United States Patent 11,337,426 (BIOLOGICAL CONTROL AGENTS AGAINST FIRE BLIGHT) - sequence listing, part 7

SEQ ID NO: 59 - DNA, 75321 bp, Pseudomonas poae FL10F
ctcaatcaaatgtgggagctggcttgcctgcgatggcatcaactggttgtgcctgatacaccgaggtgcctgcatcgcaggcaagccagctcccacagaaaagcagagcgcaaaagactggcggccgaactcggtctaattgtgggagcgggcttgctcgcgaaggcggtgtatcagccagctcatgtgtcactgacccaccgccttcgcgagcaagcccgctcccacattttggatctcagtacatcaggtagatgtgcttttgccctgcttttgcttctaccactcaggtcggctactaggccgccgtgctgtagatcttgatcttgatccgggatcgccccatcaaccacgctggccgaacgcaggcttgaatccgtgggtaacccggcaggacgccgggttagccgcactgggccagggatggcccattgcggcggcccacggattcaagccggagtgagggcacaccgagcctaggcgaggtgccgagtggtggggcgaagactttttggttacttttgtgtctttacaaaagtgacccgctgtaagagcggaaccctaagccgccgttacctaaataacggatacacccccatcaaaacgccaacttatacccaatggtcatcaacatcaccgccagacacggtcgcagcacaccatcaggaaccttgccggtcatgtgactgcccaggtaaatcccaggcaacgaccccatcagcaaaaaccccagcaaatgccaatccatgttccccatgctggcatgccccaaacccgctaccaatgtcagcggcaccgcatgggcaatctcggtgcccaccaaccgccgcgtggccaggaacggatacagaataaacagcgccaccgtgccgagcgccccggcgccgatggaggtcagagcaaccatggtgccgaggaccgcaccggtcaccaccgtcagcgcattcaggttgcgcgggctcatgtggtagtcatcacccgcatgccgctgggcaaacgccaacaggcttttcttgaacagaatcgccagcgccgtgagcagcaacaccacgccaagcgcctgtttgatcaccgcgttcatggcgctcgggtcggtatgcaggctggccaggaaccacaaggtcaacagcaccgcaggcacactgcccagggtcagccagccggtgatggtccagtcgatgttcttgttcttgctgtgcaccagcacgccaccggacttggtgatcgccgcatacaacaggtcggtgcccactgcagtcgccgggttgatgccgaaccacaacaggatcggcgtcatcaacgagcccccgccgacaccggtcatgccgacgataaaaccaacgatcaggcccgcgattacaaaaccaaaattacccacatccattacaactacccgcggccttataaatttctggccgcaggatagcgatttttcatataacgacttatatcaatgtgatctgactttatgcctttttcgccagccgctgacacacataggcctgggtctgatacgggaaagccaccgtatcacggccgcgcaagtcgggatgggtgtcgatcagcgcctgcaattgcgcggtgaccgtggctttggcagcaggcggcagcgccgcgataaaactcaccgacaaaaagcgatccatgatcacctcctgcgggctgccaacatgttgatacgtaaaagtggtcatctcaggcgcggaaaaatattcgccggtgaaggcttcacgccaacgccctgtgtgaaaacgcggcgtgtcgccctcgtacggcgtaatgatgtcggtaatcgcggcgacccaatccaccgactcgtcgcgcacattccacaccaaccccaggcgcccatcgggcttgagcacacggtggatttccgccagcgccgcctcggtggagaaccaatggaaggcctgggcacacaccagcgcatcggcgacagcggtgggcagcggcatggcgtcggcggtgccttctaccaggcgcacgtccggcaggagtttattcagctgcgcgcccatcgcctgcactggctcaacagcgatcaacgcgggcgccagggtgctgagcaaacgggtgaacttgccggtgccggcgcccaggtcgatcaccgtcgattgcgcatcgatgtgcagcgcctcggtcagccagccggtgagttgtcgtggatagtcgggccggccttgggcgtaggtgacggcctgggtagagaaaccctgttgagcagacgtgtgaacaccagtcattgccaatctctcctcgggtaaagcggggggcacagtgtgcgcccttgtgcatttattttctaatcactgcatccaatcgtgcgcggcctgggtagtgcttacagtgaccccgctgttttactcaatggagaaacaccgatgaacgttaaagcactgttctgcctgaccgccctgctggccgctgcgccaatagctttcgcccagaccggcctgcccgacagcatcaaggtgccggaggggcacaaggtggcgctggagaccaccggcgtcggcgaaatcacctacgaatgccgcgacaaagccaacgccgccggtcacaccgagtggacgtttgtcggtcccaaggctgtgctgaatgaccgcagcggcaaagccgtcggcacctacttcggcccgcccgccacgtggcaggccaatgacggctcgaaaatcaccggcacccaactggccgtggcgccgtcgagtgcgggcaacctgccctatcagttggtcaaggccaacccggccgaaggcaaaggcgcgatgaatggcatcagttacgttcagcgcgtcgccctcaagggtggcgtggcaccgagcactgagtgcaccgtcgcgaacaagggcaagcaggaagtggtgaagtaccaggccgactacatcttctgggcggccaactgagtaaattcagctacgctgctgcgatagcgccccggcctttgggtcggggtattggccttgatcttgcggcgcaaaaccgtgtccttacctgaatccctgtttgattacgacgcctgtctgcaggcctgtgcccgtggcgatcaacatgccctgcgccgactctatgagcaagagagcagtcgcctgctcggcgtggccctgcgcatcgcgcgcgacaaagccctggccgaagacatcgtgcatgacgcatttatcaagatctggcgtggcgcggggagtttcgaccccagccgtggctcggcgcgcggttgggtgttcagcgtaactcggcatctggcgctcaattttgtgcgcaatcatcaccgcgaggtggccttgagcgaagcccatgagcacgtcgtaaccgcccacgacacctttgaattcaccgcgcgctccgggcagattcagcattgcctggaacagctcgatccggcccgtcgccgctgcatcctgcatgcttatgtcgatggctattcccacagcgaaatcgcacagaaactggacactccacttggaaccgtcaaagcctggatcaaacgtagcctcgccgcgctgcgggagtgcatggcatgagtaatccacttgacgaactggccagcgagtacgtgttgggcaccctgcccgccgaacagcgcgccgaggttgaacggcgcttacctatggacgccgagttgcgtgcggcggtggacacgtgggagcagcgcctgctgccactgacggcattggctgagccggtgccaccctcgtcccagttatggcggcgcattgaacacactgtcgcgcccagcgatattcaagtgccgtggtggaacctgctggcgctatggcgcggtttggccggcgcgggtctggtagcaaccttggtattgaccaccctgctgctgacccgcccgcccactgctgaaccgacctttgtggtggtgctggtggcgccacaaagtcaggcgccgggttgggtgatacaggccagcaatactcagcaaatccagctgataccgctgggcgtgatggaggtgcctgccgacaaggcgctgcaattctggaccaaagcggagggctggcaagcccccgtatcgctagggttggtcaagccggggcaaacgctgtcggtgccgctgaacaagcttccgcccctggcacccaaccaattgttcgagctgaccctggaagacccgaatggctcgccgaccggcaaacccaccgggccgatccaggcgatcggccgcgccgtcaaggtgctctgatcagccgacgctgggcaaccacagacggaaccgtgccccgcccaaaggcgacgcctgggccgtcaacgtgccgccctgggcttccatcgcgcggcggctgatcgccaggccgaggccgaagccgccggtggcgcggtcgcggctgcggtcgaggcgatagaagggttcgaaaatgcgttcacgctggtccaccggaatgccgatgccgtcgtcgtccacccagatttcacagccgttggcgcacaccttgacgcccacctggatgcgcttgtcgcagtaacgcgtggcattgcgcagcaggttctgcaatgcgcgggcggtgaggcgcgggtcgaggctgaagcgttcgacggcgcagtcgagcgccacgtcgataacaatttcggggttctccagctcgtcgtcgacgctgccgagcacgctgtcgatgaactcgtcgagcaccacctcgacgcgttccggcaattgcgccgggttttgcaggcgactataggagagcagctcgagtaccaactcatccagctcacgaatgtgcgccaccaggctttgcaggcgttcgcgactggccggcggcaagtcttcggacagggccagggccaggccgaaatccaggcgcgtcagcggcgtgcgcagttcatgggagacagcgttgagcaggtcgcgctgctggttgagcaggcgttcgatatcgtcggccatggtgtcgaacaccgacgccaggctgccgatgttggagctggcgggaatccgcgtgcgctcggccaggttgcctttgccgagctgggcggcggtggttttcaggcgctccaggtcacgccagtgcgggcgcagccagaacagcaggcaggccagcaacgcggcgccgatcagcacgttcatcgaccagtacaacaggttcatgtccagcgggtcgggcgggatggtcagcttgaccgcaaactgctggttgatcggcgaactgacctcctccatccagccccactcgcccaggcggatcaccggtttgccgtgttccagcaactgttcttcttcggggctgtagctcgcgtcctggcgcagcagcagttgcactttaagcggcgcaaaatcgcggctcagttggtcggtaacctgcgaccaacgctcaaccggcgcccgcaggtactgcttgacgatgagtttttgcaggccgcggctctgctcgacgttgtagttcatatagcggtgttcgaacacctgaatcaccagcttgggaatcaggtagatcgccgcactgtaggtgacgatggtgatcaggtagaggcgcagcagcacacgaaacatggatcagcattcccactcggaacggctgaacaagtagcccttgccccacacggtcttgatcttgcgcgcttcaccggcgtggtcgtcgaacttgcgccgcagcttggagatggccacgtccaccgaacggtcggtgccgttgaactcgatgccgcgcagccgttgcaggatctggtcgcggctgagcacttcaccggcatgccgggccagcaccaccagcaggttatattcaccgctggacagctccaccgcctgctcgcgccaggtcacggtacgttccgacaagtcgatgcacaggttgcccatgacgatctggtcattcgccatttggggctcggacaggctgctgcggcgcagcaaggtgcgtacacgggccagcagcacgcgcggctcgcagggtttggtgacgtagtcgtcggcgcccatttccaggcccagcacctggtcgtggctgtcgtcgcgggcggtgagcatcaaaatcggcaggcccgccgagtcggcacgcagcaggcgacacacctgcaagccgtcgaggccgggcagcatcaggtcgaggatcaccagatccggcgggttgaggcgcgcgcgttcgcgtacgtggtcgccgcggctgagcacgctgacgtggtagccattgcgttccaggtagctggcaatcagctcggagagtgcggcgtcgtcttccaccaggaggatgttgggcatggtgtttccaaataatgcaatttgttggtgtgttgcaggattgtgcaaggatatacgccctcaccgaactatgggctgcaccttacatttcttcacagacgcgctacacagcttcacagcaccacggcgcaggtgtctttaggatgcgccagtcaataatgggatatgagcatgtcgaagaatctgtttgcgccgttttgcctgctggccctgtcgctcgccctgagcgcctgtggcaagtcggcggacgaagcgccggaaacgcccctggccaaagtccgcgtcgaaacgctgcaggccaagcctctctcgatcaccagtgaactgagcgggcgcatcgccgcgccacgcattgccgaggtgcgcgcacgcgtcgccggcgtggtgatgcaacgggtgttcaaggaaggtcatgacgtcaaacagggcgacgtgctgtttcgcattgacccggcgccctttaaagccgacctcgacagtgcccaggccaacctgagcaaggctgaggccaacgcgttccaggcgcgcctgcaagagcagcgctacagccagttggtcgaaggcaacgccatcagcggccaggattatgacaacgcccgcgccgccgtgcgccagaccaacgccgaggtcgccgcgaacaaggctgccgtcgagcgcgccaaactcaacctgggctacgccaccgtgaccgcgccgatttccgggcgcatcggccgcgcgttagtgaccgagggcgcgctggtcggccagaacgaggccacgccgctggcggtcatccagcagctggacccgatccacgccgacctgacccagtccacccgcgagctcaacgacctgcgccgcgccttccgtgccggcagcttgaaacaggtcggccaggaccaggccaaggccacgttgatccaggacgacggcagcctgtacccgctgccgggcaaattgctgtttgccgaaatcagcgtcgaccccggcaccgggcaaatcatcctgcgcagcgagttccccaacccggacctcgacctgttgcccggcagttttgtgcgcgtgcgcctggaacaggccgtggacaaacaaggcatcagcgtgccgcaacgcgccatcacccgcgacagcgccggtatcccgatggtgctgctgctcgacgccgaacagaccgtcagccagcagccggtggagctgggcgcggtgatcgaggatcgctggatcgtcagcagcggcctcaaacccggtgaccgcatcatcgtcgaaggcctgcaacatgcgcgccccggtgaaaaagtcgaagtggacgacagccccgcgccgaatgcccaggcctcggtccgctaaggaaaggaatacctgacaatgccgcagttctttattgaccgcccgatcttcgcctgggtggtcgccctgtttatcctgctggccggtgcgcttgcgatcccgcagctgccggtggcccagtaccccaacgtcgcgccgccgaaggtggaaatctacgcggtgtaccccggcgcctcggcccaaacgttggacgaaagcgtggtcagcctgatcgagcaagagctcaatggcgccgaccacctgctgtatttcgaatcccagagcagcctgggctcggccaccatcaccgcgacgttccagcccggcaccgacccggaaatggcccaggtcgatgtgcaaaaccgcctgaaagcggtagagccgcgcctgccgcaagcggtgactcagcaaggcttgcaggtggagaaagtctccgccggtttcctgctgctggtgaccctgacgtccagcgacggtaagctcgatgacgttgcgctcagtgattacctcgcgcgcaacgtgatgaacgagctcaagcgcctcgacggtgtgggcaaggcgcagttgtatggcgccgagcgcgccatgcgcatctggatcgacccgcagaaactcatcggcttcaacctcacgccggccgacgtcaacgcggccgtcagcgcgcagaacgcccaggtttcggcgggcagcattggtgatttgccgggcaccaagacccaggaaatcaccgccgcaatcctggtcaagggccaactgtcgacgccggccgaattcgccgacatcgtgctcaaggccaaccctgacggctccaccgtgcgcatcggcgatgtggcgcgggtggaaatcggcagccaggaataccagttttccacacgcctgaacggcaagccgtccaccgccgtcagtgtgcagctggcgccgggggccaacgcgctgaacaccgcgacgctggtacgggcgaagatggacgagctgtcgcgctacttcccggccaacgtggaatacaagatcccgtacgacacgtcgccgttcgtcaaagtctcgatcaccaaggtggtctacaccttgcttgaagccatggcgctggtgtttgcggtgatgttcctgttcctgcagaacgtgcgctataccttgatcccgacgctggtggtgccgattgcactgatgggcaccttcgccaccatgctgttgctggggttctcgatcaacgtgctgaccatgttcggtatggttttggccatcggcatcctggtggacgatgcaattgtggtggtggaaaacgtcgagcggatcatggccaccgagggcctgtcgcccaaggaggcgaccaagaaggccatgggccagatcaccggcgccatcatcggtatcaccttggtgctggtagcggtgttcctgccgatggcgttcatgcccggctcggtgggggtgatctatcagcagttctcgctgtcgatggccacctcgatcctgttctcggcgttcctcgccctgaccttgaccccggcgctgtgcgcgaccttgctcaagccgattgccaagggcgaacaccacgccaagggcggtttttttggttggttcaacaaacgtttcgatagccttaccaaccgctatgaaggctgggtggcctatgccctcaagcgcagcggccgctatttgctgatctacctggtgttgctggtgggcctgggctggatgttcagccgcctgccctcctcgttcctgccggtggaagaccagggttacaccatcaccgatatccaactgccaccgggtgcgagcaaaaaccgcacggtgcaggtggccgagcagatcgaagcgcataacgccggggagccaggcgtgggtgataccaccatgatcatgggcttcagtttctccggctccgggcagaatgcggcgctggcgtttaccacgcttaaggattggtcggaacgcggcagcgatgactcggccgcctcgattgccgaccgcgccaacgccgccttcagtgagctcaaggacgcgattgcctacgcgatcctgccgccaccggtagacggcctgggcacctccagtggtttcgagttccgtttgcaggaccgtggcggtgtcggtcacgcggcgttgatggccgcgcgaaccgagttgctggcggctgccgaaaaaagccctatcctcgccaacgtgcgggaaagcgccctggccgaggcaccgcaagtgcagctggaagtggaccgcaagcaggccaatgcgttgggcgtgtcgtttgccgacgtcggcaatgtgctgtcctcggccgtcggctcggcgtatgtcaacgacttccccaaccagggccgtatgcaacgggtggtggtgcaggccgaaggcgaccagcgcagccaggtcgcggatttgctgaagatcaacgtgcgcaacagcgccgggaagatggtgccactgtcggcatttgtcgaggccaagtggacccaaggcccggcccagctgacccgctacaacggctaccccgccatcgccatcagtggcgaagcggcaccggggcacagcaccggcgaggcgatgagcgaaatccagcgcctggtcagccagctgccggcaggcctgggccaggaatggaccgggttgtcgctgcaggaacgtttgtccggctcccaggcgccgttgctgctcggcctgtcattgctgatcgtgttcctgtgcctggcggcgttgtatgaaagctggtcgatcccgacctcggtgctgctggtggtgccactgggcgtgctcggcgcggtattggcggtgagcttgcgcggcatgcctaacgatgtgttcttcaaggtcggcttgatcaccatcatcggcttatcggcgaagaacgcgatcctgatcatcgagttcgccaaggacctgtacgaccaaggtgaagacctgatcgacgcgaccctgaaagccgcgcggctcaggttgcggccgatcatcatgacgtcgctggcgtttatcctcggcgtggtgccgctggcgattgccaccggcgccagctcggccagccagcaagcgattggtacaggtgtgatcggcgggatgatcaccgcgacattggcggtggtgtttgtgccggtgttcttcgtggtggtcatgaagctggtgcgcaaacggcgttaacggtggcatgcgggcctagtgtggcgagcgggcttggtgtggcgagcgggcttgccccgcgttggggcgcgaagcggccccatcaggcccaccgcgtttttgcagttagaacacggtagctggttttggggctgcttcgcagcccaacgcggggcaagcccgctcgccacaacaagcccgctcgccacagcaatcccgctcgccacagcaagcctgctacccacgacaggcgcgctcgccacagaggtcagccgttggagaatgcgctatcgtgctcacaacctcccctgttgtgagcccctatggccttcctcgcccgcacccaccctcgcctctcatccgccgccgtactcggccttgccgtgggcatcctggcgccggccgatacgctcatcagcaaaatcctcatcggctggaacgcgggtgtctggacctacctgctgctgatgctgtggctggcgacccgcgcccgtgccgacgacgtaaaacgcatcgccgaaatcgaggatgaaaacgccgggttggtgctgttcatggtgtgcatcgccgcgattgcgagcctggcgaccattaccgtgaacctggtgggcagcaaggacctggacagcacggcacgcgcgcttcattacggctttactggcatgacggtggtcggctcgtggttgctgaccggggtgattttcagcgtgcattacgcgcggcttttttacacctgggaaggcgaagaacctgcgctgcgctttgccgaaggcttgcgcaaccccaactactgggacttcctgtacttctcgttcaccatcggcgtggcggtgcaaacagccgatgtgggcgtggcgacacggagcctgcgcaaagtggtgctgggccaatcgttgatcggttttctgttcaatacggcaatactgggtttctcgatcaatattgcggcaggcttgttcagttagcgcgagcgtgctgatctgaggcccacaatcgataacctgcggcgagggagcaagctccctcgccacagtacagcgcttgttattaaccgactggcattagcccattttacttagaaggcgtactgcaaacctacagtgagacccaaaggctgatcgtaagccttgcctttcatgtgcgtgacttcgccatgcacactcaggtttttcgtcaatgaagcagccacgccgcccgcgacctctacaccgctccctgacaggttgtttttgaacgcctgatcgttgatatagaccctgctgtccgggctgaagtcgcgcgttgcggcagtacgcaggtacggctgcaggatgccgccgctgtcgagctggatgttttggccgacagtgacacccaccttgccggtcgcggaagtggcacgatcgcttttggccttcaaaccgttgtccatggtgtagttggagccgccaattttggcaacggccacctgagcgaagggttcgacaaacaagccgtcatcattgagcttgatgttcttgccgatttcagccgaggcactcaccgcgtcctgggtatatttgcctttggcgcgcttaccatcgctcatgttgacctggctttgaccattcaggcggttgaccttcgccgtcaggtcgaggtacacgccgctctcttcatcacgaaaaatgccatagacaccggcgtagtagctgttgaccataccgctgctgccgcggctcaggcccagggtggagttgctgtaaccgcccatcacaccgactgtccacagttcatccatggcccagtccgcacccagggtcaggcccgactgattctgtttgtaacccacgccgttggtgttggcggccacgtctgtccggttggtgtaattgcgtatccacaggcctttctccttaccgtcgccgaagcggacttcacccatacgggtgcgcaatacgctcgcttcgcccagcaataccgccggtgcagcgttggcgagcgccagcacggccttggcgctggtactggtgccctttttctcggtgtccaggtaccagtcggtgccttcctgcttgagcccatattcgaacgcgccgacatcgacggtatcgcccaccaggccgaacttggcgccgccgctttcagtgtgcaccactttgatcgcctcaccggtggccagctccgagccacttgcaccgatcaacaattggtgatcaccttcggcgttgccgttgacgttcaacaggtcggtctcgccggtgttgaagttggtgtacattttgaacgtaccgttgccggtcaagttgttggtattgagttgcagatactgcagcggggcaccaaacaccacgttaccgccgcccattttcagcgtattgacctggctgtcgcccaccatcacccactgagcgtcgctgttgacgtcaagttgctcgacgttgcgtaactggccggtcagcgaggcattgttgttaagttgcaccgtgcccaagccgccggtgccaatcaccacatcaccgatcaactggctgttgtcgacattcaggttggcggtggagttattggcaacttcgagcagcacaccattgccgccaatcaggttcgagccgttaagcacatgaatattggacttggtgttattgcctgggcccggggccacccgtatggcagcaccggttttcccctggaccacggaattatccaggatcaaggtattggtccgcgacacactcccaagcgacgtcatatggacgccgtttaccccgcccaaaataagacttttattctgtgcgttagcgtcggcattaaacattactatacctatgccggcggcggtggtgccctcgacatgggcattgtccagattcgccacgccatagatgccggccgaaataccgcgcagggagccgaaaaccctgctgtctttaaccgtaacggttgaaccatccgtgccgccgagcgcagcgtttatcgctacaccccaaccattaacattggtcactgtactgttgttggtgattgtcacggtgctgttgttactcgcataaatggcttccgtgttgccaatacgcgagttgactcgtgagttattaacgacgattcttgacccgtgcgtcgccgtgatatctcccgtcctgctgccgggctgcaacgtcaagcctgcacgcgccatcaaaatctgccgggtttgcgcgccgtggactatcaggctcgaaccgggatacagcacataattatcaagccgcacattcggtgctatcgacgtattaggacgaatcacttgcgtctcggcgtgaacattggacgaggccagaaacactaacgtgactgcaggggccgccaacgcaaggctcagaggcgtttttttgaagttaaatgctgccgacatacgatggacctctagtgcctgtacgaaacgataggacgggctctcaaactcgcgagatcaaccccatcaagcgcggccataattaaccagcgcatcgttcagatctgtaggacttctcccaagaaactgccaaacagccaacggatcatgtaagcgcagcgccttaagcggcgctgaaagcaccgagccgctacaaacagcaatgccaaagagggttcaacccctctttggcaatttcccttgcgttttttatttagggcgttgtaggcgctgcaggcatagccaggccctcacaatagttgatgcgagacgtcgctcccttgtaaccccttacgcgataagtggtgggacgagaaggtaccgtctgcccttgatacacggtcgaaacagtgaccgttgccgacccggtggccgtgctcccgcgattcggcgtgagtgggttaaacagagccaccgaggactcatcaaataccacgtcccacccattgcgagcagcaacatcattaggtactacgaaatttttcgatatatcgactacagagacgccatttgcaaacccttggtacctgacggaaaccgtctggtttgcggccaaatactccgaaccggaaatatggacgctgagtctgccggtactgggtgggctcaagctatcgcaggtaagcgtagctggagtaccactggcacgtagcacctctggcggatccatttgcatgatcacagagtctatcttgacgattgtaggcccggagtcttgcgggttgccgctggccgcggaggtgatggtgtaatacgcgatctgactagggccgccggcagctttgatatcattaaaggaaataggaatctcctcataccctgatgcagaaagggtcgtgacagtccgtgggtagtgcttgccagcaaaatgcaatgtgtacgtccaaggcagtgagtcagcgggcaatacggcgccggtccagtatggaattcgagcgatcgcaccccggcctgcgtctcgagcctccaaatggttgtccgtgatcggggcagtatcgctggcaggacgcacggggcgcactatcgccagcggcaagttggtattgactggccctggcccggtagggttgggccccggaacagacaagtccagatcgaatggcgtctccaacgccaccgccgggtaggtgtttgttccacgacgcaggacgtaagatgccacaatcggcacccggtttttgccgactgctctgcccccgtacagcgtgtccatggcatccgagtcaaacgtgatgaatcgacccgtaccaactggcgttggtcgcgagagggtgattggcggtgtgaatgaagtcgagatcagttgaagatcaatgatatctgtcgcaagcgcgttggggatgttaagaatctccattgtcgtaccgcgctgcgtcaccacatcagctctgtcaatcaagccatcgccgggcacggctagagcaaccagaggcgcacggaattcggttggcaccggagcctgtgccaagctgttcaggttcaagctgagcgaccgctcggatggattgaggccagcgtcatacagcctataggtaagcgtataaacgcccccagtctcggcctggacaacgtcccacggcaggtaaatgcccggacctcgggatgcgtcgaactcctgtagtgtatccgtgccgatcgcgtaaggttcctccgaagagccgaaatacgctgccaatttatcgcccggtgcgtacccttgggcctcagagtaatctatcgggaagaacgccatgttgtttggctgggttctaaaaaaggcttcatccagcgtcgcccccgccggcaattcaagcggcagccgtggtcgaggagggctgatgcgaggctggtcgtagggcgacgtctcgtcgacgatcaatagttgcggaaccgaaatattaaaactctttgcaccgagctcccacaccttgtacctgatcaaatacagcccaggggggcgaaagccttgcggtatatccacctgaatagggtcggtcaaactcgaaacttgacgtcgaaaccttgaaccattggtatcgaaatagtaattctcggcggcggctttcttttgatcttccgtgagcggcggagcgggcgtcactgacggatcgtcctcctcctcctcttcctctggatctttatcgggttctggaggtgggggcagcgtgtccaagttaacaagcgggacgatttggacgtctattaactgaccaatggcgggctcaagccatagctcgatattaaatattgtgctctgacttcttgaggccgcacgcgtcaacaacccgcggtaccctggaacttcccctgccaacgtaccggggttaaaagcctgggggatgtagaagtcgacatctcgttctacgaaactatcaataattgctctatttgtacggtccattgtcttgctccggatagttaaaccactcacaccaacagcacacttcgaaagttgaataaacgttgtttatccaccgcgaaccctttttaaaaatatgacaacactggcgacacacacttaatcaatagctgatttcaatcacagcacattcaaccggccacaattcccttgtcagagcagtacttaccgccagggtacgtcaagtcaatacgtactttcccgggaagtgattcagcgactttttcgccgtgacgccatacttcataaatcaacgtagcggagccgcgtttgcgcagcggaaaaatcgctgtggcgaactcatccacaatgaccttcatcaccccggctgccgtatgagttgcttcccaaaacagtgactgactgaacacgacattcgtattgacggtagcccagttattctcgttaaaccctacaaacttaaccgttatcaaatcgccaatacgtatattgggattggccgctattttccaaacaatacccttcaccggtgagggttccgaatagcagttcaagtaatcgttgatgagttttttgtgatcgtactctggtgccggcagcggaataactttgacattgacattagtcacgggcgagcgctgctcgttaacgccattgctggtggtgtaatgcacagcataagtagcggtattggcaccactgaccaccgaccacggcacgttgggaaaatacacccaattacccgctgtatctgcggtgcgcactgtgtaggtcgccaccgggcccacaccgttccagaacaagctcaacacctgccccacctgcggcgtttcaaacaaacgcacgcggacttgcactggctggcctcggtcggcatcaaccagcatattgctgccggtgagccccacaatttccgcccgagccagggtggggttcagcagtgctggcgcattggggtggtcctggccggcaatcgtcaggtcgacattgaccgataccggtacagaaggcgccggcgtcggattaagcccataaatttcgtaacgaaccggtacgctctgcttcgccagaaccgcggccgggcccctgagaacagtccagggaatttcaacatcgaaagggagctgggagacgaccagccgagtagtcgggcgatcatcccagtacaccaccacttcatgcttggcagcggctgaccagccagggtagccgtctatacgcacaaacaccccgccgccttcatcccggcgtgcgtcatcgcgcttgatcaactgatcgttgtagaccggagggcgaatgctcggggccggcaggccaagcgccatcacaaaaggcaggccagcactcattgcgctgtaattgccggtctcatcaaaaacccggtagaacagccacgcagggccattgttcagcttgcgaaacgcagcggggtccaaggtggccgtccatcggtcggtactgaaatccaccaacgagcccccatccgccggtttctccactggctgtgacgaattgaacagatagaacgcaattcggtcattcaatgcatcaatgtcgtaggacgagaaggaaatccgcacgggctgatgggcaaccagatattgctcggtgatcgccggcccaggtggcgcaacaaattcggcaacgtccgacggcaggcgcagtgatggcgcttccaggtcaatggtgatgtaaacgctttcgctggtactgagcccgccgtttatctgaaaggtgtaataaacgcgcgcgactcgagtagcgcttcgcaagtcggataatttaatttcgcgttcgtaatattggggaatagccggtgggggtaccttgacctcaaaggagtcgagcaactttattacatcgttgctttcccaccacagctggcacgtgtgcacgaggtcatacggcgctgacggctctggaatccaagaggggatcctgactttcaacgcattgcgcagcagctcacgcgacacaatacccctctcgtcggtggtatcgacgcccgggatcgtgacggggtcaaccccctcggtcccggggaaagcggtgcttaaaaggctggaacgagcagtaatttttttgggagtggtcatgttccagcctcaagatgaatttcaccacggcgaatcaggaaggcatgcctttacctgtcagcgatggaaaaattaaacgcctaaagcgcgtggccggatactgtcagaactaacaggtaagcctatccgttcgtcgattttcttgagttgggtgccgttacccatttccaaatattccttgacgaaacggttcgactggcattccatgaaaccggtttcagcgttatcagccctcgatggaaccgctaaatccaataagaaaggcccgctaccgtgaccccattttccgccgcccagcgcagccgcgtgaccatgctcgacgtcgccgaacgtgccggtgtgtccaaagccagcgtgtcgcgctttatcggagatgaccgcgccctgctctccgacgccattgcgctgcgcatcgagcaggccatcagcgaactcggctaccgccccaaccagatggctcgcggcttgaaacgcggccgcacacgcttgatcggcatgctggtggccgatatccgcaacccctactccatcgccgtaatgcacggcgtcgaaaccgcctgccgccaacacggctacagcctggtggtgtgcaacaccaaccgcgacgacgcgcaggaacgccagcacttggcggcgctgcgctcgtacaacatcgaagggctgatcgtgaacaccctcggccatcaccttgatcaattgctcgagctgcagcaggaaatgccgctggtgctggtcgaccgtaaagtcgagccgttgcacagcgacctggtcgggctggacaaccccgcagccgtgcgtatcgctgtggagcatctgcagcaacagggttatcgcaatgtgttgatggtgagcgaagccgccgatggcacgagttcacgcctggagcgccaagccagtttcaccgccgaaattgccgcccgccccggcttgaccggcgcggtgctggaactggatgacgcgctggaaaaacacctgcagacctttctggccaaccccggccccaaggccgtgttttgcgccaacggcattgccgcgctggcctgtacccgcgcactcaaggccctgggctgcaagctgtttgaggatgtcggcctgatcgccctggatgacctcgactggtatccgttggtgggcagtggcattaccgccctcgcccaacccaccgaagcgattggcgccagcgccttcgactgcctgctcaaacgcctgcgcggcgacgacgcgccgacccgcaccctggattttttgccggagttaatcatccgcggctccacccaatcccttgtgggagctggcttgcctgcgatgacggtgcaccagacgaagccgtagccgcctgacacaccgctatcgcaggcaagccagctcccacattagttttgcgtataaaaatgaaaccggtttcagaggtacacaacaatgcataaataccccgtctccatcagcctttccagctacggcgccgacctggttcgcgagcgtggccaattgagttttgtcgagttgctcagcgcagccggcgcccagcgcatcgaatggcgtgaagaactgctgacccgcgaacacccggccacattggcccaggccgccgccgagcacggcctggaatcggtgttctcttcaccgctggaactctgggtggccgggcgcgcccagccgaatgccgacctcgccgccaccctggaccgcgcccaggctttcggctcgcgctggctgaaagtctccctcggttacttcaccgacaccaacgacctgcaaagcctgcatgccctgctcaaccgccacccggttcaactgctggtggaaaacgaccagaccttgcatggcggccggatcgagccgatgcaacgttttttcagcgaagtcgagcgcctgggcctgccggtcaaaatgaccttcgacatcggcaactggcagtggcaggaccaatccgccctcaccgccgcgcgcctgctgggccgccacgtggcttacctgcactgcaaggccgtggcgcgtcggccggacggcaagctggtcgccctgccgcccggcgccaccgacctgcatctgtgggaacaactgctcaaacatatgactcaaggtattacccgggccgtggaattcccgttgcaaggcgatgacctcatcgacgtcaccgcgcaacaggtcgccaccctcgccctccttggccagccgcgtgcggagaatgcccatgtctgagatcgatatcctctcgtttggtgaaaccatggcgatgtttgtcgccgagcagaccggtgacctggcccaggtggcccagttccataaacgcattgccggggccgacagtaatgtcgccatcggcctgtcacgcctgggcttcaatgtggcctggctgagccgggtcgggcaggattccctcgggcggtttgtggtcgacacgttgaaaaacgaaggcctggattgtcggcatgtggcggtcgacccgctgcaccccaccggtttccagttcaaatcccgcgaagaagccggcgccgacccgcaagtggagtacttccgcaaaggctcggcggccagccacttgtcgattgccgccatcagtcccgcgctgctgcaggcgcgacacctgcacaccaccggcattccccccgcgttgtccgaggccacccgcgaactgtcccacgagttgatgacgcaaatgcgcaaggccgggcgcagcgtgtcgttcgacccgaacctgcgcccctcgttatgggccagccaggcgcagatgatcagtgaaatcaacgccctcgctgccaaggcggattgggtgctgccgggtttgagcgaaggccgcttgctcaccggtttcgacgacccggccgacatcgccgcgttctatctcgaccagggcgccgaagccgtggccatcaagctgggaccggacggcgcctattaccgtacgcagatggaccaaggctttgtggccgccgtgccggtggaaaaagtcgtcgacaccgtcggcgccggcgatggttttgccgtcggcatgatcagcgccctgctggaaaacctcagctttcgcgaagccgtacagcgcggtaactggatcggcagtcgcgccgtgcagagccgcggggatatggaaggcttgcccacccgcgcggagttacccactcgatccgttgcatgacttaaaccctgttgccacaactacaacaagctcaggagcaactttatggacaccttgaaactcgccacccgccgctggtggtacatcatgcccatcgtttttatcacctacagcctggcgtacctggaccgcgccaactacggcttcgccgctgcttcggggatggccgaagacctgatgatcacccccggcatgtcctcgctgctgggcgcgttgttcttcctcggttactttttcttccaggtgccgggggcgatctacgcgcaaaaacgcagcgttaaaaagctgattttcgtcagcctgatcctctggggcggcctcgccacgctgaccggcgtggtgtccaacgcctacatgctgatcgccattcgcttcatgctcggcgtggtcgaagccgcggtgatgccggcgatgctggtgtacctgtgccactggttcacccgcgccgaacgctcgcgcgccaacaccttcctgatcctcggcaacccggtgaccatgctgtggatgtcagtggtttcgggctacctggtgcagcatttcagctggcgctggatgtttatcatcgaaggcttgccggcggtgatctgggcgtttatctggtggaagctggcggatgaaaaacccgccgacgccaagtggctgagcgagcagcataagcgcgacctggaaagcgcattggccgccgaacaagtcgggatcaaggcggtgaagaactacgccgaagcctttcgctcacccaaagtgatcatcctggcgctgcagtttttctgctggagcatcggcgtgtacggctttgtgctgtggctgccgtcgatcttaaaggccggcttgcagatggacatggtcgaagccggctggctgtcggcgctgccttacctggcggcggtgatcggcatgctcgccgtgtcgtggggctcggacaaactgcaaaaacgtaaacgttttgtgtggccgccgttgctgattgcgtccattgcgttctacgcctcctacgtgctgggcgccgaacacttctggtggtcctacaccttgctggtgatcgccggggcctgcatgtatgcgccttatgggccgttctttgccatcgttcccgagatactgccggccaacgtcgccggtggcgccatggcgctgatcaacagcatgggcgcgctgggttctttcggcggttcgtacctggtcggttacctcaatagcagcaccggttcgccgggcgcctcgtacctgctgatgagcggtgcgttgatgctctcggtggtgctgacgattttcctcaagcccggcgccagcgaccgtgtgcgcgtgccgatgcctaccctcgaattgaaggccaaaacctgatgaaaaaatctgtcgttttatacaaaaagctctccgcgccgctgatggcccgcctgcatgaacacgccgacgtcacgctgattgaggcgctggatgaaagcggcctggccaagctgcgcaacgccttgcccggcgcccacggtttgctcggtgccagcctgcgcctggacgcaaaactgctcgacctggcgcccaaactcgaagcggtggccagcgtttcggtcggcgtcgacaactacgatatcgactacttgaccgagcgcggcatcctgctcagcaacaccccggatgtgctcaccgaaaccaccgccgacaccggtttcgcgctgatcctggcgactgcgcgccgagtagtcgaactggccgacatggtgcgcgccggccagtggagcaagaacatcggcccggcacatttcggcaccgacgtgcacggcaaaaccctgggcattatcggcatgggccgcatcggcgaagccctggcccagcgcgggcatttcggttttggcatgccggtgatctaccacagccacgcgcccaagccgttggtggaggagcgctttggagcgcaatttcgcagcctgccggacttgctgcaacaggctgactttgtgtgcctgaccttgccgctgactgccgaaaccgagaagttgatcggcgctgaggaattcgcgctgatggacgcggagacgatctttatcaacatctcacgcggcaaagtggtggatgaggcagccctggtcgaagccctgcaaaaccgcacgattcgcgcggcagggttggatgtgtttgaacgcgagccactgaaccacgactcgccgctgctgcgcttgaacaacgtggtggcgaccccgcacatcggttcggcaacccatgaaacacgcgaggcgatggccaagtgcgcggtggacaatctgctggcggcgctgtcaggcgaacggccaaaaaacctggtaaatggcgcggcctggaaacactgaccccaagacctacacaggcccaatgtgggagcgagcaagcccgctcccacactgaccgtgttcatcccacatatcttgctgtgtaaacccaatccctgtaggagcgggcttgcccgcgatggcggtgggtcagtacccaatatgcaagctgacacaccgctttcgcgggcaagcccgctcccacactgactgtgttcatcccacatttcctgctgtgtaaatcaaatctctgtgggagcgggcttgcccgcgatggcgccgggtcagtacccaatatgcaaactgacacactgctttcgcgagcaagcccgctcccacactgaccgtgttcatcccacatttcctgctgtgtaaatcaaatctctgtgggagcgggcttgctcgcgaaggcggcgggtcattcagcacatcaaatactgacacactgcattcgcgggcaagcccgctcccacactgatcgtgttcatcccacatatcttgccgtgtaaacccaatctctgtgggagcgggcttgctcgcgaaggcgcctggtcagtacacaatatgcaaactgacacaccgctttcgcgggcaagcccgctcccacactgaccgtgttcatccaacatttcctgctgtgtaaatcaaatccctgtgggagcgggcttgctcgcgaaggcggcgggtcagtcagcacatcaaatactgacacactgctttcgcgagcaagcccgctcccacactgaccgtgttcatcccacatatcttgctgtgtaaacccaatccctgtgggagcgggcttgcccgcgatggcgccgggtcagtcagcacatcaaatactgacacactgcattcgcgggcaagcccgctcccacactgaccgtgttcatcccacatatcttgctgtgtaaacccaatccctgtgggagcgggcttgcccgcgatggcggtgggtcagtacccaatatgcaaactgacacactgctttcgcgagcaagcccgctcccacattgaccgtgttcatcccacatttcctgctgtttaaatcaaatctctgtgggagcgggcttgcccgcgatggcggtgggtcagtacccaatatgcaagctgacacactgcattcgcgggcaagcccgctcccacattgaccgtgttcattgcgtatttcctgctgtgtaaatcaaattcctgttggggtacctgcatctgccgatcagcgcaaggcgcggcgcagtactttgccgacggtggtcttgggtaactcggtggtgcggaactcgacataacgcggcactttgtagcccgtgaggtattcgcggcaatgcgccaggagttgttcctgggtcaggttcgggtctttgcgcaccacgatgatcttgaccttctcgccagtcaccgcatcttccacgccgatcgcggcgacttcgccgacgcctgggtgcaacgccaccacgtcttcgatttcattcgggtacacgttgaagcccgagaccagaatcatgtctttcttgcggtccaccaggcggatgtaaccgcgctcgtccatcacgccaatatcacccgtcgacagccacccctgcgcatccagcacttcggcggtttccttcgggcgcttccagtaaccctgcattacctgcgggccgcgcacttgtaattcgccctgctcaccgacgtcggccagctcgccgtcctcacgcataaaccgcacccaggtcgacggcaaaggcacgccgatgctgccggtgaattccatttcgcgcatgcgggcgatgttgatcgggctgatgctcaccaccggcgagcactcggtcagcccgtagccttcgatgatcggcagcccagtgacttccttccaacgcttggccaccgccgtgtgcgtggccatgccgccggcgatgaccatgcgcaggtcggagaaatcccgcgcgcaaaactccttgttttccagcaagccattgaacaaagtgttgaccccggcaatcccgttgaagcgctccttgcgcaggatcatctgcacgcgcttcacgtcgcgcgggttggcgatcagaatgttgcgcccgcccaggcacatgaacatcaggcagttcaccgtcagcgaaaagatgtggtacagcggcagcaaggtgacgttggtttcctgcttgttctggtccaactggtccccaacccaggccttggcctgcagcaggttggcgatgatattgcggtggctgagcatcacgcccttggcgtcgccggtggtgccgccggtgtattgcagaaaggccaaatcatccaggttcatcgccaccggaaagtggttcagcacccgcccctgtttcaacacctggttgaagcgcaaagcgcctggcagatcgaattttggcacctgcttttgcacgctgcgcaggataaagttcatcgccgcgcccttgaaggtgcccagcaagtcgccgatggccgccaccaccacgcgtttgacgctgctgccggcaatgaccttttccagggtgtgggcgaagttctcgaagatcaccacggtttgggcttcgctgtccttgagcaaatgcttgagctcatgggcggtgtacagcgggttgacgttaaccaccaccgcaccggccaggatcgtgcccaacaggcagatcgggtactgcaagcagttgggcatcatcaacgccacgcggtcgcccttcttcacgccctggccctgcaaccacgcggcaaaggccaggccttgcactttccagtcggcataggtcatttcggtgccgatgctgacgtaggcaacacgctcgcggaacttgtccaggtgctccaggaacacctcgcgcaacgacgggtaggcctcgatgccggcctcaatgtctgccggcacgccgggcaagtaagcgttcaaccagatccgttctgcgtgttccaggcttacagcgttcatggcagtctccttgttgttattgttttaacgctacttttcgacgatggcggtaatgcccagcccgcccgccgcgcagatcgaaatcaggccacgcccgccgccgttctcatggatggttttggccagcgccgccaattgccggccgccggtcgcggcaaacgggtgaccacatcccagcgagccgccgttgacgttcatcttgctgcggtcgatggcgcccagcggtgcgtccaagcctagtcgctcgcggcaataatcggcgtcttcccaggccttgagtgtgcacagcacctgggcggcaaacgcttcatggatttcaaagaaatcgaagtcggcaaagctcaagccttcgcgtttgagcatcctcggtaccgcataggccggggccatcagcaggccttcggtgccgtcgacaaaattcaccgccgccgtctcaccggtgcgcaagtaagccagcaccggcaagccgtgttcggcggcccaggcttcgctggccagcagcaccaccgaggcgccatcggtcagcggcgtggagttgcccgccgtgagcgtgccgttctggcggtcgtaggcgggcgagaggcccgcgagcttttccaggctggcgtcggcgcgcaggttgttgtcgcgcgccagacctcgataagggctgatcaagtcgtcgaaaaagccgcgtttataggccgcatccaggcgttggtgactggtcagggtcagctcatcctgggccaggcgtttgatctgccagcgcttggccatttcttcacagtgttcgcccatcgacaagccggtgcgcggctcgccattgcgcggcagcaacggcttgaaaaacatcgccgggcgcaccttgagcaacgccttgagcttgtcacccaagcccttggcacgattggccgcgagcaaggtatggcgcagggattcattgatgccgatgggcgcgtcggaggtggtatcggaaccgccggcgatgccgacgtcgatctggcccagggcgattttattcgccaccagcaacgccgcttccaggccggtgccgcaggcttgctgcacgtcgtaggccggcgtgtccggcgacaaggtggtggacaacagcgactcacgcgccaagttgaaatcccgcgaatgcttgatcactgcgccggcggcgaactcgcccaggcgctggccgtgcaggtggtagcgatcgaccaggccttgcaacgcggcgaccagcaaatcctggttgctgtcgtgggcgtatacggtgttggagcgcgcaaacggaatgcggttgccgccgataatcgccacgcggcgaaccggggccgggttgaagctgtagtcactcatcaacggctctctttccaaataaataagccacgcatatgcggtttatcaccggccgcattgcgcacttcgaactcacggcgcgggccgctcggcgggcggttccacaaggcgacctggccgggcaggaagatcggcagcttgaagtcgcaatgggcctcagccgcctccaacccgccgggcggttgctgcgcggccaatgcgcggccgagggtccacatgccgtgggcgatggcacggcgaaagccgaagattttggcgccgatcagcgaggtgtgaatcgggttgaaatcccccgagaccttggcaaaacgtcggcccaggtcagcaggcaacacccagcgctgggtgcgcaacagaccgtcttcgtgcaacggcaatacgtcctcccacggcgcgccgaccgggtctttcacgtcgcggcgcaggtacaggctgtcgctctcccacaccagtgcgtcggcgctgtaggcccgcgtggcaatactcagcgcctggcccttgggatgcgccacccaacgctcgcaaaacacctccaggcgcaaggcctgaccctcgtgcaggcgctggtgctgacgaatgcgattggccaggtgcaccatgccgctggccgggtacgggaagctcggccgcgtcagcagcatcaggtgtaacgggaacgccagcacatgcggataggacaacggcacgccctgctcacggcgaaaaccacaggcgcgcccatacgccgcgatgccgctggccgacagttccaccgccgcgcgcaccagccgtgcgttgggcagttgcggcgccgcgtcgagcttgggcttgcgcagcgcgcgcacgccgtccagcagcaactgggtgcgcgacggtggcgggtcaattatctgcgtcacgtagtccatggctcaggctcccagcaggctttggccgcacacgcgtacgacttggccattgaccgcgccggacgccgggtgcgccagccaggcaatcgtctcggccacatcaatcggctgcccgccctgggacagcgaattcatgcgccgcccggcctcgcgaatcatcagcggaatcctggccgtcatctgcgtctcgatgaaccccggcgccacggcattcaccgtcacctgctgcgccgccgccaagggcgccaagccttgcacgaggccaatcacacccgccttggaggtggcgtagttgctttgcccgaggttaccggcaatgcccgaaatcgacgacacgcacacgatgcgcccaccgggattgagcccttggctgtgcagcaatgcattgctcagttgcaacggcgcttccagattgaccgccagcacactgcgccacgcggcctcggtcatcttggcgatggttttatcgcgggtaatgccggcgttgtgcaccaccacgtcgaaggcgccgtactggctgacatgcgcctgcaacagcgcggccgcgtccgtggcggtgatgtccagcggcaaggcggagccgttcacgctgctggcggcttgctgcaacgcgtcctgggcttggggcacgtccacgcacaccacgtgtgcgccgtcgcgggccagcacctgggcgatggccaaaccaatgccacgggacgcgccggtgaccagggcgcgtcggcctgcgaagggtttgtcccagttgacggttgggtggccgtccaccggtttctccaggcgcaccacttgcccggacacataggccgaacggcgtgacagaaagaagcgcaggctgctgtccagcgcgtcttcggcgcccggcgcgacgtagagcaattgcacggtgatcgcccggcgcagttccttggccagcgaccgcaacaggccttcaagggcgcgttgggcgatggcttggggcaagtcctggcaatgttccggcgccgtgccgagcaccaccacgcggccatgctggccgaggcgtttggcgttggcgtggaagaacacgtaaagctcatcgagctgctgcaggtcgagcaccgcggtggcatcgaacaccgcgccttgcaccttgaccgtggacggcgccttgagggtggccggggtggcggcgacggtgtcggtggcggcaaaaatctgctgcacctgcgcggtcagccgccctgccccggcaacaatcaccgggttggcgaggccttgctggccgctgcgataacgttgcagcggcaagggttgcggcaggccgatggcctgggccaggcgccggccccagggggaattgacgaaagataggtagctgtcactcatagtaagaattcactcacaaccgtgtcttgccgtgtaaacccgatcaagtgtgggagctggcttgctcgcgaatgcggtctacccgatacataggtgtcagctgacccaccgctttcgggagcaagtcgaagcgtcgaaccgcccctcccacattgaccgtgttcattcagtaaaaaattcactcacaccaccggccatgccttgggaacccgcccctctgtgggagctggcttgcctgcgatggcggtgtgtcaggtaaaccgctatcgcaggcaagccagctcccacatttgagtcgggtttctcctagttgaccgaggcgttttcgctttggggggtgcggcgtttggccttgggctcaagcgcctgttgacgctgctgcaacgcttccagcaaaccgaagtcctgcgggaagtcgtcgacctggataccgtggtcggcgtattccacgtagcggccaagcaggctgtcttcgtcgtcgctgatcaggtccaatgcccgcgccttgacgcgccaggcggtgaaggccgtggcggaaatcggcatcggctcgatcaggccttgcttgacggcggacttgagccgcgcgtcgatcaactcgacttgcggaagcaggcggaagcccaattcgccgtaggccaacttgtcgatttccggccgtgggatgtaggaattggccagcaggcggtcgcgggtctcaccgggggtttgcaccacgtcagccacttgggcgagcaaacggtccgacggtttgcgcagtgggataccccacgggaaactcaagccgcgcaccacggctgcagcggctttcgaggggtagttatccagcacttcggccagggcttcgtgggcccgcagcaacgcatcctgggccgaccagtgcaccagtggcaggtcggcctggggccgcccgtcatcctcaaagcgcttgagcacgcaggacaggatgtacagctgcgacagaatatcgcccaggcgcccggtgatactttccttgcgcttgagcgcaccgccgagcacgcccatggacacgtccgaaatcaacgccagcaccaccgacagccgattggcctggcggtagtaaggcgccagcgccgggtcggtcttggctggcgcggaaagcagccgcccgccagtcagcgagtgcaccgccgcacgtacggtattggccagcacaaagctcacatggccgaacatcgcgctgtcgaaggcttccagcgcctggcgccggtccgggttgcgcgcggcttccatttcgcggaacacataaggatggcagcgaatcaggccctggccaaagatgatcaggcagcgggtcatgatgttcgcgccttccaccgtgatcgcaatcgggctttgctggtaggcacgggcgaggaagttgttcggccccatgcagatgcctttgccggcgacgatgtccatgccgtcgttgacgatgatgcgcgcacgctcggtgacgtggtatttggcgatggccgagatcaccgagggtttctcccccgcatccaacgacgccaccgacaccttgcgcaccgcatcgcaggcatacaaatgcccggccatgcgcgccagcggcgcctgcacgccttcgaacttgccgatgggcaggccgaactgtttacgcatcgccgcgtaggcggtggtgccgcgtaccgcaactttgcccaggccgacgttggccgatggcaacgaaatcgcgcgcccggcggccaggcattccatcagcatgcgccagccgttgccgacttgttcgcggccgccgattacccattccagcggaatgaacacatccttgccggtggtcggcccgttctggaacacggcgttcagcggccagtgacgacggccactgttcacgccagggtgggacgtcgggatcagcgcgcaagtaatccccaacgaaccgggcgcgcccagcagaccgtccgggtcttcggcgcgaaacgccaggccgagcaccgtggcgattgggccaagggtgatgtagcgcttgtcccaggtcactttgaaacccagcacttcctcgccttcgtgcaggcctttgcagacaatgcccaggtccggaatcgccccggcgtccgaaccggcgtaggggctggtgagcgcaaagcacgggatgtcttcaccgcgcgccaggcgcggcaggtagtaattgcgttgggcatcggtgccgtaatgcagcagcagttcggccgggcccagggagttgggcaccatcaccgaaatcgccgccgccgagcagcgcgtcgacagcttcatcaccacctgcgaatgcgcatagtgggagaagcctttgccgccgtactgcttgggaatgatcatgccgagaaacccggcgtccttggtgtattgccagccttcgggagacatgtcctgccagacctgggtggtttcccagtcgttggcgatgtcgcacagcgtctcgacttcgttgtcgaggaaggcttgttcctcggcgctgaggctggccggggcggctttaagcaggcggtcccagttgggttggccgctgaacagctcggcgtcccaccatacggtgccggactcgatagccgcgcgttcggtgtcggacatcgccggcatgatcgtacgaaacaggcccaaggccttgctggtcaacaacgcgcggcgcagcggtttgatcgccagcagtagcgcgggcgccaccaccagcagcgccgcgacggtggcgcccaaccctgcgaccacattcaacagataaccaaccgccagccagatcacaccagcgcccagccacagggcggcggtggcttgtcggtacgccagggcaatcgctgctgcgaaacccgccaataaccagataaccatggggatacctctacttgatccagggtatggcctacacgccggccgctcggcctgagcgggggcgtaaagccacactacgaactcaaaacaaataattcaaattttattttgaaatatttatttagttcgtcgacgaaaaaaatcgacggccagtgactcagccgcacttatcagccatgaaaagatcgcaaccggccgcactcgcgtccgtgatccagcgcatgcacggtgaaggcagccagatgcgctgactgccttcactgtcgtgcgaacagcgttagaacttgtacgtcgcggacacgctaaccacatcaccggacgattcagcctttccgtccaggcttgcgccccccaggcgatccacgttcttggttttcagcttgacctcctgtacgaactggtgggaataggccacatcaagactcaagcctttaacctgcttcacgtcgtagccggcccccagcgacaggaacgtacgatcaccatccgggatccgcgggtcacgggtagagttgcgggtcggcgtctggtccagtgcgacacccgcacgcaatgtcagctcgtcagtggcgcgaaagtcccccccgagggagtacatccaggtgtttttgtagttatagggaatcgaaacaatggtcatgtcgccggacttcagcgtcaggtccttgaacgacgaccattcggtccatgtcacgctcgcacccagcgtgaaacgatcgttgaactcgtgcacccaatccaggcctgcagtggctgggatgtctaactgagtactcgcatgggcgccgtcaggttgtaattccaacccaggataagcggtgtttaccagcgtgccgctgccgccaaacgggctcggttgagtcataaggttgtaggaaaactgatcggcccgaacgttgtacttgccggtcatcttgttcttgattttggcgtggtagttcagacccagcgtatctcgatcagtcggtttccagacaacgccggtaaaccagccggccgatatgttatcgaccttcacccgcattaacgcgccgcccacatcggacgggaaattgataccgcccagtacagagttggacacggcagcggcggacaacaagtcgatgttctggctgacaaaccctttgctgtgctgcacgatcacgccaccgccaagggagaactgatcgttgactttgaacgacagggagcccgtcaaacctacggtctcaatcttggtgtcgacggcaaagtcacgcagcttggagtcttcatcccaggtggagcgcatgccttgtggtacgacctggctcaaaccgaaagcgaagcggtcgcccaaaggcatcaccatgaaacccgttggcaaccaggccgtgaacccaccttggccaccatcgttgttattgacggtggttgcggatgtatcagggaaaccatcggccaacggggtattggaaatcggattgcccgcgtagtcagaagcggtgcctttgtacttgatcttgatgcgcgcgtaatcaacggtcatctgcgcgacgttctggtccacgaacgccatggccgccgggttgttgaacgcagaactggggtcattcttgaacagcgagccaccggcaaacgccctgccccagccgggtgcgccgtaagtcggtgtcgagaacccgccggcttgcacgggggcagcaactatgacccctcccatcaacgccaaccccagcaaaacctgcacctgttgttttttattattcatgcggcactccttattgttatttcactgaaccagcgccagccggctcgtcttgctgcttggttcgcccgatgagggcgttgtttcaaaactgcaatgcctcgatccctctcacggggtgaatgtgcaggcagcgtcgcccgccgctggtaaacagacgccccagttggggcgcctgtctttcaacgggtgatcagcccttcgttctcaagccccctcaaggcacaatggtcagcgctggcgaaggagtaacgctcaggcttactacggtgcaactgccggtcaatgactggttggaagcggtcagcacgccaccgctgtaacccacggtgatggtggaagggccgcagttggaggctgggtacagaaccgacgcggcgatggtgtaacccacattggtgacggagcccgctgccggagcagtggccgtcagcgtccacggcaagccggtgatttttggcaggctgcacagaccaccaccggtcactgcaacacccgtgatttttgcaacgccggtggcatcgacattgccggtaaacgttgcgccgcagttaacagtggcctggaacgaggacggcgacttcaccgaaatagtacccggtgcagtaaagctggtattcacggggctgatgctataggcgttggccatcgaagcagcacccatgcaaacagtcagagcagtcaacgacacgagagttttcaagcttttcattgtttttcctcacatgttatggcgattcatttcgccaggggtaatggccatgatcgagaggtcacggtgaaactgcagaacttccctttccagccaaatctcaattcaattaccgcactttttattccacaactttgaaattcggcggcatcttgatcgacaccgtcttaatcttgcagtcctcgccaatcggcacattcgtggcttccaacttgccggtggcgttatcccaggtgccgtcggcagttgaagggccgcacttgccgcctaaaccgaacgcatgcacatccacactgatctttgacatggacccgctcttggtatctttggcaactaatacccacggcaagttgatggcttcgacgcggctgcatttaagcccgccgtcaaattcaactttgtcgacattcaccgacgccccatcggcggcgactttacccgcgaccttgatggtgcagtcggcgctgatcagtgcgcccttggaaaagctgatcggcccctgggcagtaaaggcgctgccggcaggttcgatgcgggcggcctgggcctggtggtaaataatcaggcccagggcggccaaaataacgtgagcggtgaacgaggcagggctttgcataatgtacgtccttcccttgaaattattgttgtagggtcaaactttgcggtactcaaatcggtaaaccgtgggcgataaaaccctgcgcaatactcagatcgcgagtacgcccactgctgttaattcagattaaaacggcctggcactgttgctgtatttctccaggtacttcaagcgttgtgacggttgaagattggtcagggtgatatccccggcgtaatgattaagtacccgatggtccatgcgccggcgccacaagtacggtacataggcccagacaatcatgctcgcgtaaccgtaaggaagttgcggcgattcatcgaagtgacgcaacgactgataactgcgcgtggggttggcatggtggtcggaatgccgttgcagttgaaacagaaagatattggtgacaatacggttgctgttccacgagtgccgcggcgaacaacgttcataacggccattgggcaacttctggcgtttcaggccgtagtgctcgacgtagttcaccacttccagcaacgagaacccgtagatgccctggatgatcaggaacggaatcaccgccgcgcccagccaggcaatcatcgcgccccacaacaccacgctgtacatccaggcgctgagcacggcgttcttccagtgcaatgccggcaggccgagtttgcgcaggcgttcacgctccaggttccaggccgacgtggcgctgaaccacaccgagcgcggcaggaacgcccagaaactttcccccaagcgtgagctggccggatcttccggggttgccacgcgtacgtgatggccacggttgtgttcggtgtagaagtgcccgtagaaggtcggcgccagggtgactttggccaggaacacttccagcggcttgggcttgtgccccagttcgtgagccgtgttgatggcgataccggtggcggcgccggtggacatcgccatacccaggtaagtgaacgcactgacctcaccgtgcaactcggtacgtgcggtaataaacgcagcggtcttggccagccagttcgacgggtcgagggttgcggtggcgttgagcaggccgccgtggatgatccagtcgataccgccggcggccaaccagccggtgatcaccaccgaggcgatcacaaacaccacgccggtgtagacgatccagcgatagtagcgctgcgattcgaggttgctgacggcggattcgggcgggttgctgacgtcttcaccgagcaggccgtcgatcaacgggatgaagccgaagatgatcagtacgccgacccaccacagttgctgcacgccggtggtgatggccagggcgccggaaagcaacggggtagccaggggcatgatgcccagccaccacaggtgacgtttgccgtcggtccagacggtcggggttgccaatgtctgattcatggcagcctccgaacgagacagattagagaggcgataaaaggcgtttttttcattattttattcgctcttaagctcttcaaaaattgtttcaaattagacattgaaataatttttttaaataaatagcgcggaatcgttaggtcgtcaactagtttctcgaaggctttttgacgtgaccgggcagtctctttttcagccgtttggtcaggtgtctaaagcaggcatcgacgccgttgaaccgcgagttggatagcacagttatttactcgccagggcaaacggcgggtgcaacagcgtggcgctttcgggtgggcgcacgcgcttggccacctgctccaccaccgccaccacgcgctctgtggcggtgatcggcaacatatgcccgcggccctccaccacctgcagcttgagccccggcaccttgctcgccagggcctggccgtgcttctggaagtccagcaccttgtcgcgcgcgccatagatcagcccgatcggcagggtcagttgcgggtagcgcttgaccatgtccggcaagtgatcgttgaccgtgttgatttcggtagaggcggcatagaagttgtgcgggcgcatacccagcagcccgccaccgcgcgtggcgaagtcgcttggcgcggcatccggggcgaacacgcccttgaccaccgcgctgcgggtcagcaggcccacgggcatggtcagggtgtgtgacatccagcgccgcaacagggccgggcgcacggccagagacagaaacaccgccggcagcatgcgctgcggatgggtcagcggcgccaccaggatcaacccggacaccgcctgcgggtgatcaagcgccagggccagcgctatcgcgccgccaagggaatggcccagcaccaagggtttatccaggtccagcgtcttgataaacgccgcgatttggcgggcctgggccggcaagtctgccgccgtgcccgcctgccgggtggaatagccggagcccggacggtccagcgtgatcacgcgaaagcgctcacgcaactggccggacaaggcatacgtcaggttacgactgctgcccatcagcccgtgaatcatcaccagcggtgggcctttgccttcctcgacataatgaaagcgctcgccatcgacctcgacgaaacgcccgttgatcggcacgcgggcttctatgcgccgtgtcatccaggcactgaagccccataacacggcactcgcgccgaccagtactcccgcagcgacaacccattcaacagccatagctcggtcctctgcttccctgccgctggcgacctgaccggtattgatcaaggcctcagccatcgtccacaccctggacccaaactgcctgcataccgtgcgcgtccgtcggacaagtcgcacatgcggaacaaggtcctagcgtaggcgaaattttcaggtagattatttaaaatcttttttaaaataattaattcatttttcctttgcaatggtgttctatctaaaacacacaacaaaaacaggagcacatcgatgcccacgagggacaacccatgaatgcccacagcgattccatcgacatcgccatcatcggctcaggttttgccggcctgtgcatggcgatcaaactcaaggaagccgggttcaccgacttctttatcgccgagcaggccgacaccctcggcggcacctggcgtgacaaccactacccaggctgcgcctgcgatgtgcagtcgcatgtgtattcgttttcgtttgcgcccaacccggactggacgcggcagttcgccccgcaggcggagatccgcgcctaccttgaacagtgcgcgcaacgtttcgggctggcgccctacctgcgcttcggcatgggccttgaacgtgcggtgttcgatgaacagcagcagcgctggcaactgcgcttcagcgatggccgccaggtcagcgcgcgggtgctggtgtcgggcatgggcggcttgtcgcgcccggcgctgccggatattccagggctggacagtttcaagggcaagcgctttcactcccagcactgggaccacgactattcattaaaaggcaaacgcgtggcggtgatcggcaccggcgccagcgccattcagttcgtgccgcagatcgccccgcaggtggcgcacctggatctgttccaacgcacgccgccgtggatcatgcccaagcccgaccgcgaaatttcccgcctcgaacgttgggccttcaagcacctgcccttcacccagcgcctggtgcgcggggcgttttattgggcgctggaaggccgggtggtgggctttgccctgcatccacggctgatgaagatggtgcagaaaatcgccctgcgccacctgcgcaaacaagtggcgcgcccttccctgcgcaaaaccctgacgccggactacaccatcggctgcaagcgtgtgctgatctccaacgactactacccggcgctgtcgcgcagcaatgtcgaagtggtcaccgacaccgtgctgcgcatcgaagccgatggcgtgatcaccgccgacggcatcaagcacccggccgactgcctgatcttcggcaccggtttccaagccaccgacccgctgccgcgcgattgcatcatcggtcgcgacggcatcgacctgatggacgcctggcgtgatggcgcccacgcgtacaagggcaccaccgtgccgggctatccgaacctgtttttgatcgtcgggccaaacaccggccttgggcacaactcgatgattctgatgattgaggcccaagtcacctacatcctcgatgcgctgaagcaaatgcagcgccagcgcctcgccacggtcgacgtcaaaccggcggtcgagctggcctacaacagccgattgcaggaccagctcaagcgcaccatctggaacaccgggggttgccagagctggtatctggacccgcgcaccggcaagaacaccacgttgtggcccggctcgacctggcgcttcaagcaggtcacgcggcatttcgcgctcaaggattacctcaccgagccgttgcccacgcccactccgcgcccggttgcggcgccccactccagcgtagaaggcagcctgtcatgaagtcattcaacggccgcgtggcggccatcactggcgcggcgtccggaatggggcgcgccctggccctggcgctggcgcgcgaaggttgccacctggcgctggcagacaagaacagccaagggctggaacagaccgtggcgctgatcaaggcctcgacgctggccccggtgacgatcaccacccaggcgctcgatgtgtctgaccgccaagccatgcaggactgggcggcgcgctgcatggccgaccacggccaggtcaacctgatcttcaataatgccggcgtggcgttgtcgagcaccgttgaaggtgtggactacgccgaccttgagtggatcgtcggcatcaatttctggggcgtggtgcatggcaccaaggcatttttgccgtatctgaaagcctccggcgatggccatgtggtcaacacctccagcgtgttcggcctgttcgcccagcctggcatgagcggctacaacgcaaccaagtttgccgtgcgcgggtttaccgaagccctgcgccaagagctggacctgcaacgctgcggcgtgtccgccacctgcgtacaccctggcggtattcgcaccgatatctgccgcagcagccgcatcgacgcgaacatgaccggatttttgatccacagcgagcaacaggcccgcgccgacttcgaaaagctgtttatcaccgatgccgaccaggccgccaaggtcatcctgcacggtgtgcgcaagaacaaacgccgcgtgctgattggccgcgacgcgtacttcctcgacctgctcgcccgctgcctgcccgccgcgtatcaagccctggtggtgttcgccagcaagcgcatggcgcccaaaccccgcgcgccggtgtttgaaaccaacgacgaacctcgtctctgaacaggagcacctgaaatgctgcccatccgtcgcgacatccgctttgccttgcctgccgagcgcatcaaggactggcacgaacaaggcccgttcatcacgcatttcttcaatgcattgtcactgctgtttcctcaaggcgagctgtttttcatggacagcgtgcgccactaccgccagcgcatcgacgatcccgagctgaaaaaagagatccagggttttatcggccaggaagccatgcacagccgcgaacacgtggcctacaacgaccacttgcaggcggccggcctgccggcgcacaccctggaccggcgcctcaaattcatcctcgacctgcagaaaaaacacctgccgccgtcgttcaacctggcagtgaccatcgcccttgaacactacacggcgatgctcgcggaaatcctgctcagcgaccccacgcggtttggcgattcactcaagggctaccagcaaatgtggtactggcacgccctcgaagaaaccgagcacaaagccgtggcctacgatgtgtggaaccgcgtgatcaagcctgggccagggcgctatctgctgcgcaccggcaccatgctgaccaccaccctgttcttctggctggtggtgttcgattttcacgtgcgcctgctgatcgccgaccgcaaggccggtgggcacctgaagggcttctggcgcatgctcaagtttctgtatgggcccaagggcgtgttcccacgcatgctgcggccatggctgcactacttcaaaccgggctttcacccctgggaccacgacaaccgcgcgcgcctggcgcggatcgaaacgctggtggaggaaatcgagcagacccagcgcgaatacgccgcacagccggtttaaacctgggccgccgcgcgttcgcgcacaaagcgttgcaactggtcggcgggcagcgccttactgaaataccagccctgaataaacagctcggtgccggtattcaagaacgccaactgctcggcggtctcgacgccctcgaccaccacgcccaggttcagcgcctcacaaaagcgcagcatgccggtcagtacttgtgcgcccttggggtcgcgctgggccaccacaaagctgcggtcgatcttgatgaagtccaccggaaactggtgcaggtaactcaaggcggaaaaaccggtgccgaagtcatcgatatacactttggcgccgatggcctgcagtttgtggatggtctggcgcgtggcctggatatcactgaccagggcgtcctcggtgatttccaccgagacctggccgtgggcctgggcgaggatctccaccagccgatcaccgtaggcggcatcggtcagggtggcgctggaaatattgatggtcatcggcaaggcaaagccgctcttgcgccacgtctggtactggcgcaccgcctgggacgccacccacacatccacgtccggcatcaaccgcgcctgggccagccactgcaggaactcccagggcgaatgcaccgtgccctggttgtcccgcgcacgcatcagtgcttcgcaaccggtgcacaggccggtgcgcgtggagatttgtggctggaattcgaggtagaactcgtaatcgctgatctgctggatacggcttaactccacggcctggcgggccacgcgcttgtgcgaggccagcaccgggtccagttccagcaggcggcctttctcttcgaggccgcgaaaggtcatgtccaacgacttgaggtacaccgtgccgccttcgctggcctgccgatgaatcgcgcgcacatagggcgcatacaccaacgtgccgaggcccagcaacgccagttgcagcaccaccgccgccgcatcgccgtgggtgctgaggtaggcgttgagcagcaccggcgcggtaaacggcacactggccaccgccggtgaaacccagcccatctgcaccaccgtcaacgccagcagcgtgttgacggccggcaccagtagaaacggaatgaatagacgcgggttgagaataatcggcaagccgaacaacagcacctcactgacgttgaacagcgacagcggcaaactggccattgccagcaaccgcatgggctggctcctggaaaacagcaggatcgccaacaacaggcataacgcgccgcccgagccaccgataaacgcgaaactgccgagcaaaccgctgttgagcaagtacttgaccggctcacccgcagcggatgcgctggcgttcagcaccacggcctggtccagcacatcgaacaacggctgcatggcatacacaccatgaataccgaaaaaccacagcagcgaattcatcaaggtcacaaacaaaccgctgccatacggcgattgcagcgcgtcgagcacctgcggcccctgcagttgcgccacgtagggaatctgcaacagcaacgacaacagcaccaccaggcacagcgccgtgatggcgcccggcaccaccatattgatggtaccgcgcaggttatggcccaccaggtccgcgttgaccagccgggtccagcgaaagcggtgcagccaggccatcgccggcacattgagcagcggcgaggcaatcgcgataaacaacatgaacgtggccgacgcccgtgggtactcacgcaagacaaacgtggcgaccatcacatgggccaggcacaggaaggccaccggcaattggggcaggcggtgctggatcgccagcatgtaaccaatcgaggccgccaccagcagcgggatcaccgagctgatctggttgtgcaacccggacagaaaggccaccacctgcggatcgaaccccagcaccttggcgcactcagacaagatcaggaagccggccgacaccagcaggcacggcaaaatccacaacaagccttcacggatcgcacgcaacgattcggtgctggccaaggccgccagacgctgcgtcaggaacagtttgaacagcgtttgcgccatgaccaatccctctgcgccctcgatgggcaagcccgaaaacccgcgttaacgctacacgccctgatagcctgcgcgaaagacttttgccgcaccggcgggtaattattccgctaacctgtggctcgttcggggcatggccccctttaattaactcacccaaacgggagcaagcccttgtcagaacccggtgataaccaccagcgcgcgctggaccgattcctgagcgaacatccggacgtggccacgcagctggacaccctcaaccccctggccgcgcaggccaagggcgaaaccctggcgcagtaccgagccgaacgcctgcacgaagcctttgaagccgaagcggaacgccagaacctgttcgcctgggagctgaccctcaagttgaccgccgactccgccgaagccttcgaagcccagcgccttgaggtgcacagggaagtcgcgcagatggcggggttgagctgggctgaatactgtcagttgcatggtttggcggggtaagtttttcttacagataccaggcacgtcgcgcacatcccagcgcctcgcgcaattcggcaacggtgagggtccggcgctcggggtcaaccgccaaggccgcgcgtaatgctggccagcactgcctgggcagttgccgagggcgcaccagtgtgtgcctgggctgctgttcgccaaggcgcttgccttgggccaattcgtaaacaatgcacgccacgccatacaggtcggcggcggcggtcaacgcaccgcctgccagcagttccggggcggcgtaagcgcgggtccacgccttaaaacggttgcggctcaaactcggcaaacctgccgccacctgggcctgagcaaggcccaggccaaaatcgaacaggcgaatgccctcctcgctcagcatgacgttggcgggtttcacatcgccgtgcagcacatttcgctggtgggtataaaccagcgcatccagcaactgcaagaccatcggctgcagctcgggccacgacaagccccccggacattccagcagcagtcggtccagggtgacgccgtgcagcaactccatggtgaagaacgccgtacggctgccgctgtcgacctcgaatgaaaatgcccggaccacgcacgcatggcgcaggctgcgggtcgtcgcgaactcgctgtacagcagcacatgagcgtcaggacacgcagcaaaggcttcgcccagcagtttgagggcgacactggaactgggctcgccaaactgctcgtgcaacaggtctcgggcgcgatacaccacgcccatgccgcccctgcccagctcgcgctccaggtgatagcgcccggcgagtaaaccgggtggggcccaggcttcactcatggctgtaccaccactgcggtcaagtcatcccgcgcgggtgtgcgtaacaccatcgcaaataaacgctccaccacttgctgcggcgtcccctcgctcaacgcgcgccccagttgctgatggctgagtgcctgatacaaaccatcgctgcacaacagaaacacatcgcccggctgggtgttaagttccagcctctcaagccgcaatgacgtgcgcgccccaatcgcgcgggtcaatgcccttgcatccgggtgtgcctgggcttgcgccaggctcaatcggtgctcagccataaggcattgaagcagcgagtgatccctcgacaactggtacaggcgctgtcggcgccagaggtagcaacggctgtctcccgcccacacgcaggccgcccggccctcttcaagcagtaacgccacgacggtactgcccatcgtaacatcggcgctggcggtggatcgcacggtcgcactccccagccgctggttgacactttgcaagcgttgctgagcggccttgacgcgttggtcgaggcttccctcaaccgttaacgatgcaaggctgctgatcacccattggctcgcgacatcaccgtcgcggtgcccgcccataccgtccgccacggcccagcagccattctgcgggcagtccagaaacgcatcttcgttacgcgccctggcctcgccccgttgcgttcgcccggcactgcgccactgaaggtgcagggccttcacagttgctccggcaggcggaaagtgcgccatgcctccatgtcaaacgggctgggtgtgcgttggctggtgagcaggtaattggcgcgcaaaccggcgaggtctgccttgtacagctgtgcactgcgtccactggcgggttctttttgcaataagtcgaaaaacctgaagagcgaccaggccccagtgtttttctcgatacccaatggccgttgttcggcgcctctttccagtaccaggctgctacgaccattgtccgcgtcggtgggccactcaaacgccatgctcacgatcggaccgtggcgatactcaagctgcttctcgccaaaacgcagggtcgcgcgactgaccgactgatccaggctatagggcgccaaggtaaagcgaacagacaactcactgttgctctcggggaagaaagcgcgacggatgacctgagctttcgtcagttgctccagcaatgagcgcgatatcggcaagctatggccatccagccctcgcagccggtagcggttgccgtcagcactgatgaaaggccgcagataggcctcgtaaaagcctgccatcacaccattgggcttgaagaactcctgaaaatcatgaagcgcaacctcgctggtcgcgtgggcctcgaaggggtatcgctggcgaatcgctttggcgtagaggccatgcacctcgctttgatagcgttgattgacatgcacataagccccttccagcaagtggcgccaactgtcgtcagccatgccctcaaaccagccggcgagcggcaacggcagacgcgcagcggcatcgcgcaggctgcccaacgcatcctgctgcccctccattcgccgcttgacccgctgaaaggcggcctgctccggcaagttgtcccgattcagcgcagtgaattgcaagtgcaactcgtcgagcacgcgcaatgcctgggtcaactccacaccggggttctgctgctcatcaagcagttggtgcaacggttcaaaacgccgttgcagcgcacgccgcgcggtgtccggaaccgccgccacccgcccatcggccagcgccgactgcacccgttcgccggcctcaccgaccgcaggggccaactggctcaacagttgcgggctgggcagcaaacgcgtgttttcacgcagtgacagcaataactgcagcaacggtgactgggccgatgtcaggctcgccagctgttcggcatcctgcttgaggctgtcagtgcgttgcagcttgacctgcccaagggctgcgctccagacatcggcatactcactgaaatagcgctggtgcagttcagccatcagccggcgcagctccatggcactgaggtcggtgctctgccccagtacccagttgtcctgcgcgatggcgttcaccagccttgggccttgcgcctcgaagtactgcacatagcgttttgaatagaaaccgggaatcggtgggtctatgcccgcaaacaccttgccctcggccagacgcacaggttccaggttgcgcgattgttcacgcagggcgcggtagaccgcatcggccagcgactcaccgcgcagtttttcccgcgcggtggcgacaagcgtttcgtcgagtggcgctgcaaacggctgctttagcaggcgtgccaagtgttcattcaggcgcctctgcgccgacgcatcgcccacatgactcaaggaccattggtctgccacccgctgcgccaaccatgcgctgtctcggcgctcacgcagattaagcatcaggtacgcacgcaggtggtccaacagctgttcacgatcccccaggcttgcgcgcacctgctcttcgagctgtgccgttatctgcgccagtaacggtgtgagcagggcctgctcataggcgcggctcagtggtgggcggctcgcctcacctgggtacaagccggcgcgctcaataaacgcgacgtccgcaaccggcgcaaacacctgcgtcgccgcaaagcgcgcatccagcagcgccagggtctggtgaatatccggcccattgggcgacgggtgtgcgagcaatgttgccaattgcgccaggcgctgttggttgactgaatagctgtaggcccaaagccacccggcgccaccgatcacacccgccatggccagggcctgcaaccccaggcgccgacgaattcgccgttgctccgtggcctgcagccccgccagccccgcctcagtgaagatcacccgactgaacaagccctggacgaagtggctgcgcctgtcgccggcacaggtcaaatagaagccgcgcaaccccttgatccgctggtaacggtgagcggaaaaagccgactcgacaaacaggcacaaacgctcgccgagctgcgccgcgtgctgggggaaatccagcatacgaccccggcggtcaacattgcgctcctggtgcaatcgcgtcatcagctcagcgctcaaaccttgcagcagcgcctcgaacgcctgacgcacctgtgtgacgtcaatgcccgccgcacccgggtcgaggaactcgcccagcacgctttcagcgtcctctgccaaggaggcgtcgaagaattcggcgaaccccggtacccgatcagcctgagtcagcaccaggtacaccggtacatccacgtgcaatgtctgctgcacttcctgcaagcgtgaatgcacacggcgagcatggaggtccagatcgtgctcattgccgctcaacagtgcgtctaccgataacgtcaccaccacaccattgagtgggcgtactcgacgccgcaatctgagcgcactcaacagtgtcgaccagcccgcggcatccaccacactgtcgggttgcgtcaagtagcgccccggcgtatcgatgagtacgccttcgtcggcaaaataccattcgcaatgtgcagtgccgtgggtcgccctcgcctcaacgtgatccagcggcgactgcaaaccagccgcggccaataaatgcgttttgccgctgcccggcccgccgatcaacaagtaccacggcaaatcattgcgccaacgcgcgttgtgccctgcgtaacgccgtgaggttttcaggcgctgaaccgcctccttgaagcgaccgcgtacctgtttctgctcagcttgcgccccggccgaagacggctggcaaacttcgcgttcagcacttcccggggtgctcgcacggcggccaccggcaacgaccatcgccagcccccacagcagaaacaacgcgcagagggtgaccagtcgagccgtctggctttgccagaagcggtaatcatccaccgccagcaacgggcctgcgtaccacaccaacactgcacaggaaagcaccagcagcaagctccagacccaaatcctgcccagcacggtgctcgcgctcttaaagaatgcgttcattcattgctcccagcgtttacaagggcgtctgagtcagtgtcgacgccgaaaattgaaggggttgcagcgtggtcgtgacctcgaggcccagcttccaggcaaaccctgcgtacatcgccaacacacaggccagggtgaagactgcgagccacggcgtggaaatcacgcgtaatcgcccacgccgtgcgcgccccgccttgaccggcggcacacgttgccgggtgggttcaccgcgcacttgccgtatctgtcgatacaaggcgtcgcggacgctctcgagctgcgatgcgccgcgttccatgatgcggtacttgccttcgaaaccgatggacaggcacaggtacatcagctccagcatcgccaaatgcttgaccggatcgcgggacagccgctccaacagctggaagactttttcaccgccgaaggtttcgttgtgaaagcgactcaacaggctcatcttcgaccaatcgctgcgattaccccaggccgtggtgaccacggcctcatcgacgacgctgcacagcacgtagcgcgccgacatgacctggctggcctcgacaccgcactgcaaggcaagggcttcaaattgagtgaccgccgctgagagtcgatcattgaccgtgcccaggctttcgcgaccggagcagcccttgagctcaatcacttgcgacaataaagccgatgctgcggcgacgagcggattgagacccaccttgaagctttgcgcgtcgtgcagacgggccgcgtagatcatccgatcttccaattgctcaaagcgcggcggcgcggggaagtccgttatcggcccctgtgccgggccacggccttcatggtcgagcaatacggttttttcgtcctgcgggtattcactgtccatagtgttcagttcctgatggcccagaagttgagttcaagcgctgaaaattcaccgccgacatggaaggcaaaaccgcccgactgttccaactgcgtgatatcgcgggcattcagatcgagcatgaaataggtttttgcggcatggaacggaatctgtcgcggcgccaccggcagtggcttgaccttgatacccgccaagtgcaggttaaccagctcgcgtatgcgctccaccggcccgaccttcagatgggccggcaggcgatgacgcaattcctccgaatcacactgcgccgtggccgcgagaatgaaggttgccgtgcccagcagcttcaggtcgctcaccgggcagaccagcaccccgtattggcgttgctgcaggggcagctcaagggcgtgctgctccaggaccatcgacagcacgtctcgaacgcccgccatcagctcacgaaaactctcactctgatcgccatgcctgtagcgcacgtccagctgcgcgcgcttgctggcgctggcgaacgttgataactcacccaccatcgacagcagcgctcggaacaaaacatgcgggcgcacctgggcctggctcaagtagtgacgcagctccagttcggtgcgattgatcagttgcaacatcaggaagtcgccaatttccgagcctgctgccacaccgtcgccgcacatacgcgccgcaatggcatccccgcgactcgccagcaggctgatgacttccttgaggcacgatgacacataggtgctgccctgcagaaaaatgaaggtcggtgtgaagtccgtgtccaaggtcacgccgccttcatcggaggcgctcactacctgcgcgaccttgagcttgatcaagccatggtcactgggctggtctcccaacagaagacgcagatcagggcgtgcgcaattgatgcgtaatcgagagtcgatgccggcgttcgaatcacccacctcaacctcacaggccaggtagcgtgacaggacatcgacctgctgctgctcgcgaacctcgacctggttgccggtggccagcggcaacgccagataaatcgcttgcttgcccgagttggcaggcacctgcaggaccaagggttccatcgtcccacccagctcgaacaggctgccgtccggcaaaacacccgaggcctggttgaccactaccttgccaaaattcaggtactgcacgtcaacctcaagcgtgaggaaaccccaggcgtcagtgtcgagcaaccgaatttgattgagttgctgctggtaataccggtcgttgtgctggaaatgctgtggcctgagcaacatgccttcctgccagatgactttatgaatcggcatatcacttgccctccttgtcaggaaggggcgaaaccacgcgaatacccgattggtccagcaccaggtcagcaacggtcagctgttgcgcggtgaccgggatgaccattcgccattgcacatgaggcaagtctcgataggccgccagtacccccagaaaacgcgccccaggttcaagcctgagcttgaggctcagccgctcaccggggcgcagctcaagttcctcgctgcccacccaatccttgggcagcgcttgttcggcattgctgtacaggctgaaaaaatcggcattttcaaaggccacgggatgtcgcaactcaagcaggtgtaccaccaccggcgaggggcggccgtgcaggtcagggttaacctggtcagcggcggtgagcgtcacatccaatttggtcaacgtggaaaacggcgacaccgcgctgcagccggccaacacgccgagcaggagcagcattgaagcaagcgtggctcgatacataactatcatccttaataatcggcgtgcagtgttgagatcaaacgaacctgctcctcataggccgtggcgaagtcgccgcctgaccactgctcatcctcaatccagtgctggtagtggcgctggtaagcccgccagtgcccaccgtccgtggcaaaccgcggtcgcttgccccgagacgcaaagcacatcagtagatgacccggcgcaaaggcattgcgtgtgttgcgcagcgcactgcgagacgccgccagcagtgcaacttgatgagcctgtagagcccggtgagcctgggtgatggcctgttcggcaggtaaatggtgcgcgtccgccggccccagcagcgtcgccaaggcagcatcggtatcgacacacgcgctcaaggggttgcggcttttttgcagagggccgacaaaccccaggcccagctcatgtttgagctcttcacaggtatgcaggctctgctgcagcccctcgacgcccacacgaagcaagcgggccaccttgatcgccagggcctcctggcttgcgcggtcgagcgtctccaggcgaatgcccagcgccgccgcaaactgttccccaaaggcgttggtgtccgtcggcaccatcacgcaaggtttcgagagggtttcccggacaggctcagcccgacgcggtatcgtcagatggtctctgctgaccacacggttatccggccacgacccaggttcctcggcggcttcctccaatgccgccaactcctgcgatcgggtctgctgccgatgctccaggtccagagcctggatagggtccaacgtcaggaatgcatcatcgggaatggcgccgctgccgacatcgtatggcgtgtccgcagaccgtaccggcgtgatcaatcgtgcacgtatcgcaaacggccccaattcaaacacctcgccgtcgccgatcaatcgcgcctgccctttgtgcagtcgctcggcactgccggatacaccaataccgttagtgctgatatcggttaaaaagtaccggccttcgcggtaagcgaccaatccatggtgactggaaagcaggcggctggaatcggcaatcatccagtcacaacccgcaccgcggccaatcacaccgccggtgccgtcgaacattttacgcgccgatactgcgctgttgacgcccttgacatcacatacttcaaacacgagttgcatggtcgggctctccccattcaatggtcacgggttatcaccttcggctcacccagcgggcggtaatcggcatcatcaaacacatagttcgcgctgcaaccacccagtaaacacaacacaagcaccacggcttgccacgaacgaacaggcatcagctttcctccacaacgttaaggtcgccaagcccgattcgacgcaggcggcgttgatactcggcagcgctcaagcacagcattcagcactcccccttggcatcgccaatagggatgttcagccgcgccagacggtagagcagcgtgcgacgcgcaacaccaagctcacgcgcggtgcgggtgcgattgccacgattcttgtgcaggcaatcaatcaggaacacccgctccacccgctccatgcgctggcgtagcgtggtgtcgagggccacggcggcagccggggccagtggcagtgacaggtgcatgggcagaatcacaccgtcgtcacacaataaaacggcgcgttccaccaggcacttgagctcacggacattgccggggaagccatggctcgacagttggtcaagtgcgctgctcgaccaatcaacagccgccctccccagtgacgcgcacgccttttcagcgaaatgtcgcgccagttgcagcacatcgccatcgcgctcacgcagggccggcaattggatagggaactgtgcgagtcggtaatagaggtcttcacggaaactgccttgcgccaccatcgcagacagatcgcggtgggtcgcagcgatgatgcgcacatcaaccttatgggcagtgctggcgcccaatggacgcacctcgccttcctgcaatacccgcagcaatttggcttgcagggccagcggcatgtcgccgatctcatccagcagcaaggtcccgccatctgcggcgtcaaacagccctgcgtaattgcgctcggcgccggtgaaagctcctttgcggtagccaaacagctcactttcgagcaacccctccggaaaggccgcgcaattttgcaccacaaacgcctggccactgcgcggccccgccgtgtgaatagcgcgtgccacgacctccttgccggtgccggtctcgccgcgtagcagaaccgtgtacggggtatgcaggaccttgccgatcaagtggcaggtcgcctcaatcgcagcgctgttgccgatcaagccgtacgcacctgtcaccgatgtaccgcgttgcgcctttttggcgcttggcgcgggctgcacgccccggagcagacgcagctggctcaaggcaaaaccgcccagtttgcccaacgaaggcgcgtagcccagcaacggcgttgcctgccaactggcgcacagcagcacgccgttaacctgctggcactgattgaacagcggcaccgccaagagtgaacaccagcgatgctgcgtgatcggcagaaaagccgtgtcatacaggcatcgctgcacatcatcgacgccgagcacgctgcgctggttgagcacgtaatgcagcagctgctgctcttgccataccgcccccacagctgggtcgacgcgcgttggcgctcccagtagatgctgggcaatcaggtccagtcgccccgtgacctcatccacccgatacaactggctgagttcgcactggctcagttgcgcggcgcccgcaacacacaggtcgggcaaggttgacgcgtcgcggccttggcccaggctcatcaagcagttcagcaagctatcggcataggccagagggtcggacaagccggtaaacagggcgtcggtcattagctgaactcgcacgtcggctggccgttaccgtccaatcgcgcatgggccaaggacaatgactcgcccatggccatggcactgagaagacggtccaccatctgtggcagcaactcgcgctcgatccattggtcgatgtagcgtgcgccgctatcaccatgggcacagcgctcggccatgtgcgcaatcagttcggacgaataactgaaagcgagctggcgtcgttgcagccgctcacccaggcttgccagcttgagccgtgccacgtcatgcagcacttgcccggcaatcgggtagtacggtacgacacgcatcctggctaacaacgccggcttgaaatgggcacgcaagatcgggtgaatcgcgtcctgcagcacgtgggcgtctggtcgccggccgtctgcacagagtgcgctgatgcaatcgctgcccaggtttgaagtcatcaagagcagcgtgttgcgaaaatcaatttctcgcccttcgccgtcattggcgcggcccttgtcgaagacctggtaaaacaggttcagtacttgcgggtcggctttctcgacctcatcaagcagcaccactgaataagggcgttggcgcacagcttccgtcaggatgccgccctcgccgtaaccgatgtagcccggtggcgcgccgatcagtcgggacaaggcatgctgttcctgatactccgacatgttgatggtggtgataaaccgctcaccgccgtacaaaagatcggccagggccagtgctgtttctgtcttgccgacgccactggggcccaccagcagaaaaacccctaccggcgcatcgggcttgttaagcccggcggcaacggcccgcaatgcgcggtcaagggcttgcacggcgtgctcctgccccaggattcgagcgcgcagggcatcggcaaagcccaggactttttcgttgggctcaagtgccagttgctccagcggaataccggtcaaggcgctgatcacttgcgccaccaggcgcgggcacacctccagcgtgttcgacgattgcccgccctgctgctccagcgcctggcgctcgcactccaggccttccaggcgcaggctcaacgcctgcaacgtctgcgcttcggccggcaacccccggtcggcgtcgcgacttaatgccagatagtgtcggttgccttctgccagttgcgcgcaaagatgctgcaatgcctcaggtggcagagcctggcgcgtgcgcacacgcgcgcatgcggtatccagtacatctacggccttgtccggcaactggcgacccgcgaggtaacgcgcgctcatatgcgcagccgctacgacggcatcgtcgcgtacgtaaaccccatggctcgcctcataaaccgggaccaggccgcgcaggattgacacagcctcctcaacgctcggctcgccgaccagcaccggctgaaaacgccgcgccaatgccgggtctttttcgatgtactgtttgtactccgcccacgtagtcgcggcgatggtgcgcagccctccccgcgccaatgccggcttaagcaggttggcggcgtcggaaccgcccgtctggcctccggcgccgaccagggtatgggcttcatcgataaacagaatcaccggctgtggcgcagcgttgacctcatcgatcaagcctttgaggcgccgctcgaattcacccttgaggctggcaccggcttgcagcaagcccatatccagggtcagcaggcgcacattattgagcgcgtcgggcacctgagaagcgacgatcttcaaggcaagcccttcgacaatcgccgttttgccgacgccggcctcgccgaccagaatcgggttgttcttgcgccgtcgcacaaggatgtcaatcagttgtcgaatttcgctgtcgcgacacaacaccgggtcgatcaacccttcgcgcgcttgagccgtcagatcatgcgtaaagcgctgcagcagcgactccgtcaccacaggctggggcgctgacacctggctcgccaaaaaatcacgcacacggccggcatccagacggcttagcacgccgtaatagccgctgccggaataatccagcgggtggcgcagcaacgccagcaacagcgcgccatgatccacacagcgttgttccagctcaatatgagcaaccatcagcgcctgctgcagccagtgaaccagcgcctgggcaaagaccgggttgcgcgtagcgctctgttcacttctgggctgcaacacggcttgcagctcgctcacctgcacgcctgcatctgccagggccttgaccattaacccgtcgggctgctcaagcaacgccaggagtaaatcttccaccagcacttcacggccaccgcgcatcacacagcgctcagctgcgcgttccaggtcttgccgtgcctgggctgtcaacgtgcgtataagttgttgcaggtccacattaatcatgatcatcagcccctaacgaaaattgcccgcaagcgtgaccacgccgtcggcatgttcaggcaccagccaagtggtccaacccaggcggcagacgttgcgctcgccaatgtgcagcgccttgatctcgccttcggccaacaccagccgcaagtcgtactccaacgggtcgcgtgcggtgaaacgcaccagtgagcacaagggctgatacccactgccagtgggcaggaactcgtgcagtcgttgccaactcagcgcccgcatgtgcaccctgaatttgccgctacggtcagccacacgctgccccagcaccaggttttgaccgagttcgctattggcaacccccaagtgattgcgctgcaaaggggcaacctccaccgtgcgctcaacccactgttcaatgaacaaaggggtgtgcttgaagtaatgccgcaggacagtctcgatcaacgtcgccgaatgggcgcgcaaactcaggagccccaagtacggcaacaggcgcttgcaatccagttgcgtggcttgacgaatcgcctcgccacccaagccgatgagcgcaaacatctgctcggaaaacatatcgctggcaccacgctggaaacacgcgcggtaacggtacttacgccagatcggcaacatcaggcggtgcagtcgctggtggaacaggtcgaggaaatcgcgagtggggttgcccccagagcgctcggtaaatgcctgttcgccataaaacgccggcagtggcgacccagcaccaaataaccccaggatgttgaggcgcaggcgagcgcgcagatggccgtgctccacaaaaaacgccacatgatcgatgtcatgcccggcaaaccccaggccagggttggcctggaactcaaggtgctcatacagcgcgtcctcatccagcaacggatgggcctcgcgcaatcgctcgatcacctgctgcaccgcctgaaatagcgtgtactcgcggatgacacgacacaggtggttcaaagcaggggttgttgccccatccgggatggccatagatacacgtctccttgtgtgctggtgactcgcaactcgtggtacgaattaaggctggcgtagagcgcgaaaaactcattgaggacagaagcaaacacaaacatgtcgcccaacccgagaaagccatgggggtcgactgtcaggtccacccgtaaaccgcgaacgggcagccctcggtgtaatcggtcaactgcctcgtggctgatcgaccgcaacgcgcccagccttgtctggctgaccttttgcgcctgtcgatcgtgatagcgcggcaaatcgtaggtttgcaggatcaccttcaaggcgctgatatcggtcaacgacacatagttgagtgacatgttgctgatcagcttccacaggaaatcctgatccagcggcggcacgaagctcgccgtgggtgccgtgatattgcggaaggtgagtgactcaggggcctgttcgccgggccggtttatgtcgcctgcacgtaattgccgtggcaggttgctattggtacaggtcagttcgatcgagagtgtttcctgaccttcccctgcgcgcgcaccgaaacccatccaggtatcaaggcctccatgctgcaacgacaagcgttggcggaggctgtagctggacggcgccaccgccaggtcactgtcctcgtcatgctcaaaggactcgaacggcacgtaggcctgatagcccagcccgccggggcgccagccaatgacactgtccacggaaaacacagcggcattgcccgccgtatattcccccggcaccaagaggtactcgtcctgcttaccgtccaggcgaacgggcaccgcatcatgtttgaacaggttgacgatgggtgtgcaatacaacttcaggttgtccagggtgggccttggggggcgatgcccctgggtgcgcaactcgaaacgcagcaccatgccctgcacttgcttgagcaattcatggggaagcgagtgcagcacactcagcccctcgacatcgacaaacaggtacttgtccgggaaagcaaagtattcctgcaggtgtcggtaaccgcgaaacgtattctgcggatacggaatcaacgcctgcgcctctgaaaaccccaccggctggacctgactggcgcgcaaacgcagtgttgccggttgcccatcggcgccgttgaccggcaagccagcgtgatccagcaagcgtaaatcgatgccatcaaggtggcgcaacaaactgaggtagagcccttggctgatgtagcggtcccccgccaggtgcaggcgcaaggaatcaaatgccagctcagtgaaattgccttcggcactcatgttcaagcgcaggtccaaccgtgcggtttcgccctggcacgtgtactccaggccgctgagttgcagtggcatgacgtcggtggcgtagcaggtccgaaagcgacagcgctcgccctggacagcggtgctttccacggcggtgtcgcgcgccactcgtacactggggccggcacgtttcaaggggtcaaattgcaggatgctgaacgcaggcattggccgcatgtagttcggccatagcaagtgcatcaaggaatgcgtcagctctggcaactcgtcatccagcttctgtcgcaggcgccccgtgaggaacgcaaaaccctccagcagccgctctacatccgggtcctggccggtctgcgcaagaaacggtgccaacgcagggttacgctcagagaactgccgcccaagttggcgcaaggcgctcagctcactttggaaatagcggttaaagcccatcaacacttacctcgacgcgaccggcatccgccagccgcgcatgaaacacaaccggctgcatgacaccctccaccagcagcgctgcttcgatcgaaaatgccagggtcaagggttcactcacccgtggcagaaccctgacgcgcacattcgccaaccgcggctcgtacgcccggatgaaacgttcgatcagtacgcgcgactggctcaaggattcgtgcaggctgagccgcatatcattgaggtcaggcaagccgtagtcaggcagcgtctggacactgccggcgcgggtgctgagcattttttccaaatgtgcagcaacggatgccacgctgcacgccggggttggcgcatcgcattcgaggcgttcgaaaaggctattgtggtggggcctgccctggcttcggctcattctttatcgagcttgccgaccagcgacaacgtgaagtctgcgcccatgtacttgaaatgcgggcgcacgctcaagttaacccgataccagcctggttctccgtcgacatcgctgacgacaatgcgagctgcgcgcaatgggcggcgtccacgcacctctgcactggggttctcctgatcggccacgtactggcgaatccacttgttgagttccaactccaggtccgtgcgttctttccacgagcccagctgctcgcgctgcaaaaccttgaggtagtgagccaggcgattgaccaccatcatgtagggcagctgggtgccaagtcggtaattcaactcggccgccttgccctcttcactgatgccaaaagacttgggtttttgcacggaactggcggaaaagaacgccgcattgtcactgcccttgcgcatggtcagggcaataaacccttcttgggccagctcgtattcacgccggtccgaaaccagcacttcggtcgggatcttggtttcaatctcgcccatgctctgaaagtgatgcagcggcaagtcctccactgccccgccgctttgcgggccgatgatgttcggacaccagcgaaagcgtgcgaagctgtcggtcaggcgcgtagcaaaggcatacgcggtattgccccatagataatgctcgtggctgttgaccacggtttcccggtaggcaaaggttttaaccgggcattcaagcgggtcgtagggcgttcgcagcaaaaagcgcggcaccgtaaggccgatgtagcgcgcgtcttcgctctggcgaaaactttgccatttggcaaactgggggccttcgaaatggtccctgaggtccttgagatcaggcaaaccggtgaagctttccaacccgaagaaggccggcccggcagcggcaataaaaggtgcgtgagccatacaggcaacgctggatgcgtattgcatcagcttcacatccggtgcactgggtgacaggaaatagttggcaatgatcgcgccgaccggctggccaccaaactggccgtattcggcgctgtaaatatgcttgtaaagcccggactgggtaatttccggcgagtcctcaaaatcatccagcagatcctgccgcgagacattcagcagttcgatcttgatgttctctcggaagttggtgcggtcgaccagcagctgcaagcccttccaggccgactccagcgcctggaaatccgggtgatggagaatttcgtccatttgctggctgagtttggtgtcgatctcggcaatcatccggtcgaccaggcgtttcttcaccggttctgcgctgttctgcggcttgagcagctcctcgatgaacgccgacacgccacgtttggcaatgccgtacgcttcgtcgtcggcactcagcagtgtctgggcaacgatgttgtcgaggatgctgtactcgtcagcggcgcttgcgggctgcgggttgggctgggtggtgatcatggtgtcagtgtccttttactgaagtgttcaggtgacggggctgctcagccccagctcagcaagtacccgcgcacgcgactcgtcatcggccagtgcctgctcaatggctttgcgaaagctgggtgtattgcccaaaggccctttgagcgccatcaacgcctcacgcaatgccatcagtttgtgtaactcgggtatttgctcaaccaggttggcggggttgaaatccttcatcgagttgatccgcacctgaaccgccaacgcttcgacatccgtgttctcctgcaagcggttgggcacgctcaacgtcaagctcaacgcctgtttggccagcacctcatcaagggtgtgcttgtcgataccaatgggctttcgatcttcgagcttgcgcgaatcctcacgctggctgaaatcccccagcacgagcaatttcagcggcagctcgacttcctcttgagcgccgccaatcgcgggcttgaaggtgatattgatacgttccttgggtgctaccgaaccgtctttggccacggcatttctccttttttggtcggctcgaaagcctattcaagtaccgcttcgagatcgaagtggcacaacctgcgatgggtgacttccttgcgttcgcgcacggcgtggtcttgtggcaaaaggtcgtaacagcgatgcagcagccgcgcgacttgaaaggccaactcgggttcccagcggtccaggcctgcgtgctggagttcaaggtccatctgctcaagctggatcctgcccagctcatgcttgcccgcccggatgcacaacctggccagcgccaatcgccaatgaaaacgcgcgcggtcactgcacgcggcgtgcaaaccctgcttgagctcaccgaccgccgccttcagcccctctttacgcagcctggacatcaccgcctgcaacgccgtttcccagggcgcactgcccacatcgaccacgacacttgagggctcggtcttgtgcagatggcgaagtacatgcagtgcgatccagtcggctgtcgcggaatcggcaaacccgctgccgtcgtcaaatttgaactcaggcaggctcggcagccgttgcaataacaaggcaaaattcatttccaactcggtcatggccaagtcggcctgcaaggcttcaaggcactcccaagccatacgcaacccatcgaaccagaacaacgcgccagccaggctcacctcgagttccagtaaaagatcggcgtaatgcccctggtcaaagcggtcctggaaccgtttaagtttgtcgggcgacggtgcacgcaatgccgttactcgctcgctattggcgtcggggtaattgaccagcgcaagccatgcaagggttcggctcaggcgcaaggctcgcaggtctgtcgcactctggcgtagccaccaggcgcacaacgggcgagcctgctcctgcaatgcacgcagcagtttgtgagcgtctttttcgttattcaccaactgctcgggctggcgcagttgcgttgccgcctgcttgacctgggcaataacacccgccactgcgccaggctcaggacggctttgcgcggcaagtgccaggcgctccgacagttgcctgcgaatcggtaataacaaaggcgcatcgtcacccagccgctcgccccatatttcgtcgaggctcgcgaggtgttcaagcagcgcctgaaacactgcctgctgttcggtaagcgagaggttctgcgcaaaaagcggctccaaccgcaacaccagccaattgaacgcagcgctgcgggttctcgacttggcggggtacacaaccgcccaatggtgcacacacaggtggcgtagcaaaccgagacccgccagaagcccgggaaatgaatcacgctgatacaacgcccatgtcaaccagacggcgacccgcagatccttggaatgctcacgcagcagacgctcaccgttctcgctgactttttgccaatccggctgacttgcaccatgaatcgattgcgctttgccaagctcggattccaaggcctcgaactcgctggaaaaccgactatcacagccggcaaaatcctgtggcgaacaaggtagccgcgcaacttcaaggtaataagcgtacagcgtgtctgaataatccattttaggccgcaggcaactaattcaagtcaaaatttcaaggcaaaagcagcacactaatttcaattaaccaatcagcgctccatttgcttcctgttcactttctgaggaagccatcgaaccttagccatccaaaaagcaatcagcaagccagggttttacacttaagaaagttcctacaccctcagtaaataaaggcctgcgcaacagtttgcgcagttcacccaacccaaacactcccgtttagccttgaacagccgcgcccgcgcaccactaatagcgcaagcaactaactgcacataagtgcgcaagaaaaggcactaaaacaccgataaaaatcaggactacttcttaaatatttatccaactaacgccacagaccgccatttcattagcgctcgtcatttcaggcacgcttcttgttatagagacttgcctgaacggccttcatgccgctcaggaatacttacttaatcagacaaggaaaccagtcatgccaacacccgcgtacctttccgtcaccggcgtcaaacaaggcttgataacggcaggcacatttacccaggattcggtcggcaacatttatcaggagggccatgaggaccagatcctcgtgcaggcatttgcccatcaggtaatcattccccgcgatccgcaatcgggccagccaaccggccaacgggtgcacaaaccactgatgatcagcaaggtcttcgacaaatcctcaccgctgctcttcagtgcgctgacctcgggcgaagaagtgtcgtgccggctggagtggttccgcacctcctcggccggcacccaggagcattacttcaccattgagctggaaggcgcgaccatcgtcgacgtgcaatcgcgcatgcccaattgccaggaccctgacaacgcgcacttcacgcatttggaggatgtgtatttcacctatcgcaagatcatctggacccacgaagtggccggcacgtccggctcggacgactggcgtagcccggtcgccggctaacttcggctgacgcaggcacggtcgccagggacggcgccgtgactgctgccggttaactacaccatcgccagcgggtgcttgcgtttgggggcgccgaatacgcggtcgattgcgtccaggtcgtgctcatccagcaccagttgcgcagccctggcattgagccgcacgtgttcgggtgtaacggccttggggatggcgatcacaccgtcctggcgcaagacccaggcgagtgacacctgggccggtgtcacctcgtggcgacgggcgatttgcttgagcgtggggctggccagcaactcaccgccctgggcgatggggcagtaagccatgagcggcaagtggcgctgttgccaccatggcagcaggtcgaattcaataccgcgctcttcaatgttgtagagcacctggttggtcgcacaggctggggaggcaagttcctgcaggtcggccacgtcaaagttggatacgccccagcggccgatcttgccggcttcacgcaggcgttcgaaagcgtcgacggtttcttcaagagggtattggccgcgccagtgcaacaggtacaggtcgatgtagtcagtgcccaggcgttgcaggctggcttcgcaggcgcggggcacgcctttgtgactggcattgtgagggtagattttgctgacgagaaacacctggtcgcgcttgccgcgaatggcttcgccgaccacctcttcggcaccgccttcaccatacatttcagcggtatcgatcaggctcatgccctcgtcgatacccaactgcaacgcagcgacttcagcccggcgctggtccgggttttcgcccatgcgccaggtaccctggccgatgacaggcacgggaacaccggccagatcgatagtacgcatgacaacctcctgatgagttcgcgggttaactgtgtggcactgaccggacaaaagggttcaatcgaagtatggttagcctttgccaagtcgccaggaagaacctgcaatgctgtttgtcgtcatgctcgggggtaagcacccacgggccagaattgaagttcacgatgtggtgtttgcagtggcgccaacgctgcaagccacctacccgcaactgcgcgacggttggttcggcagccccaagggtgtgcatatcgacgcctggatggccgtggagggcgtcgacggctggaaagtcgagatcagccacatggcaccacaagcagacgcgcaccacctgtacttcatcaacctcggcggctatgaagccaacgtatttggcgaggctcatcattatttgctggtggttgcccgtgacaaaaaggaggcgatgagcaagggcaaacagcagatgctgcgccactggtcacagccccataccgacggcgtgctggatatcgacgactgcctgccgatcgacctgatggacgggcgctatatccatctggtgcaaggcccgcatcgaccgatcatccagcagaacgactacatcgttctgccctgacgcctcacacgtcgagtgtcagggttttaccaaacaggcggttgccatgggtttcaccctggaaggtgtaggtcggtgaacccagcacctcatagccgcgtcgagggtaaaagcccagcgcgcgttcgttgccgacccacacggttgcccacagtaacgcagcgccatcgcgtgcagcgctttgctccgccgcgtgcagcaactgatagcccagcccctggccggtaaagcgttcctgaatatagaggcgttgcagctcggcagcgtcagcggtgtcgatcatcgagtggctggcgttgagcttgatctgggcgaagccgaccaggtggccgttggcttcagccaccagcaacgcaatgccgggttgcgcaatcagttgggcgatggtgtgcggcgcaaaggcttgcagtgcctcatgagcaatcgagctgcgaatgccttcagtggcgtaggtgtcgagaaacacctgcatgcccaatacgccaatgcacagtgcatcctcggcaatggcggcacgaataatgaacgttggggtgggggcggtaggcattgagtgtccgtactcagggttgaaaagatcaccgttttaccacgaatgcagggcgaaggcgttgagctgttctacgccggcttcagctttaaaggctgggtgggttaccaaccgcgctagtggcttaccaactgcccgacgccccgccgccgccactggaaccaccgccaccggacgagctgctgctggagctggaactcgagcttgcggaacttgaacccgacccaccgcccgaccccgagccgccatcggaaatgctcgtcaaaaacacaataaacgcaacgacggaggccgccggtatcgccagtagccagccctggtagccgtgcccgagcatcaaccctaccgccacatacaccgctgccaccgccagcacacgcacgaggaagaaacgtggtttggtcttccaggattgatggatgacaaagaacaaccccacgtacaacgccagcaccagggcgccgccaaatggcaacgccagccaatgcacgaagttgacttcgacgaagtggctcaccaccagcaccgcgacgatgtaggccagcgctgccaccacgcagtaaaacaccgcgcgcgccagccacagcgcgccaaacgtggccccgccgatcaacagcgtcagtggaaaggccaccaggtacaccggccactcctgcccgcctgaataaatcgtcagcagcaccgtcaccgccacggtggcaatcagcgcccggcgccaatgcagcttgccggcggcgatcagtacaccgccgatggcgccggcgataaacgccagcagtaccgcgatgatctgcggattcacctgcggcgccgcctgctgtggcaggtcgccgccgtccaccagcacggtcagatcgttgacggcttgttgcacgccgcccgcatagtcgccctggcgaaacgccggggtgatgtgttcttcaatgatgcgatgggccaacaggtcggtgacggtgccttccaggccgtaacccacctcgatgcgtaccttgcggtcttgcttggccaccagcagcaggatgccgtcgttgacgtccttgcgccccagcttccaggcgcggaacagttggttggcgtagtcctcgatgctcgtgccgccggtgctgggcaccagcagtaccgcgacttgcgcgcctttgcgctgttcaagggcggccaactggtctttaaggcgctgggtcgtgctggcgtcgagggtattggtgaggtcgatcacccgttggtcaagggccacgccaatcggcgaagtgtctgcctgcgctgtgctcagcaagccgatgaacaccaacgcgagaagactcaagacggattgccgcagaatcgccatcatgtttgttacctgaagtttctacctggaggcgccgactttacctgatcggggctaaagcacgtataagtcacgccagtcgttaccagcttccggaagccccaccgccgccactggaaccgcctcgacccgcaccgccgctgccaccgctagcgccactggaggaaccgctgctcgagccggacctgcggtatctcgagcgggaggagccaccgcccgaacctgggcgaaaactgctggcggtcaggcaaaagatgaatacccccgcaaacgcggctttcggcaacgccagcagccaaccaccaggaccggcgtgcgcgtccagcccggcccccacaaacactacggttgtcagtaaaaaccgcacgaaaaaccccactcggctcctgcgccaggcgtctttcatgacccaaaacagcgccaggaacagcgtcagaatcgctaatgtccccaccaaaaaggcccaccagtcgtagaaactgatgtcgcggtattgattcaccaccaccaggctgatcccatagatcaacagcgccagcgcgcagtagaacacggtgcgtgccctccacagccagccgaaaaccgcggcgccgatcagcaggttgagtggaaacaccacgaggtacaccggccattcccgaccgccgcaaaaccccaccaccagcgcagtcagcaccgccgtggcaatcaacgcgtggcgccagtgcagcgtgcgggtcaccaccagcacgccgacgccggcaccgacaatgaacgccagtaacaccgcgctggcgcccaggggcaaccccgtttcagcgtccctgggcaggtcaccgccgtctaccagcacgaccaggtcattcacgcccctggcaacgccgcccacgtagtttccctggcgaaacgccggcgtgatgtgctcttcgatgatgcgatgggcgagcaagtccgtgacggtgccttccaggccatagcccacctcgatgcgcaccttgcgatcgtccttggccaccagcagcaggatgccgtcgttgacgtccttgcgccccagtttccaggcgcgaaacacctggttggcatagccctcgatgttcgcgtcgccggtggtcggcaccagcagcacggccacctgtgagcctttgcgccgttcaagcgcgtcgagttcgagtttcaggcgggccagggtttgggcgtcgagggtgccagtgaggtcaatcacccgttggtcgagggccacgccaatcggcgaagtctcggcctgagcggtgaccaacaggccggcgaccatcaacaccagcaaactcacaacaaaatgatgcaaccaccgcaacatgtccgtacctgacgtttcttcctgaagtcgccgactttaccttatcgacgtataacgcgtgaccccacgcccgcgactatctaaactgcgcccatacccacatagcaaaaagccatgcacgagaacgccatgaacctaaagcaccgcaacaacgtcagtgtgacaggcaatggtatggcgaccctggtgttctcccacgggttcggctgcaaccaggccatgtggaattacctggcgccggcattcttcgaccgctttcgcgtggtgatgtacgacttggtcggggccggcctgtcggacctcagtgcgttcgacaaaaccaaatacgccacactggcaggctatgcccaggatttgaacgagattgtcgacgcctatgcaacgggcccggtgatcctggtcagccattcggtcagtgcgatgatcgccaccctcgccgaccgcctggcgcctgggcgcatcgccgcccacgtgatgatcggcccttcgccgcgctacattaatgacgccgattacgtcggtggtttccagcgcagcgacatcgccgacctgctcgacatcctcgacagcaactacctcggctggtccagtgccatggccccgaagatcatgggcgcgccagggcaaccagccttgagcgacgaactgagcgaaagtttttgccgcaccgagcccgacattgccaagcagtttgcgcgggtgacgtttatgtcggacaaccgccaggacgtggtcggcctggccacgccggtgctgatcctgcaatcgagcgatgacctgatcgccccggtcgccgtgggtgaatacctgcaccgcgtgctgcccaacagcacttactgcctggtggacaatgtcggccattgcccgcacatgagcgcgccagaggcctgcgcggcggccatggaagacttcctggcgccgtgggcgattgccgatgtcggctgagttgttcgataacgccgcctgcgccctggccgtcaccgctgaagacggcacgatcctgcaggccaatgcgcgcttcagcgaatggctggggttcagccgcgccgagttgtgcgggctacgtttccaggacttgttgaccatgggtgggcggattttccaccagacccacctggcgccgatgctgcgcctgcgcggcagtgtcaccgaagtaaaactcgacatgcggcaccacgacgggcacaaagtgaccgtgctgctcaatggcaacaagcgcgagcaggctgacgcggcggtgtacgacctggccttgttcggcaccaccgaccgtgacaagtacgaacgcgagttgctcaacgcacgccacctggccgaagcattgttgcaggaaagaaccgccaccgaaattgcactgcaacaagcccaggccgagttgagcgaggcttacgcgattgcccagcgccgtgcgctgtttgccgagcagatggtggcgatcgtcagtcacgatttgaagaaccctcttaccacgatccgtatggcgtccgactttctcaaccgtggcgagcgtacggccaaagagcatcagttattgggccatatcgcccagtcttcggagcgcgcccatcgcatgatcgccgacctgctggacttcacccaggcccgggtcggccacggtatttccatcaaggccgcaccgttggacttgcatgcggttattgcgcacgccgtggatgagctgcgcgtggcgttccccaaggccacgctggagcatcacgccgaaggccagggcgatgcctgcctggatgccgaccgcgtgcagcagatcatcggcaacctggtggccaacagtgtcgcgtacggcgacttgcgccggccgatcagcgtgacctccaggctcggcgagaaaggttgcgaagtgtcggttcacaactacggcgcggtgattccagaggcattgctggccgacctgttcgagcccatgacccgtggcaccgaccagggcagcgaggtgcgcagcgtgggcttgggcctgtacatcgtgcgtgagctggccagagtgcacggcggcgatgtggccgtgagttcctgcgccaccggcggtacgacgtttacggtgaaattttagaacacgtacgcggcgccctgcatgaccggctcaacgctgccggtcaacaccacaccgccctgcccgtcccattgcaccgtgaccgtgccgccgtcgcactgcacctgcacggtgtcgtccaacaggccgcgccgaatgccgttgaccaccgcgccgcaacaacacgaaccggagcccaacggcacaccgccaccgcgctcccagatgcgcaagcggatgtggttgcggttcagcacctgcacgaagtgcacattggtcctggccgggaacagcgggtggttttcgagtgccggccccacggctgccacatcgacggcggctatatcctcgacaaaaaaggtgcagtgcggattgcccatgctgcacgcggccgggttgccgtcgataggcaagctgcgggtgtccatcgcttcggccaagggcacggacgcccactccagcgatggcgcgcccatatcgaccgacacctgccgcgcggccgcgcgcacacaggtcagcaagccgcgctcggtgcgcaacacaatcgaatcgctgccggtttcatgcatcaggcggtcggccacgccccgggtggcgctgccgcaggtctgcagcggcgtgccgttggggttccagaatttgatgcgtgcagcggcgtcgtcgcagtcgagtaccacggccagctggttgaaaccgatgccggtgtggcggttgcccaggcggcgggcgatctgcgcggtgatcgggtcgtcctggccacggcggccgatgatgatgaaatcgtcgccatgggcatgcatcttcacgaacggcaaggtcatgggcggtccttggggcgaactgagtggagatccagcatacgggagtttcatccaagccgattcggccacatgttagcgtgggcgcgttctcgtcctgcagagccctcgatgaaaaaaaccgccttcgtttttaccacactgctcgccacgttttgccacacggccgtcgccgccgcgcaagcaccgagcctgtgccagccggccttgtcgaacccgacatcccaggcactgctgactgccgcgcaacggcatttggccgacgtgcctcagcccctgccccatctgcacaccgaaggcaccctgcctcaccagggtatccgcgagcaaagtatcgccgccgaaaaggattggccggtgatgcgccaggccgccctggcgtggcgattgagccatgacccgcgctacctcaagcaagtcgacgattacctggcggcgtgggccgaggtgtaccagccggacttcaacccgatcgacgaaaccaacctcgacatgctgatcaacgcctatgcgctcaccgccgacagcctgcaaccggcgacccgcgaggccagccgccgcttgatcagcagcctgggcaacggctacatcgcgcgcatcgagcagtttcacgggcagaaaaaaggcacccagaccaataactggcagagtcaccgcgtgaaattggtcacggtcgcggccgccgcgctgggtgaccaggcgatgcttgagcaggcccatcagctgtttaaacagcagatcgccgataacgtactgccggacggttcggtgaccgacttccaggaccgcgacgccctgcattacgtagtctacgacctcgaaccgctggtgcaagccgcgctggcagccaagccttacggggtcggcggcgactggctgagcctgcgtgcgaacggcgagtccctggccgcggcccttgattggctggtgccctatgccactgggcaacgcagccatcaggagttcgtgcacacccatgtgcaattcgacaaagatcgcgctggcgtgggcgaagccggttacagcggcacctggcaacccaagagcagtgcgacgttgttctggctggcggcgcagttggacaagcgctatttgcccgtggccacgcaattggccgcgcgcccggccgactggatcagtgcctgctatttaaagtaagcgccgctagactggccgcactgccctttgcaaaggattgaccatgctcattgtgttcagcggcctgcccggcaccggcaaaaccacacttgcccgcgaggtggcgcgccaggccggcgcggtttacctgcgtatcgatgtgatcgaacaagcgctgcgcggttctggcgtgttggccggggatgtgggggccagcggctatggcgtggcgaatgcgttggcgctgagcaatttgcgcctgggccacaaagtcgtcgccgattgcgtgaacccggtcaaggaaagccgcgcggcgtggcaggcagtggcgaccggcgcgggggttgagttgctggatatacaggtggtctgttcggatcggcaggagcatcggcgccgggttgagagtcgcgcaggtgatattcctggcctggttccgccgagttggcagtcggtgacggcgcatgaatatgaggtgtgggatgaagtgccactgacggttgatactgcgagtgtgacggtggatcaggcggtcgcgttgatcctgacccacatctaacccgtggcgagcaggcttgccctgcgttggggcgcgaagcggccctaattcagccactgcggtttttcagaaagaattcggtgtgaggttttggggctgcttcgcagcccaacgcagggcaagcctgctcgccacaggaagcccacccccctaaagcaccgcccccatcgccttcatccacaccgggtcgcccccgtaaaattccggcgcgtacaccagcccgccctggcggtcgacttccaccgcccagtaggcca

SEQ ID NO: 60 - DNA, 73015 bp, Pseudomonas poae FL10F
tgggtaacccggcaggacgccgggttagccgcgctgggccaaggatggcccatcgcggcggcccacggattcaagccggagtgagggcatgccgagcctaggcgaggcaccgagtggtggggcaagagcccttttggttacttttggggctcttttccaaaagtgacccgccgtaagggcggaaccaatttcagccatcacccaaataacggatatgtacccccccacacacccgagcccacattgggttactcaagccacctgtttcgcccgctcacgctccgccaccaactgccgcgtcaacggaatcaaccttttgccataatcaatcgcatcattcagcggatcaaacccacgaatcagaaaagtgctaatccccaggtcgtagtaatccagcaacgcctcggcgacctgctcagcagtgcccaccaacgacgtggaattgccttgcgcaccgagcaaccccgcaatccccgtccacaaccgcttatccaaccgcgacccttgcgccgccgccgccaacaaccgccgcgagccctcgttcggtggttcacgccgcacaaacccattctgctcagccagcgccgtggcctgctgcaagatcgtctcggcacgcgcccaggccagttcttctgtctcggccaggatcggccgcagcgacaaactgaagcgaatcgtacgcccatgcttggccgcttccgcacgcacctgggtcacgatttcgcgcacttgctcgtaggtttcgccccacagcgcatacacgtcggcatgcttgcccgccactgcaatcgccgccgctgatgaaccgccaaagtacaacggaatgtgcggctgttgcggcgacttcaccgtcgagtgcgcgccttccacctggtagtacgtgcccttgaagtcgaagggggtctcgctggtccattcctggcgcaccacgctgaggtactcgtcggtacgcgcatagcgttcgtccttgccgatatggctgccatcggcgcgcagttcgcggtcgtcgccgccggtgatgatgtgcacggccgtgcgcccgccgttgaacacgtccagggtgttgaactggcgtgcagccagcgtgggctgggcaaagcctgggcggtgcgcgatgaggaactgcagttttttagtcacgctggcggcatgcgcggcgatcagcgtgctgtccgggctgttggagtggaaagccaccagggcgcggtcgaagccggcctcttcgtgggcgcgggccacggtttcgacgtagtccggttgcagggtcgggccgctgcgcgggtggatctcggatgcgtggtggccgccgatatagccgataaattcaatgctcatggtctgtccttgttcagtacgggatcaacacctcctccgggcgtggggtcggtcactcgcgtcaaaagtaagggcagtggccgggtctgtaaaaggcctgttggttctaacctaattattaaaatgcagaattattccaatagttttttataaataaggtgcattaagcgaagccgttagaaactcaaccgaatctcagcgcacagcccgccacccgcgcggttgctcaaggtcagtgaaccgccgatggccaccgccaattgttgcgcaatcgccaagcccaggccggtgccaccggtgccgcgattgcgtgagctttccacccgataaaacggctgcaggacctgcaccagttcgtcctcggcaattcccggcccacggtcgagcaccttgatcgacagctgcccagctgcggtcgagccgacttccagctgcgcgctgccggcgaacttcagcgcattgtcgaccaggttcaccagcacccggcgcaacgcgtgggggcgggtgtcgagcaccaccgagcttttgccgctgagactgacctgcttgtgcatgtcctggtagtcaaacaccaggctgtcgagaaaggcatcgaggttgatgcgatgactggcttcggtggcgccgtgcacgctgcgcgcataggccacgccttcgcgcaccaggtgttccatttcacccaggtcgctccagagtttgtcgcgctcggcgcagtcttccatgaactcggcgcgcagtttcatgcgcgtaatcggcgtttgcaggtcgtgggaaatcgccgcgaggatctgcatgcgctccttgaggtattcggcgatgcgttgttgcatttgattgaacgccgccgccgcatgcgcgacttcgatcgggccgtgctcgtccagcggcgtggggtgggcgttggggtcgagggtttccaccgctcgcgcgagccgcgtcaacgggcggatcgccaggcgcaccgccagccaggtgcagccgagcaacagcgccaattgcaggatcagcaccaccggcaaccaatacgccacgggcagggcggcggggcgcacgtcgatggtgatcgggctgccgtcggccagggtcaggtgcgtctggaagtgtttctgcaggccgggaatgtcgcgaaacgtcagcgcgtactgctcgctcagcgcgtctgcaatcgaggtggcggccattggcacgtcatcactgttcatcggctcaccggtctcaccggcactcagcaaatagtgatagttctggcggtcgatacgcggcagccaactggcgcgctcgttggcgggcaggcggtcgaggatcgccaccgaggtggatacatcgttctccaggttgccgagcatcgcggtgcgcgcgctgatatagcgctcgtaaaactgcgcgcagaacgacagcccatgggcgcacaccaggctgatcagaaagatcagcgacaactgcgatgccagcgtgcgaggccagcccaagcgccacttcattgctcggccccgaggatttccacagcgagggagaacacataaccctcgctgcgcacggtcttgatataggccggttcgcgggcgtcatccagcaggcgttggcgcaggcgactgaccagcaggtcgatggagcggtcgaacaggtccgcgtcacggccttgtgtcaggttgagcaattggtcgcggttgagcacgcgttgcgggtggtcgaggaacacccgcagcaggcgatattcggcgccgctcagggcgaccagcgtgtcgtcttcgtcgagcaggtggcgggcggtggtgtccaggcgccagcggccaaaacggatcagccgcccggtttcactcaccaccagattcggcggcagcatgcgcgtgcgacgcagcacggcgttgatgcgcgccagcagttcgcgggcggcgaagggtttgaccaggtaatcgtcggcgcccatttccaggccgatgatgcggtcggtttcatcgttgcgcgcggtgagcatcagcaccggcgtggctttgtgcttgcccacccgcagctcgcggcacagctgcagtccgtcgtcgccgggcatcatgatatccaacacgatcaggtcaaccggcgtggtgtcgaggaagctgcgcatctgacggccgtcggcgaccacggtggtgcgcatgccgtttttcttcaggtaattgcccaccagctcgcggatctcgcggtcgtcatcgacgatcaggatgtggtcgacatgatccatgctgcgttcctcgttaaatgctcatgggccgcagtctagccatcgccgcaggctttgccttgtgccctttgtattgcagtgtatctggcgataatgagatacacagcgaagcaaaaaagctgacaggccagcgcgcggggtcgctcagcccagcaaggcctcgaacgcccgttgcacccgtggctcatcactgtgggccacattgaaccgcatcaagttgaggtgcgccggctcgtagccgaacagcgcgcccggcgccaataccaggctgcgttttaacgcctcctgggccagccgctcgccattcacgcccggtggcaggtgcgcccagataaacatcccgccttcatacgccatcggcaactcacaaccgcagcgtttcagccattgctcgacacgcccgccggcttccatcagccgctgcaccacgcgtttgcggtgcttggcgtagctgccttcgctgagcatgcgatagatgagctgctcgaacagctccgaggttacgccgccgctcatcagcttcatgttggtcaggttcgctgccagttgcggcgcggccaccacgtagctgacgcgggtgttggcgctgaggatcttggagaaccccgacaggtaagtgacctggtccaggccggcgagggcggccaggcgtggcggcgggttggggtgcaggtcgccgtagaggtcgtcctcgataatatggcagtggtattgctgggtcagttgcagcaggcgaaacgcctggctggggctgaaggaatggccggtggggttgtgcagcacgctggtggtcaggtagaggctggggcggtgctcggccagcagctgttcgagggcggcgaagtcaaagccgtcggggcgacgctcgagggtcaccaccttgaccccgtgcagcgccaggttggcgtggaagttgaagtagcacggcgcatccagcagcaccgtgtcgccggggcgtgcgagcaggcgcataagcatgtccaggccttgcacggtgttgggcgtggtgatgatttgctccaccggcaccgacaggccatcgccgtgcagcttctgttgcaaggcctggcgcaacggcaatagccccgccggcgtgcccagcccggcaaggcgcagcgacggcgcgcggaccacgctgcgcatggcttggcgaatggcttcgctgttcagccagtcctccggcaagtggccgctgccggggcgcaactcgccgctggccgtcaccaaggggcggcgcagcacgctgagcaggtcttggggcagcaggtcgacccagttcgccgacgcggggcgggcgctgtccatcgccacaaagtagccgcgaccctggcttgaggtcagcaggttgcgcccgcgcaggcggtccagcgcttcgttgagggtgaatttgctgacgcccaaggtcagggtcagctcacgcaccgaaggcaacttgctgccgggcgcccattcaccgctctcgatggcctggctgaacgcctcgacaatctgctggactttgggcgtgccttggacaaaggcgatggcggatacgaacataaaccttcctggtatttgccggttattttaccggtgaagtaatgccggattaggcattactttacctgccttgcgcaaggcggtggctctagactgcgggccatcgacgacaggaataactccatgccaaggcaactgctcaaccccggcgcgccgttctgcatcgcaatggcgcagcagaaatacctgacggctgaaaaaggcctgcaaagcgccatcgacggtggctttacccactggtacatcgacggcagcctgttgggcgaaggggccgaggattggaccgatgcgcgtatcgccagcctgcaggcgaagatcgcggcaagcggcgttcagccgatcttccacagcaactttaaggcgccgctgggcagcgatgtgcgggcgttccgtgcggcagcggtggagtacgtggaaaaagagatcgatattgccagccgcttgggtgcgccgctgatcatccacggcggctgtatcgtcgggccgcaacgggtgcaggaggccaaggcgattgccctggcgcagtacctcaaatcggtgcgggcgctggcgcagtatgccgaggctcaaggcacggatatctacctggagagccgggccaactacgtcaactaccgaatatttaccgacgaggcgcagttcgcctgcgtgttcgaacacttgcaagcgcacagcaacgtttattgcttgctcgacgccggccatgcccccgtcgacaacagcttggctgcacatgtggtgcgcaagtatcacgggctgatcaagggcattttcttcagcgatacaacacgggcgccagacatcggcgactacgcggacgtggtgcgggcaatcgtcgacacccgctggaaaggcctggtggcgtttgaagcgaaggccgccctggccgagctggcgcttaccttcgccagtgtctcttcccactaaggtatcggcccatgaccagcgcgttaacactgtcttcgtttctgtactttctgctgttctgcgtgaccatgaccttcagccccggcccgatgacgctgctgctgttgggtctgggtctgaaagatggcttgcgcagttcgatcccggcgcagatcggcgccagcgtggcgtacctgatttcgatcctgatctttgccgtgggcttttcggaattgatcaagggcaacctcgctatcacccagaccctccagctcgtgggtgtggcctacattctttacctggcttacaggcagtggaccagcagcggcgtatcaatcgacagggtcggcgccgtggagggtgcgcgcagcctgttcggcaaaggcctgttgaccgggttttcaaaccccaagaccatcatcatgttcagcgccgtattcccacagtttgccggggccggggagcacacttcgacggtggatatcgccatcctcgggctgacattcctgacgctgcaatttgccagcggttgcctgtactgctatttcggccagcgcatcaagcatgtgctggataaccccaagcgccgggtgctgctgcagcgggtcacggcggtgttgctactgggtgtggcgttgatgttggcgcgaggattttcccactgaagtattagcctataagcggtagtggcgatttgacgttgccctgatagactccaggcattcatccaggatcacaccagaccatgtcagccgccggaggaaatggacttccgctcgcttcacggttgtataagtcgcgcgccttgggattgtcgctcggctttgtgtgcgtggtgtttggtatgtaccccttgcacccgccgctgtgggtgtgggcctggatgttgatcaatgccttcgtctggccgcacatcgcctatcaatggtcacgccgcgccagcaactcactgcgcagcgaacgccgcaacctgctgttcgattccttttgcggcgggttctgggttggcgccatgcacttcaatccgctgcccagcgtgaccacgctgtcgatgatgaccatgaacaatgtggccatcggcgggccacgctttatgttggcgggctgggtggcccaggcattgggcatcggcgcatcgttgctggtgttcgccccggcgtttatcgccgtgactaccaaggctcagttgtacgcctgcctgccgatcttgatggtgtacccgctggccctgggctggatctgctatcgccaggccgtgaccctggctcgacacaagcgcgaactgctcgccctgagccgcaccgacagcctgtccggcctgctcaatcacggcgcctggaaggaccatctggaaatcgaattccaacgctgccgccgcgagcaggtcggtgccgccattgcgctgatcgacatcgaccatttcaagaccatcaacgacacctacggccatgtcaccggcgatatcgtgctgcgccaactgagtaaaatactgcgccagaacctgcgcgttaccgaccttgcaggccgttacggcggcgatgagttctgcgtgatcctgccgggcatgccgctgcaccgcgccaccgaagtgatggacgccttgcgcgatcgcttcaacgcgctggcctatgcccaggacccgacgctgcgcgccagcttgagcatcggcctggcgccttttcaacccgcgcatgccgattccaccagctggctcaacgacgccgaccaggcattgtatgaggcaaaaagcagtgggcgtaaccgcgtgagttcggtgcaagggagttggttgcggtcggtttagtggggtagggtgtcgcagcccctcccaacaaaaacacaaggatcggtccatgctcttcaccttctcccgtaccctcctggccgcgaccctggccttgtccttcgccgtgccggcctacagcgccgagccgcacaaacagatccaggccgattccgaacagtacaaggccgaggccctgaaactgcttgaacgcctggtgaatatcgattcgggctcaggctacgagcctggcctgacccaagtgcgcgacatcgccgtggatgaattgaagcagctgggtttcagcatcgaactggtgccggacaaagccgccaataacagccatgtgatcgccaccctcaagggcaccggcaaggccaagatcctgctgatggcgcacatggacacggtgttcaaggaaggctcggccgccgagcgcccgttccacatcaaggacggccgcgcctatggccccggggtgatggatgacaaaggcggcatcgttgccggcatttacgcgctgaaagtcctgaaaaaccagggcttcaaggactatgcgcaaatcaccttcctgctcgacgccagcgaagaaaccggttccgaagcagcctccgagctgatccgcaccaccgccaaaggccacgacgtcaccctcaacctcgaacccggccgcccagccgacggcctggttgtatggcgcaaaggcagcgccaccgccgtggtcgaagtcaaaggcaaagccgcccacgccggcgtcgcccctgaactggggcgcaacgccgccatggaagccgcacaccagatcctgcaactgggcaaactgggcgacgaagagaagaaaaccacgatcaacttcacggtcatcaaggccggcgaccgcaccaacgtcatccccgaccaagccactgccaaggccgacgtacgcgcggccttgccggaagagtttgaccggatcgagaaagacctggcccgtgtatcagccaacaaattaatcccggacaccgaagtgaagaccagtttgctgcgcggcttaccgcccatgccgcaaacgccggagtcggacaagttggtcgcaattgcccaaggcatttacggggaattggggcgtaagttgaccatcgaaggcagcggcggggcggcggatgcaagcttgtcggccggggtgggcacaccgacgttggacgggtttgggattgtgggggggaatattcataccccagaggaatatgcggaagtggagagcgtggcgccgcggatttacctgcttagccggatgattgtggagctttcgaaacggtgatttgttcgcagggttggccattcccttaagggtgagcctggctctgtggcaagcaatctactggtggcaagcaggcttgttgtggcgagcaggcttgccctgcgttgggttgcgtagcagccccaaaactgacgacgcggatctggcttcagaaccgcgtcgggtttattggggctgctgcgcagcccagcgcgagcaagctcgctcgccacagtgtttgacggcgtgtcagtgaggcaggtgttttcaccatgtggattggtcttcgaggctggctttatggaggtcgtctttccaccactcatttgtcaacctataaatgtcctcgaagaaggctcttgggttctccatagcgctccatccccagggtagggagcagtaaaaaccaggagccgggctaaattcttgcgagaagtcataagtttcatcatcaagcgcagcacctaaagtgtcgactaagagttttcgatgccggtaattcaaatctgagcttttatttattatgtacttttttattaatttttccctgtctgacttaaggtcgatgttgtaggttgaaaatatctcgcccaaggtttcttcacggtcataaatgtcgaacggtgaaaggaagtaacgaatctttggctggaaggatgtatttagaaaagggtgttttaacatcagtcgtcactcactggaaatacggtatagaggtttttggtttcgcgatcaaatttcgcgatcgctgtattcatgtcttcgtcatatactgggttgttcgggtcgccggggtttggtatgtatccttttccacagtccagtaactccattcggactatagggtttccgtagtaatcctcccctgtgaatggctccagattccgatctgttcttgtggtggcttcattcagggcagcgagttgcaccctgtggcttttgaattgagtgctgagttgcataggttgattttacctttgggtaaaagattttagagaatttgatcttgtattggtttctcttcgatcatttcgttcttgtagtttttgagttgttcgagtagcaccctcatgaagtctttcttgtcagctatttcatcttcgaaatatgtgtcaaagaggtaaaagacagactcaaaattttcatctgtagccaagaagtattcgagcgtatctataaaccactgttgctcatcttctttatatgagaggaattctggctttgtcaatgcgtcgaatagttccgcaagctctttggggtcgttgatgtttttcgaagctataatctcctctctctctaggtctctggtgttttcaatgcagtaagtaaatagtagtccgcgaagtatggtaagttttgggtgttttttcatttttaaaattccgtaaaggcggtgataggtttgccgtctcggttcaagtagacgatggcttttctctgtgttccatatgtcaggccatctcttttgtagccctcacctataatctttcccatatctatcgggtcaggtgtgtctggtctaccattaagtctgaaaattagcagcgcacggtcaattgcatttaattgatccctatggcttagaaagcgagttgccgcgctgggtggcctgggttcacccgttcgtctccctctaacgaacctctcaatttcccctgtggtggggtttctagctgttattacacgctcacgttgagattctagtgtcgtctgagcaccgtgtttttccaagaagtgtgcctctgggatagacccctctagttctgataaacgccggtaagcgttggcttctccaagctcattaatgcgtgcctgtcgctgtgcgcgtgcctgttgcggtaaagcgggttccccgagttcaactcccgctgtcggattttgaacagaactgtctggcttgcatccatccccgccggggcatgtgttcaagcccaacggatccacccaccccgtaggattaggcacgtactggtacgcattgatcccacccgccagcttcaccgggtcgggtgtcaagtaacgaccaatatctggattgtagtagcgatggcggttgtagtgcagtccgctttccgggtcgaagtattggccttggaagcgcagcgggttgtcgattttgttgacgtctaggcgactgatctggccgtaggcgcggtagtgcgcggaccagacgatttcgccgtctggagcggtgagttcctgcggtgtgcctaggtggtccagttgatagtggaagggctgggtgtcttgagggccaaaaccttctaacagtactaagggccgaaagctgtccggctcgtagatgtaactgcgatgacgatccgcgtgatgctcggcaaccagcttgtcgccttgccagaaaaactcagtggttactccatcaacggttttgctgatccgccgaccgaacgggtcatagcgataactggccgttttcccgttgggttgagtaacgccgatcaaccgatgctgacagtcgtagcgatactcggtgacgagttgatggcctttaccgcgtctttggcggatcagattgccaaacgcgtcatagtcataatgatgatcgccctgaatcaccaaccgattccccgccacgatgtccgggccgggtcgatcctgcatcagcaggttcccagccgggtcgtggccgaagcgctcctgctggtcttgcgaatgatcggcgcgggtcaggcgggcgagggggtcgtagtggtagtggtgttcgcctttgcgggtgtcgagcaggcgggtgaggttgccggttttgtcgtagtcgtagtggcggcggtagagcttgtgttcttcctgggtcaccgcgtgggcgtgcaggcggttttgctcgtcgtagtggtagtgactgaggagctggccttgctggcgttggcgttcttttccggtgttgaacaggtgagacgttagggttttgccattcagttcgacggtggcgaggtggccgcctttgtcgtggttgaaggtgaggcggttgttgtccggcaggcgcaggttcttcagttggccgcaggcgtcgtagccgtagcgcaaggtgccccaaccttggtggtcggcggtgaggcggttttggctgtcgtattcgtaggcgagcgcccagtggccgtcgtcaacgctgaggaggttgccttggcggtcgtaggtgtattcaacaacgttggaatcgggaagggtttttcgtacaagccgcccggaagcgtctcgctcgtagcgggtgactagctgactgccgtcatcgccgtgttcggtcttttccagcaggttgccgttgaggtcgtagacgtacgccgtacgctggccgtcaaagccgatttcctgctggatcaggccgttggggtggtaatccagccggtaggtttcaccgacttcgttttcgatctcggtcagtagtaaccgggtgttgtcgtagcggtagttgacctgggtgccatcggcattgaggcggcggctgatcaggtgcaggccgtcggcgtattcgtagcgggtgacttggcccagttcatcacgttcggaggtgatttttccgtaggggttgtagctgaattctcgcgtggcaccgcctggaagtacgacacgaaccaaccgacccacaccgtcccactgatactgggtcagcgccccatgctcatcctcacgcgcaacctgtcgcccaacatcgtcatagcgataccgcttaaccccaccattcggcagttgctcttcaaggagctgcccacgctcattccagaccagccgatgacaaccgttatccggataccaaaccccaaccagttgcccatgtttgttgtaggtgtagtccgtaacattgccgtcaggatctgtctgacgcgtaacgtcgccctgttcattacgctcatacttccaaaccgcctcaccccgccgcacaacccgtacgaacccgttgtcatgctcgtaggatgtcggctcatcctcccccggaaacaacgccaccaagcgtccggcatcgtcatactgatacgccgtgaccgcccccagcggatcctgctcgaccgtcagtcgacccttgtcgtcgtaggatttgaagtgctcagcaccatcaggatcaacccgctgcaccagccgcgcgcgctggtcatggacatagacttcctgactgccatcagcgttgtgaaccgtaacccgaccgccgtcctcccacgcataccgcgtgtccatctgcgaaaaactggcccagtgccgaacacagcgcgccgccttgccggaacgttcccacgcccaaaagaaactcgccccaccggccaattgccgctcaagaatgacgtgctgatcgtcgtaccgataaacctcgctttcgcctacggcattggtcgcggaaaccagtcgtccagcgtcgtcataggcgtaggaaacaacgttctgctccgtcacccaaacatacggctcacgccctttggcgcgatgaacctgatagtccaccgccacaatgcggccaagttcgtagcgcagaaacagcgaccggcctacaccgttatccagccgctcaatccgccccgaacgatcacgaataacccgcagtcggttgtcatacgcgtcgctgatcgctgtcagaacaccatcgcaaaagtgataaaagcgcgatgcctgagccagtaccagctcatcgggcaaagaccccaagtagatcgcggcttcagccaagctattggtaatcgctggccgggaaacggtaggcaacggaaactcagtaatgcgattctcatgatccgtccaaaccaccgaatcacccgcaaccaccaaccgctgcgccagcgaatgactccaaccaaaccccaacccgcaatccacttccaccgcgctggtgcggtacaaccgcgtccactcaaacggcaaaattccgtccagcgcgccatcggtaagggtcagtaattcctcgccggtgaccatcgacaccgggcagccattggtggccgttttatccgcaggcgccgccgcatcgccctggggatttttcgcagcgacaggcacatcatcgacatgctcctggcgcaccaacgtcgtctgctgggtcttcttacgaaccgcaggcaccgcattcgcaaccagattttccccagcctttaacggcgcaaccggcaccgtcttaatctgagtcgccgcactactggccagcaacggcttaaccacctcggcatgcggctccaacttgggcatcaccaacgttttagccagcaactccagcagaacccgcgtccgcccagacttgatatgcccaatcacctgagcacccaggcgcaccgccacacccatgcccgccgtcgcccagatcagcagcaagttaatcaacacctcgccagtgatttcccccatcaactcattcatttcttgcggtggcagcatgcgcatccagctgaccatcgccgacacataaatgaacaacagcggctcatcgctgagcaccagcaggccgttggcaatcgtgtcgttgccgagcttcagcagttcatcaagttcggtttgggagaggtattgcagcaacttttcgctgttgggcttgatgtccgccaacaggtcaaacaactgagtgatgttgtcccacaggctgtaaatcgctttgcccatgccgctgagaaacgccgcttccagcatcctgcgtcggtccagcggggtcgcgtccgtatagtctttccactgtgcctggaacctgttgttccactcgtcgcgcaggcgcgcttccagcgccccgatcaccgcctgataagacgcatacagcgccttgatgtgatcctgggaaacgttgggataaaaactgattcggtactgctggttgcgatcacactcggtgatttcgagaatgccgctggggccgatggtcttgcggatcggctcgcccagtgggccgccgttggggtcgacgcgttgcagtatcaccggcgtgttgccgatgggcacaaaccgtgtgctctggaacatgtgcaccagggtcaaggtgccgttggcctggcaggtggcgacggtgctgctgggataaagggagcgggtgatgggcgcaaccagcgccacttcatcgcccaccttgaacacctgctcgacctccagcgccgaaaagctccagaagctcgaagcccattggtcaaaggtgttcaggcaatcccgaaagtcgcgcaagacggtttcaacatcgaccgtctttgcatccattggggccagggccagccggccaatggccgggttcaagcgacagccccatgaacaggggtttcaacacaaaaaaacatctgcaatccctcgcactgtgtgatcaggcgaaggactttgcagaggttttcaagcgatatctgtagagcttatccggctgtggcgtgggatgtttcagtagtcttcgtccgctcccgcccaagcaccaggctgcacagcgccggcaggaataacagcgtcaacaccgtgcccaccagcacgccgccaatcagcacataggccaacgaagaccagaacaccgacagcgtcagcgggataaacgccagcgccgccgccagcgcggtcaagatcaccggccgtgcgcggcgcacggtggcttcgataatcgcctcgcgaatcgccatgccgtgttcctggttctggcgaatctggtcggtgaagatcagcgtgttgcgcatcaggatgccgccaatcccgatcaagccgagaatcgcgttgaacccgaacggctggttgaatagcagcaaggtcggcaccgcgccgatcaagcccagtggcgcggtggcgaagaccatgaacatcacgccgaacgagcgtacctggaacatgatcactgtgagcgtcagcagaatcatgatcgggaacagtgcggccagggcgacgttggccttggcgctttcttccaccgggccgccgatgtcgatctggtaaccggcaggcagtttggcgatcagcggttgcaggtctttgtacacggccatttccacgtcgggcggttgcacgccgtcgatgatgtcggcgcgcacttccacggtgctcgcgcggttgcggcgcttgaggatcggttcctccatgaccgcctggaaatgcccgacctgggccagtggcaccgaagtgccggcgctgttggtcagggtcatgttgttgaggttgccgaggttttcgcgctggctgccctgggcgcgggcgactacggacacggtgcggttgccttcgcgcacctcggtaatcgggttgccgctgagcaaggcattgagctgcgatttgacctcgttcggggtgaaacccaacaagcgcaggcggtcctgatccagcaccaggcgataaccgctggtgcgctcgccccaatcgaggaaggcgtccttggtcagccggttggcagccaccacgcgacgcacctgctcggacagcccgcgcagcacattcacattcggcccggacacgcgaaacaccaccggaaacggcacgggcggcccgaacaacagctgcgtgacccgcacccgcgccgccggaaattcaccggccgcaatgcgctcacgcatgtgcagtttcaacgcatcgcgggcatgcgagtccggggtttgcacgatcagcttggcaaacgccgggtcgggcaactcggggttcagcgacaggaaaaagcgtggcgcgccgccgcccacataggtgtcgaccatgctggtttgcggctcctgcagcagggctttttccagctgcgccgccaccgtctcggtgcttttgaacgcgctgccgggcggcatatacacctcaagaatcagctcggaacggtcggagttggggaagaactgcttcttgaccacgcccatgcccaagccgcacaccacaaaagcggcgatgaccaaaccggttaccagccaacgcctgcgcacgcaggcttcgactaaaccacgcagtttctggtagtaacgcccggcgtaaatggcatcgtggccacccggcacgggcttgatctgcggcagcagtttcacgccgaggtagggcgtaaacaccacggccaccagccacgacgaaatcagtgcaaagccaacgatccagaaaatattgccggcatattccccggcgcccgagcgcgcaaaacccaccggcagaaagccaatgatcgtcaccagcgtgccggtcagcatcggcgcggcggtggaactccaggcaaacgtggcggcgtgaatccgatcaaagccttcctcgagtttcaccaccatcatctcgatggcaatgatcgcgtcgtccaccagcaagcccagggaaataatcagcgcgccgagggtaatgcggtcgaattcacgcccggtcagcaacatgatcacaaacactacggataaggtcagaggcaccgctgcggccaccaccaagccgacgcgaaagcccagcgccaacaggctgatgatcatcactacggccagggcgacgaagaatttcagcatgaattcattcaccgccaggctgatgttcttggcctggtcggagaccttggcgaagttcacccccagcggcaggtcggcctggattctggcttcctgggccttgaggcttttgtccagttccaggccgttgaagtgcttctccatgatcacgccgagcatcaacgccgggtcgccctggtggcgaatgcggtagctgggtgggtcttcatagccgcggctgaccgtggccacatcggcaatgcgcagcacgcggccattgacttccagcggcacgttttcgatcagcgccaggctgtcgaacgccccgtcgatgcggatataggcgcgcgcgccggcagtttcgacgaagcccgacggcgccacggcgttctgcgcggcgagggcggcgaagatctggtccggcttgatgcccaacgttgccaggcgttcatacgagaactcgacgaagatccgctgggcctgctcaccgaggatgttgacctttttcacgccgggcaggttgagcaaaccctggcgcagctcttcggccatttgcacttgctggcggtgcggcaagtgctccgcttccagtgcgtaaagggcgaaatacacgtcggaatattcatcgttgaagaacggcccaatcacgcctttgggcagtttcgcggcttcatcgctgagctttttgcgggtctggtagaacaggtcctggatttcgctggggcgcgtggactctttgtaggtcatgcgcatcgacacaaaacccggctgggcgatggtctcgacgcggtcgtaatagtcgagttcctgcaggcgtttttccaggcggtcggcgacttgttcctgcatttcctcggcggtggcgccgggccaagcggcggtaatggtcatgaccttgacggtaaacgacgggtcttcagcgcgccccagcttgccgaacgagaaaatcccggcggcgagaatcgcaatgatcagaaacagcgtaacggcgcggtgtttcaccgccagttcggaaaggttaatgccgcgcatgctcagtggtcctgtttacggttgagggccagggcttgggcgggcagcaggcgcaccgcgtcgccgctgtgcagcaggtgggcgccgagggcgacgatggtctggccgggtgtgaggccgctgtcgatcagggcgtcttcctggccgaggctggcgacgttgaccggcgcgaagctgaccttgtcgtcatcaccgatcagccacacgccggtgctaagccctgcgtcttgcaaggcgccgatgggcacgcgggtttgctgggcttggccgttgccttgcaggcgcacggtgatggtcgaaccgagggcgaagcggtcgacggcgccgtgcaacacgtagcgcgcacggtaggtgcgggtggtcgggtcggcgctggcggacagctcgcgcagcgtggcggtcacggcctggtccggcgcgccgaaggggaaggccagggctttttgcgaggcttggtcgcgctggttttccggcaggttgacgatggcttcgcgggcgccgtcatgggccaggcgcgcgacgatttgcccttcggcgacgacttggccacggtccacgcgcacatcggtgatgatgccgtcgccgtcggccttgagcaccgagtaggtgcggcggttttcgatctggctggcatccgattgcgccgcagccaactcggcttcggcgacgcgcaggtctgtcgccgactggtcgaagatctgccgcgacaccgcgccagtgttggccaggcgctggtagcggttttcatcatcacggcgctggcgcagttgcgcctgggcggcgtttacgcggttcctggccgagcgcagggccagttcgaagtcgccgatgtccagcactaaaagggtgtcgccacgggaaacgtgctggccggggtcgaccttgcgttcgatgactttgccgctgacccgaaagcccaagtcgctttcggtgcgggccgccaccacgccggtataggcgctttgctgggtgccggccgcttccactttggcggccagaaccgggcgcggcgggggcacttcggcggcggtgtcggcctggctgttgcagccgctgaggatgatcaacagggccaggggcgtgagaagacgcggggcaagagggttcatggcgggctccaggagggtgaccattaggcaaaaaattatggacataattttttacgcatattatggtcgaaatataaattaatccagccccccggatattcctcatggcaaacgccccggccccctcgcgaagcgtgttgttgttactggtggccctcacggcactgggtgaagtgtcgacccagttgatcatccctggcctcggcgccatcgagcaggcgctggcggcgccagcaggctcggcgttgatggcgctgtcggcgtttgttgctgcattcggcctggggcagttgctgttcgggccactgtcggaccgtattggccgccgcccggtgctgatcggcggcctggtgttgtatgtgctggcgaccttggcgatgttgctggtcaatgacatcggccagttcatcgccgcccgcgtgctgcaaggcctcggcgcctgcgctgcgctggtgttggcgcgtactgtggtgcgcgatgtgtggaaggccgaagcggggccggcactggccctgaccatgatcggcatgctctacgccatcgtcgtcgcgccgatgattggcgggctgctgatcaagctgctgggctggcatgcgccgatcgtgctggcgctgatcattggcagtgtggtgctggtgttggcgctgctgttctttcgcgagagtaaccattacctcgaccccaaggccggccattggcgcacccttggcgggcagtacctggatctgctcaagggccgccaataccgcgcatacgccgtggccctggcgtgcacttatggcgcgatgttcgcggtgattgccgggtcatcggcggtgtttattaacctgctgggcttcagcagcctggagtacggcatcaattttggcgtgattgtgtcgatgctgatcgtcggttccacctacacccggcgcaacatcttgcgcctggggccgcagcggattgtggcgataggcgtgacgctggtggctatcggcgggatctcggcggtgctggtgtatgagctgttcggcctgtcggtgccgggcgtggatattccggtggcgctggtcaccctcggcggtggcctggtgttgcctggttcggtgacgggcggggtgatgcccaacgcgcaccgcgccggtttggcggcggggttgatgggtttttcgcagatgttcggtgccacgtgcagcggcctgttgctgagccatttacgcgatggcagcgccacgccgatgatcatcattcaggccagttttgcggtcacggcgtttgtcgcgttccacctgttgcgccaacgcccagtcaagggattgtcctatacgtaggacgatcagggccgcttttgccggctagtgctcaaaggcttacggacttatggtgtagccaacttggaggaacaccatgaaaaaaatcatcggcatctacaccagcccccgcgcccattgggtcggcgatggcttcccggtgcgcacgctgttttcctacgacgccatgggcaagcacatcagcccgttcctgttgctggaccacgccggccctgccgatttcacacccaccgaacaacgtcgcggtgtaggccagcacccgcatcgtggctttgaaaccgtgaccatcgtgtatgacggcgaagtcgagcaccgtgactccaccggcgccggtggcaccatcggccctggcgatgtgcaatggatgacggccgctaaaggcatcatccatgaagagtttcactcacaagcctttgcccgcagtggcggggcgctggagatggtgcagctgtgggtcaatctgccggccaaggacaaaatggccgacgccggttaccagaccattgtcgacggcgatattccagtgctgccgctggccaacgacgccgggcagttgcgcctgattgccggtgaattcgccggcactcaagggccggcgcgtaccttcacgccgattgatgtgtgggacttgcgcctgaacgcgggtaaagcgctgacgctggacctgcacgccgggcgcaataccgcgctggtgatcctgcgcggcacggtactggtcaatggcgaggaagtggcgcgccaagggcaactggcgttgttcgaacgtgacggcgagcacatcaccctggaggccaacgacgacgccaaggtgctgctgctcagcggtgaaccgattgatgaacctatcgtcggccatggcccgttcgtgatgaacaccgagcaggaaattcatcaggcgtttgctgattaccagtccggccgtttcggacaaatgcaggcctgactgcccaccgcaaaaccctgtgggagctggcttgctgtggcgagatggcttgctgtggcgagcgggcttgttgtggcgagcgggcttgccccgcgttgggcggcgaagccgccccaagaaatcaccgcgttctttcagtgagaactgggtgtcaggttctggggccgcttcgcgccccaacgcggggcaagcccgctcgccacagcaagctggcttgccacaaaagcccttcccaatacattttgtttgctgcgttcccgattcatgcgatcttctgagcattcgccctggagtcgcctggatgccctcatttatcgccgatcacccgatgttatgcgccgtggcgctgatctttatcgacatcgccgtgtggcgccttatttccgccaacctcgccaactggaaactggcggcgcgcctggcgatttttgccgtgtacagcgccgtgctgtttaacgacggcatgaaccccatgcaactcgcgccgtatgccgacaacaccgccttgcacctggcggccacggcgttgcagatcggttggtggctgttcgcagcgcgcaccctcacggtgttgctcggcacgctgatgatgcagcgcgtcggccacggcgggcggctgttgcaggatttgatgggcgcggtgattttcctcatcgcgatcatcgccgccatggcctacgtgctcgacttgccggtcaagggcgtgctcgccacctccggtgcggtggcgatcatcgtcggcctggcgttgcagagcaccttgagcgacgtgttttccgggatcgtcctcaacaccaccaagccgtatcagctggatgactggatctccatcgacggcaccgaaggccgcgtcaccgacatcgactggcgcgccacgcgcctgcaaacctcccagggcagcatggcggtgatccccaattccctggcagccaaggccaagatcatcaacttttcgcgcccggcggacatgtttggcctggcggtcagcctgcaagtcagcccgcatgcgcgcccgcaaaccgtgatcgaagcgctggagcgcgccatgcaaggttgccggccgctgctggccaagcctgcgccgagcgtggcgttcaagacgtccgccagcggcggcgtcgaatatgaaatcagcggctttgtgccagccatgaccctcaagcgcgaagtgcgcaaccagctttacgacctggcgttccggcatttgcaggcggcgggtgtgggcctgctgtccgccaccgaaggcaacgcaccggcggcgatgtccggcgcgcgggcgctgctggagcgttcgtcgattttctccacgctgcgccaggaagagaaagacaccttcagccagaacatgaccctgcacacctatcgccccggcgacatgattctgccggccggtgaggtcagcgatcatttgtttatcgtcgaatccggcgtggtctcggtgatgttgatcaagggtggccataagttcgaagcagggcgcatgggcccgggcgaggtcattggcgaggcgggcattctgtctgatgaggcaacgctggcggacttttccgccaagaccttttgcacgctgtaccgcatcgagaaggaatacctgaaaccctgcctggatgcgcggcatgacatcagcgaggcgatgaaggcgctgctggatttccgcgtgcacgcggcgcaggcaatgacccaggaaacgcccgtggtaccggtgaaaaaaggctttttacagtggttgcgcagtcgcgggctttaagccattcaaggcgccatcgcgacgcggtagcgctcatcgaaatcatccgccaactgttggttagacgcggtttccatccaccaactgttggaacagcggcgtcagcaagttgatcagcacctgcgggtcggtcttggccagcgccgacagttccagcatctggcgcatcacttggaagcctgacaccagcgccatcaccagcgctgcgcgctcttggtgatgcgcgccctgaagcgtggcggccagtgtggcctggtgacctgtttcgatttgctcgcggccaatcgccgccgcgcgcttgttcgacgccgcgtgcagcatgatcaggaaaccttccagcggcgtgctgccggcttcagtgatgctgaccagcgcggtggcaagcgtgcggccgaggttttctgcgctgaggctgccttgcgtcagggccaacgggctcgccaaggcctcggcgaccacttcggcaaacagctgctccttggaggcgaagtagcggttgaccagcatgaccgtcacccccgcgccggcggcgatttcacccagcccggtgccgtcgtagcctgatcgggcgaacaccttgcgcgcagacaacacaatggcgtcgcgggtgacggcggcatcgcgccggcgaggaatggggttgggcatgggcgtcctgacatggctggaaacggtgggcgcgcaaccggtgcgcgcgcacagggtacagggtctattcgctgtcgaggaagtccaacagtgcggcattgaacaatgccgggtcttgcaggaaggcgaagtggctggtgttcggcaaaatcagcagcccggcgcctggaaaatacgcatttttgtctatcaagctgctccccatgaaagaaaaaaatacagttatatcaatggaataaaagcgtctaagggctcagggtgattttcttcaataccgcggtcgttgcgccctttaccgtgatgccatcttcgcttggcataacaaaaaggaaccgtaatgagcttgatcatttccatggccgccttcgccctggccacctccatcacacctggcccggtgaatgtggtcgccctcagcgccggtgcgcgcttcgggtttgccgccagccagaaacacgtgttcggcgccgccgtgggcttcaccttgctgctggtgctgatcggcctgggcctgcatgaagtgctggtgcgctggccgatcctgactcagttgatccaatggggtggcgtggcctttttgctctacatggcctggaaactggcggtggacgatggccgcctggatgccgacggcaccgccaccgcgccgtcgatgctctacggcgcgatcatgcaatggctcaaccccaaggcctggctggcttgcgtggcgggcatgggcttgtttgtggccgatggcgacgccggccaagtgtggctgttcgcagcgctgtacctggtgatctgctacttgtcggtagcgtgctgggcgtacgccgggacttttttgcgccgctacctgagcaacccgcaaggcgtgcgtctgttcaaccgttcaatggccgcgttgctggtggccagtgtgggttatttgctgatggctttagcaagtcgcggtactgccccggcgtggcggcgaaatgctgtttgaacgcacgctggaaatgcgcctggtcggcaaaaccggcggccagggccacatcggcgatcagctcgccgttgcgcaattgggtgcgggcaaactggatgcgccggttgaccagaaaggcatgcggtgtgagcccgtaatactgcttgaacgcgcggatcaggtacgacggcgacagctcggccgccaggcaaatctcctccagcttcaccgcctcggtgcagtgcgcgcggatgtactcggcggcgcgctccagcttgtggttgacctcgcgcaccggcgtcagcgaagggttcaaacgctgctgcacttcggtgaaataactcaccagcgcgctctgcttttgcagcagctcggcgtgctcatccagcagtattgcgtacagctcgatcaagccgttgtacaacaccgtgtcgcgggtgtacggcgtgttgaagggtcgataaccctgatcggtgctgaagcccaattgatattgcaggtccgtcagccacggcgtgtcgaggtaaatcatgtgatacgaccagggctgatcgtagatagggttgcacgcatgcacatcgccggggttcatcaacaccaccgtgccggcgctgatctcaaaggtctgcgcgccgtagtggtaataactgcgcccggtggtgatcgcgccgatggaaaaatgctcgtgggcgtgacgcgtgtaggtgaccttgcgcccatcggcgatggtccgcgcctcgatgaacggcaggcgcgcgtcacgccagaagcgcggtgcagtagcggcggtcatgggcaggctcccttgcggcgatcaaatacgcaggagagcagccttatacaaaacccgccgttgttcaagcctcaacccagtatcaacgccacatcgcgcaggtactccgcccaagggtcgcggccgctggcggcggcttgcagggtgatcggcagccgggctttggtacgccatgccaggccgtcgtgcagcagatggtgctcgataatcaccctcgtcagagcctttgaacgtgctgaatcgaaggtgcgcggtacgcggcggcccagggcatcctgggcgggaatgtcagttgctgcaggcaggtcgcggttgagccggctgatcagcaggtcagtgctgggcgcggtggcagcgatctcggcaggtttggcgccgtgagcatacgccggccagtcgaaacgcatccacggttgcggggtggccgctttgacggcgtgcatgagctgcgcgtaatcaatgtcgcgccgaggccgaatcaacagttgccgagggaagaattcatagaggtgttcatcgctgtaataagcgacatacaccaggatacccagtcgaccaacctcggcgggcgtgtcggcccgtgagctggctcggctcaaggtgaaaaactgcacttcgccatattccagggcttcgcgccgtggcagcgtcaggtcagccaagccgcaccggatggactccccgtaagcggcctgcaactgctcaagcttctgattgaaggcgttggcgaatatgccgttgatctgcccgagcaaataaaagcgcttggccatttcccggtacttgatcgctttatttgaggagtgccagcggtttgaagtgacgtccaggctcgcggccatatgcaggtcgacgaacgagtatttggggccggtgtgcaccccttcgaactggccctcttcggaaaagggcgaatgctccggcagccacatcaataccggggtttccagcaaattgttgtcgggataaaccctgcgcaggtcctccagtgcggtctggcgcagcgtcacgatgggcttggcaaacgcttgcagggtcgacgtcaggcgggcacgttgaccgttcagggccattaatgcgcgggtaaattcgagtgcgtcatggcgtgtcttgggcgccagcacgccgttggccaccgcccagtccaggatcggccctttggcgtcgctgccggcgaggtaggctttccagctgttctccggcgtgaggtttgccaaggtcatggtgtgctcgtagttcaacaggcgcgaactgccgggaacgactttttccatccaggcgacacggtgacgcagcagaacccaggcctgtgagctcaagtagggggttatttcaggtaggtcgcgcaccagcaactgcgggcttttttcgcaaagcaccagatgcgcggccagggctgcgaccagtgggctaagcccttgcaggctgacttcaatctggtaacgcacaaacgacaccggctcgccccagcagtcggcatcgtgccagtcgaagtaattgaggcgtgtgggatgggcttgcggctggggatccaggctcaggatcagcgcggccaggatcagcccgttgcggctgccgtgccactgcaaggcggtcgccagtgcttcaccgagctgctgggccaagtgcgatgccagcaggcgcaccatcaaaaagtccgcttcggcgcgcacatccgccacggacttaccggccagcccgtcacgcccaaggtactcgaacagcggcaccgcctggccggccataaacgtggcgttgaccgtcagtatcggctggcgatgcagcgccagcagcttccacgccgagggctgtgcatcgtccagcggtttgagtgcgcgccaataatagtgttggccgggtggaaacggtgggctgagctccaggcgccgcagtgtctggcgagcctctggcagcgtgttgggcaggatgactttgtacatcttcaaggcctggccgaggctgatcaggccattggtgcgcagatcaccaccggtcttggccgccagtttcttgagggggtgcagcagcgtggccaaatcgggctcgttcacgacggcatccgtgagtagtttccaattgccgtccaggtcgattgcgccaacgctaccggatgcatccagcaaaacatggctgctcggcgcaatgcgttcgcgcctgcgaatggccaggaatgcggggtcgtcagtcagcacacgcaatcttgcacaggctttgtttacgagcgcctggagggtgtccgggtcgccgctgataaacatcccaaggccgtctggcccttgtaataccccaccgctgatcagcttggccagcgcactgcagagggtgaagtggtcatttaacaggcccacatattgaatagcgtaataaagctcagtaaaggcgcgcgctgagctgagcactaccggcaccgccggcgcgggccattgccgcaggcgttgcgccagggcggtggtcgctggcgcatccagcgggggggcgatggcgtaggcgtgcaatgcggcggcaatgctgaggctatggtccgggtagatatcaatgtgcagttgttcactcagcgctaccagcctgtgccagcgcgcatcccgtgtgccagccacctctggctccagctcgcccttatcgtcacgcccggcgacacagagccgttttcgttggtagtcaaagtacatggaacccgatgcttctgttgtcgaacacggatcgctttcagcgttaatcgcctgtaacagggccgccgcctccttgaggtgcctggccagtcgcgagtccgacgttaactgcaggcgtcggcgatagatatccaacccggagaggctgtcttgatcctcagccaaagggcgcagaacgtcggccaattgcaggtagtcgcgcgcctgttcgcgcaattcggcgtagagactcgatgtgctgcggccgctgctgtcaaacccggggaagccctgcaaggcacgtagctcttcgacgagggtcagtgcctggaggcgattggtgggcaccggcaagccatggaaagccagtgtcagattcaacggcaacgtcagtgctgttatgtctgttgccgcgtcaatgtagggccagcccagtgtcatcgggtcgaccacgtggcagatgtagatgatcgggttggcgagtgcccaccaggccgacgcatcggccaggttgagcaccttgagctggccgtgtgcacggacccgcaacgtgctgccctgtaggcgcagcgtgttcagatcaaagccctgcgcgcgcgcccaggcgataaaacccttgccgttgatggccttgatgaacaccttgctccactggcccagcagtgagtgctcggcaatcggcaccggccgcgaggggagcgacaatgcctggcccgctgcgggggaaagccggttgatcaattgctcgagcaacgcctggtcacctgcaacgcgcagggcctggcgctcattcaaataagtggccgatgggttgtaagtgacaggcagcgcggtatcgccggccgatgtgtccgacgtctgagcgagggcgcgaaagtcttccatgaggacggttccgggttgaggaaacccggatcatcccactgcgccaaaggggctcagtagcaggtgtttccgcaatggtcgtggcttgtatcaaccacggcccgacgtacaaccccgacgctcaaagttgcttgcacaaaaacacccggctactgcccgcaggcgtgcaaggtatctcgccaaaccgcagccacccatgcttctcgtaaaaccccggcgcctggaagctgatcgtgtacagcaccgcattcaggcaaccccggcgccgcgcctcgtcttcgaaagcctgcagcaactggcggcccaggcccgcgccgcgcagggtgtcgggcaagtggaacaggtcgagaaaggccatgcccaaggaagttttgccggtgatgccgccgaggatttgcccggtggcggggtctttgatcaataccgtgagcggccggcgatcattggcgccggtgacggcttcattgaaggcggcaaggccgctgccaagcaggtgctcggcgtcggggttggcgtggtcgctgatttcaatcaagggtgcgctcatcccggcctctcgataggtgcttgtggggcggtaggcagccgcgttgctgcgcgccataccgccggttgcgttacgccggcaggccggcctttgcctcgtaatctatggctttgcggtaaggatcgccaagtgctttgtattggccatcgccggcgttttaggcgggttgccaggtttgtgtggcggggtcgaatatttcggcttgattctcgaggccattatcttcggagttgggccttggtatgtcgctgtcgatatatatgtctttaggcggcatgaaacgtagctcacgcagtgagccgaagtgcgaataaagatcatcgctgtcgatccggggcaggtgtacatgctcgtaaatccgatcatgcggttttccacgtggcttgtccgccttaatgatgtcattaccgcgcccatcttcagcaggcgtgggtgttggtttttcattgccgttcgtgtgggctgcgtggacaaatttggccaaagatacagacatgccgactgaaaccatgatttcacctctctgatgttaaaaaaaagatcagccaacacttttgctgactgctcgaaacccaagttatcgagcagtggaagggcgttcaatgaggtgattgggagaggatgttacggagcaaaaccccacccgccacgctcacaatgtgagctgcgtggctgtaggccgaggctgaaaaccgcgtttgatgtttcacgtcaatcgccagaggttggccagtaagacaaggttcttacgtactgaaatacagttgccctttgagcgtcaggctatcgtcacaaatcccgacacacaaacgcgctgagcacttgaatcggttaaagcgccatcaccatctcatgccacgccatcccgccatgatccgacggcgaaggctgcacataggtgtagcccatgcgcgtgtacaacggcacgtgttgctccttgcacatcaaatgaatcgtctgcttgcccagcgtgcgcatgcgctgcacaaactcagtcatcaatagcttggaataacccttgccctgatgcgccgggtcgaccaccaccgacatgatcaccacattcggcgcctcggccgaatgccccaccaactccttgaacgcctcatccgacatcaccacctgatgggcgcagccacagttgataaagcccaccacctggccatccgcctccaaaatcaaaaagccctcggggtactgcgcgatgcgcgtggcgattttttccagggtcgcggcttcgtcgccttcgtaggcagtgatctcgatttcaaagcagcgcgcggcgtcggcgggcagggcgttacggaaggtgagggcgggcatgggcgtttcctggtgcgttaaacgaagggccacatgataggcatcggtagagagcaccgccagcggcttccatagttggaacggcacgctttatccatcatgagaagggctaacgatttagtgaaatcaattcattttctctcaagcaatgtcgctgcctacaatacgtcttaattatagttcttataaatatcatcgagatcaaggcgtggcgtcgggctttatctcaggaatcagagtgtcagattaaaatgaataacgaatttgcatttgcgatcaagcgcattcgtttcgatgaggattatcacccctccgaaaatacgcgcattaccaccaactttgccaatttggcccgcggcaaaagtcgccagcagaacctgcgcaataccttaaagatgatcgacaatcgcttcaatgccctggcgcattgggataaccccaaaggcgatcgttatgctgtcgagcttgaaattatttccgtcgagatgaaaattgatgctgataacaagggtaatgccatccctttaatcgaaatactcaaaaccaatatcgttgatcaaaaaaccaacgagcgcattgacggtattgtcggcaataatttttcttcctacgtgcgggattatgacttcagtgtgctgttgctgggccacaacaaaggccgccccgaattcagcacacccgacaattttggcgaactgcacgcaaagctgttcaagtgcttcgtgaattcaagcacttacaaagccaatttcagtaagccgccggtgatatgcctcagcgtgtcgagcagcaaggtctaccatcgcaccgaaaaccagcaccctgttctgggcgttgagtaccagcaagacgaatactcgctgacggatgaatacttcaacaagatgggcctgaaagtgcgctatttcatgccgcccaacagcgttgcgccgttggcattctatttttccggtgatttgctcggtgattacacaaaccttgagctgatcagcaccatcagcaccatggacactttccagaagatctaccgccctgagatctataacgcgaactccgcagccggtaaatcctatcagcccagcttgcagcaccaggactattcattaacgcgcattgtttatgaccgagaagaacgtaaccgcctggcgatcgagcaggggcagtttgtagagcaaaactttatcaaaccttaccaggctgttcttgaacagtggtccgctcattacgcgctttgacgcatcaaaaaatacaaggtcatctgttatgaaaaaactactacccacgtccactgctggcagcttgcctaaacccgcctggcttgcgcagcctgaaacactctggtcaccgtggaaactgcaagacgaagaattgatagagggcaaacaggacgcgctgcgtttggctttgcaagaacaacaacacgccggcattgatatcgtcagtgatggcgagcaaacgcgtcagcactttgtcaccacctttatcgaacacctcagcggcgtggatttcgagaagcgcgagaccgtcagaattcgtgatcgctacgatgcgagcgtgccgaccgtcgtcggttcggtgagtcgccaaaagcccgtgtttgtagaagacgccaagttcttgcgtcagcaaaccgatcaaccgatcaagtgggcgctgccaggcccaatgaccatgatcgacacgctttacgacgcccattacaaaagtcgcgaaaaactcgcctgggaattcgccaagattctcaaccaggaagcccgcgaactcgaagcggcaggcgtggacatcatccagtttgacgagcccgcctttaacgtcttctttgatgaagtgaacgagtggggcgtcgccaccctggaaagggccatcgaaggcctcaaatgtgaaaccgctgtgcacatttgctatggctacggcatcaaagccaataccgactggaaaaagaccctgggctccgaatggcggcaatacgaagaagccttccccaaactgcaaaaatccagcatcgacatcgtctcgctggaatgccacaactcccacgtgccgatggacctgattgaactcatccgcggtaaaaaagtgatggtcggcgccatcgacgtggcctccaacaccattgaaacccccgaagaagtcgccaacaccctgcgcaaggcactgcagtttgtagacgccgacaaactctacccctgcaccaactgcggcatggcgccgttatcccgtggcgtcgccagaggcaaactgagcgcgttaagtgccggcgcaggcatcgtccgccgcgaactcttgaaccagcgctgacccatagtcgaaagagctgcgcggggagggtgaggcggtggattgaaacatcaccgcttcaagccttcgacctgcacccaatagccaggacttaccatgtcacttcccagtactgccatcgagcccctgcactttcgcgaagcgctcgggcactacgcctccggcatcaccgtgatcacctcgcacctggagggcgaaccgatcggcttcacctgccagtcgttctacagcgtctccatgagcccgccactggtgtcattcagcgtcatgtccacctcagccagctaccccaaaatccgccaggccgggcgctttgtcgtcaacatcctctccggtgaacaagtcaaaatctccaaccaattcgcccgccgaggcaccgacaaatggcacggcgtcgactggcaaccatcgccactcggcaaccccatcatcgccggcagcctgcactggctcgactgcgaaatccacgccgaacacgccgcaggtgaccacctgatcgtcattggcgaagtcaaagcgctaagcctgcaagacacggcggctacgaagccgttgctgtacttcaaagggcaatattgcaacatcgccgccgatagcgtgggttgagcggtccagcaaggcccagagactagaaaacccgccaaagcgggtttcctcacagctcacatcacatcaactcacagcagccacatcaaacccccgccgctccatcaccgtaaacacatccgccacatcctggaccatgatccgagcggtattggcgacggtattgatgtcgtgctcggcgtagtcggatacgttggaacaagccatcaagtgcaggtaggcgagggcagcgttcaggcgctcgctggcgcaggcgtgaagctcgcggagcggggcgtcgctgtcgatgaggaggacggggtagtcggttgcggtttgggacatgggggtgaagcggcggggtgggtgttgagttttcaaggtggaaatccctaagaaagaaaaagtgttgaatatccgtagaacaggcattaccgggaatcggttctgtcgggtttaacgggttttgggtaattcttttttagggctgcgaatcccatcgccggtcaagctggcgacggggtggactataaagggctgattttggtgaggcaatggaggggtatgtggtcgtaaggctggtttgtggaagcggtgactgttttagatgtggggttaagcgctctataccctgtgtttaaaggccattgaggttcatgagggagttggcatcattgatatgtctttcgagcctgtgagatttttctgactggtttctaggagagtttggtttgattcacagacctgctcaaccgtttgcgttcggcctaatcagttctttacatcggtttttaccagctggctaggtacatgacgggcggaaagttgccgtttgctgcctagtgaaaggtctgtcgggagccggtaggcgtcggacgtgagcggcagcaaacggcccagagtgtgtaaaaacgcttcaccaaaattgaagtatgcgcatctatgttaaatctgaaatttatcggcacgtcagcagatgtggatttcgcgtagaaacgcgatttccagtccgattttgagtacctgtcacgctcaaaaacgtttttacacagcctcggccaatagctgccattcgtgaccgccagcagtcgatcagatacagatcttggaagttcctgaaaatcgagtgcgaatcaaatccactatatattcatccgcaacatgagttcaggataaattgtttaatcacgcgaaaacaaatcgtcaattggatcgatagcaataaatgagcgctcggaccaactcatacgttgatttctataatactcataatctggctcatgctctgtgtcattaaaatatttatcataaaatctagccacatcaaccaagtctacaacgctatcagccacaccggatgaatcattagctcccaactcaacagctttttcatccattagttcgataaattttcggcgcgccgctgattgcgaaccaccatcggaaaatacctctgcatctggaaactcatcttcaactgaagtgattagataattagtgattactaggtcataggcatcgtaaagtgactgatgatttacaacagcaaagcatttgacagtctgagctaagatcagtaattcgtcataatttgggtcgttgacgaatgctccagccaagaatgcttccacagtcattttatcaacacagccactgcgcagcgcccataaaagtactcgtgctgacgccaaaaaggatcgaccacattgctcaccaccaataaaatttatcgctttcaagagaccttgatctgataagttaaattttttaccaagttcagagcgcgcaatacatagttgagctacgaattcggcatcagccccaagaaaattaatttctaagaccgatgaaaaaatatgacttattacttcgatcgccacgtcagcaatgattatcttgttatccagcatgtccttcaatgtcttcagtgaagaatgtgtcttcaggctaccaaagcactgccgcaaaacaggggtgttacgggcatatctgttgagtacaaagtcacctaaagacggattaaataagcgaacgaaaggctgattttcgcctactactaatctcgtgagcatcgaaccagataggtgacggaggttgagtaaaaaatcttttttcccagtaagactagcggctcctggattctctagataccgcgcgaatgcctctgaaagctcaggctcagtaatcaggcgcccgttcatagcgaccagcaaaaccaaggcacgaccacaatcatccagttgcgcttgaaatggatgatcccagacctgagacggatcatctagcaaaccagttatatgagaccagtaagactctgatgggacatcctccaatcgctgagcatcggtaataaatcgtattagccgaggattaaaatttctatgatcaataatatctcgataacgtttatgtgagtacaactgctcaacgtattcagcacctatttcagaatgccatatatggttgtaaagaatcttggctttatcgattttcgccaatgactcaagtgtgatttcaaactcttttcgatctatatttgagttgtgaaaaacatcgtttaaaatttttccttgattgagaatcgtggttcgagatgtcaatacaaatcgcttttggggatttttgactatgcgcctaataaaacccacaatcttggcgccctcatgaccagaaagcgcttccaagtagtggcggcccaaaaagtcatcaaaatagaagatttgctttgagtcaggatcgaggacactctcagcctctttaatatcatcagagatgaccgaaagctcaaagccgtttacgacgtactgtaagattaattgcccggctaaagttgtcttaccaatgccagctggacccgtgataataacaacgttcgtagactccagcttatcaacggcttgattatgattaactgtcgccacatatagcttagaggtctcaactatctcgccaagctcaaactgactcctgtcatgcatgggcttattaagcatatatgcaaggacgttcgaactagcaatccagagcttatagtgccgtctttcaatatccggatgcttggcgagtatatcactcaaatcctgtcggcccagtatatctgctggagacaaaacaaatggatacagcttttgcattaaaattttcttattattgagtgaaagcgagtgagacaaggccaaaatatatcgacttggcgataatttctgaactttgagactttcagaatccgcgatagatttaacgagcttttctaacggcgtcgaaatccaatgcttgcactggagaatccactcatccccctcggacctaaaaaaacgtccatccactccagcgtcacgtccgggcttgaatctttcgaatctgaccccttccctcgcgctcagcaggtcagcgcaaaagacttcgaactctttgtcgtttagctgcgaaaaatcgtaatcgctcacaaaagcctcgcttagaagtggaccacatgccaataaacggctcaggataagagtgtagttgttggaagccgcacatgagccaccgcattgatagcagcgatgatgcatgctttctgtggctgctcagcccgttgtcgaagtacggatgatctacctagccacttctggcggatagctgtctgctataaagggcggcaagtgccttaagtgtttaagagcgtcgttgctgcttcgattctcaactggaaagcttccaacgccgctaatttggcatctaaatgccattactgatatcgtccgacgctgatcaaggaggatttcgcagtggccacaaattacctcaagtatttccccaagccggtcctagacgacctggtgaacggcaggtggctgccaattatcggcgccggaatgtccctcaatgcacatgtcacgtcgggtcaaagacctccgctttggggggagctaggcaagcttctggaggatgacttgattgatttcagctccagtggggccctagacgcaatctcagcatacgagcatgaacttggccgtgcgaggttaatggacaagctcacacaagtgctgctaatccacgaggcgcaaccagggaaagcacacaagagcttttgctccattccattcgatatcgtttgcacaacgaacttcgactttctgctggagcaggaataccgcctagggcccaataccgtctaccccatccttgaggaggaacagctgtcgttgaattcctctaaggcgggggtgaacttgctgaaactgcatggcgatcttcaccaccctagaaggatggtggttacagaggccgattacgacggtttcctagcgaactacccgctctttgcaacctatcttgcgaaccttttgatcaccaagacagcggtactggttggatatagccttgacgatccagattttcgacaaatctggcacgtggtaacacagcgtttagggcgtaccagacgatttgcctacaccatcgttgttggcgcgaatcaatccgatgtctcccgattcgagcgtcgtggggtaaaggtgataaacctgccaggtacccgagacaaatacggggcgatccttgccgccgcattcgatgagcttcgggagcttttgagagacaaagccttcacggttatgaaagcgaccgaggagagggcaatgcaggagctgtcgctgccgaggtcagcgtcctcacggctttgcttcttttcgttaccgttagatgttttaccgttctataaagatcaagtcttccctgctcttgaggatatcaacctcgtcccgataacggcggatggggtgatttccccaggtgatatggtcatcgccaagcttgatgcgctgattgatagatcaattgccatggtcattgatctatcgtctaactggacaatagttgagctaaaaatggcgcttaaccgtgctgcgtctaggaggcgtgagggacggccgctcacgctgatagtggtcatgagagaagggcagcaattacccacggcattagaaggggtgacggcgatctaccgccccgatcttttaacctctcaatcagaggattttgctcgcaacctagtcgtaaccctcgagcgggcgcttccctccgacggtgattcccagttagacgaggcgcgccggctttttagagttaaggcataccgcgcagctatagtttccgccatcacgtaccttgaaggcgagctgcgaaaagttatgcggatcggagatgaggaaactgctttgaagtcccacctgtctctgattgggatgataaaaagtgcagttaatcgcggtctgatcagtgtagaaacgctaccaaatcttcaagactggattcagcttaggaacggcattgtccattcgaaggaggagctagaagttaccagaggaatggcgaaaacgattgttgacggcgtaatcagaatcgtaagcgagtttcataggtcatagagtaggtcagattcaatcgagaaaagcgcatgcttaggccatccaggtggtggcttcggtgggcacagtaatcggaacgctgaaagccctcgtctggacaagagtagccagcgtaataagaaatgttatacgcaaaaactgcttggatgattatgcactactttgtatttacttaaatcaaaacacaataacaaatcgagattatatgcaaaaaatctaccattatataagctttgaaacctttaaaaaaataattgaattcgggacgatcagattaaattcgctagctaatgttgacgatgcggaagagggctttttgcttgataccacctcgcaggcaccgtatacatttgcgagctgttggaccagagacgctaaagagagcgtaccgttatggacaatgtatgttgactcccctttcgccgtaagaataggagtttctacagatattttaactccaaagttttccaataagtactttatctccaaccaaaaaaatgacgatgcttatgtttttttgatgcgccgcggcggctcgagaggtatggagtttctgtcagacatcatctacaaagataagcctaggcttcgaatgcttaagaattttcgcggaatatttgatgaagattatatatctagttacggcttaactaaaagcctgcactgggcgtttcagcaagaaataagatttattgttcaagctgtacctaaatcacaagtcataaagcgacgtgatgcattgctctatacttgttgtcaagaagttatggataatgatcgccctacagatataaagtttattgatatggaatatgatttttccaaaatgctaactgccgaaataatgctgggcccatctacacttgaagaggatgcaaaagagattaaaaggtttatagacgaaaaaatgccaaatttcaccggaaaagtctcaagaagcgaagtttttatcaggtgtaagtagtgagggaaagtatgataatgctcactataccgagcgaataaatcaaaaaatccttataaaattaatcgaacttcgagcgaatacgtgaatgagtaagtttcgcaacttaaacatcggcgttgttgttaacggtgaaaccataaatattgacggtgaaaaaaggactgagtttgttcagctgtacggacttgacgaactcatacctaaccgttactcagaaattttcgttgtcgatttaatcatgaatcttgagctaagtggagtcgatccaacgcgcatcattgatgaagtcaagcgtcttgagacgttaagcagtgatggctatacaaaagaagccactcaatttaaacgtgcgccactacacccgctgtggcatcagcattatttttctactcactttttagtgcacaatattcaaaatgaaattaagaaaagcttcaacactatatgggatgaatcgatgggagaaagaaattccattatagagcagaaacatttggataaacttgtgcacaacttggttgagggcacaatcgaaacacgtagcaatgaaaaacgaataacgggtgaatggttagttttttctaaggagacagtagggaatatctatctgtgtatggcaacgcacacgactggagacgctaatatctacaataggctagaatattgctgtgaacaccagtttccactattagagccatttgcctctaatcgtagagggtcataaataacatataccaaaattatttactaatagataaagacggccgttaaacttggttgctggaaccaatatcccgtcatacggatgcagctgttttaaccccgaatgcggtagctgctcaagggcgcgaaagtacaaaaaacagaattatttaccgttgcctggcagttactggtcgttcctatgctttatcgagaagtaatgaacggccaagagccgacgctcgactcgcccgcggcgaccagaagctgaaggtcgttttgattgggcaagccggtcgcgttcctatcgacccaaaacggacagctctgaggggcggctcttagccgattctgttgaaaaagtagctcccctgtctggcctgcggcaaaatctctgcattggccagcagggaagcacgcagcatgatgggacagttatcgagtgggcaggagcggctgttttactcgttcaaccttgaagatcacatcccagccaatcaccttctgcgcagcattgatcagtgcctcgatctgagcgacttgcgccattaccttgccgacttttacagcccgattgggcgtccgtcgattgatcccgaactgatgattcgcatgctgatcgtgggttattgctacggcattcgctcagagcggcggttgtgcgaagaggcccatttgaacctggcatatcgctggttctgccggttgagtcttgaagatgaagtccctaatcactcaaccttttccaagaatcgacacggacgtttccgggacagcgagctgtttcgctggttgttcaatgaagtgctgcgtcgctgcatggacgccggcctggtcaagggcgaaggctttgccgtggacgccagcattatcaaggccgatgccagccggcagcgcggtgtaccgggtgatgaacaggtcaactggagcgatccagccctgagcactcgcgctgtgcgcgagtaccttgaagccctcgatgaagagactctggccgaaacgctaccgaagcgcctatcgctgactgatcctcaagcccgctggaccgcagctccaggtggcccagcgttctacgcttactccacgaattacctgatcgataccgagcacggcgtgatcatggatgtggaacccacaccggctcatcgaactgcagaagtcgagagcaccaagacgatgatcgatcgggtcgaagcgcagttcgacatcaagcctgaacggctgattggcgacaccgcttacggtaccgcgccgatgctggcctggatggtggagcaaaagaacatcgagccacatgtgccggtgtgggacaaaaccgaacgcaagaacgacagtttttcgagcaacgatttccgctggaatgaagagactgagggatactgctgcccggctggcaatgcattacgtagcgaatggcgagccttcaagaacgagcgttcgcacgtcaccaaagccaacaccatcatcttccgatccaggcagaccgactgcgttgcctgtccgatgaaagccaagtgctgcccgaacactgcgttccgcaagatcgcccgcagcgtccatgaagccgcgcgcgatgtggctcggcgaatcgcagcgacacctgcgtacgtgcgctctcgccacgaacgtaagaaggtcgaaatgttgtttgcccacctcaagcgcatcctgaaattggatcgcctgcggctacgtggcatgagtggcgcgacggatgaattcacgctggccgctgcggtgcagaacctgagacggctggctaaatttacatctcaagggccacctgccacgggataggtgcgcctgcactcagcaaaaacctcaaattaacccactaactgagcagcaacgatcaacgaagggccgagaaaccactcaatgtggtaagtcggttcttaggcgatggtcgtgcctgagttcaggcgagcggtaaatccgactttttcaacagaattggccaaaagctgacactccgtttgtctgtgaaactaacggcgatccaaaggagtattgactaaggtgtcattgggccagtacaaaggagtggcagtcagttctttttataaagttcaacagtgaaaaggaaatcaaaatggccgacgttcaagtaacgtgcattaacaaacccaatgtaaatagttcccatgaacacatcactcatctaggcaatccagcaaatcaatggcgctggactcgcgagcaagtcattgccagtattgatgctggtacaaatactttctatgtgatcgatccggttagtcgtgcccgtgcagatataggtgtcgtacgcgaatctggtcgtgctccgtatttgcgtacttatgcagataggcagtggaataataacttgttgtcgctcaatcagtgccccatctgattgagcactgagttggcaatgttttttagatatatttgattgactgcttttggccgaaagcctccgatcgccaacggtcgatatcggccagaggcggtcatttacacaggtggcgaacaaaccgtgcacgatgtattctctcttctccggatgagcgttggcgtcgataaagttgccatctccctaactaattataacaaggaagtaaaatgagtaatcttgtttacgagaaacacctaaatacagcagaggattttatggattttttgctgccatggtctaagcaacacatagatattgatttaaaaaactatatttttcgagggcagcgcaatgccgatcatgggttgatcccggttgcgctgagagaaaatgcgcgggaagagatgcgaaaaaaaatgaatatttttttggaaactcatcccgagtacacggactcaccttgcatattggcactagttgaatatcaattaatcagagatttttacagacaatccgatatgcacggtctgccagtgccatcttcaaaaactttgcgcagccttcattacaagaagacggagtttaatactatggcaaactggatcgaagatgcggtttggcttcctgatgacatgttggaagctgctgcgctggcacagcattacggtataccaactcgcttgcttgattggagttataatccatttgtagccgctttttttgcgactctccccaaactggaatctccggactccggattcaagcgtgatgggagtttctgtatctgggggctcagtacggaagcagttggaacattgcatcaggtttatgaggctgcaaaattacagccaatgacagtacctttccccgagtttccgttgaaactcgtgacaccgccatacgacggaaatccaaacttagctgcacaacaaggattatttactcattgggcgagccagccaggcagtatcaagtcgctgatcagcgacttgccatatagtgcaagccgagccgatcaaggtttggaaaaacagattgaagaattttttacaacgctacagctttccggaattactaatatgctcctcaaaattactttgtcaaacgccgaggctgagaaggtcgctcgctatcttagagaccaaggttacggcccatcaagactctttccgggttatgacggggtaacacatgaaataaatgaacgaatatattttacccgtaaaagaaaggatgggtgaatcagccggcatgcctccaacatttataattacgcgccatcgaactctcgcgagcagactttggatattgtagtaattcgtatgcagcagattggttcgataccgtccgctatggggggagattaaccgctcgcgaccgacaactctcgacctattgcaaccttgaggtgccgacagaaaacggcctgatgcggacatcaacgaaataattcgtttgcccaagatcactatagatagtttgctaagaactttgcagggttggagcctgggtgctcaatagtcaagacgtatcgagcctaacgtccacccgaacagtgcaactgaatcagcagttttctagaagcgcgtagaactaccaaaaaagtctaacaagcttagggtttggtttttttttccgtgtgatgtcggtgcagtaaggcttgagccttgagaccactaatctccctcgtaagcatatcgattttctcgtccctaattttgatcgaggtattttgagattcagttttttgatgtaaaagttttagttctttgttgaaatcttgccgttcttttattgagtcggaaagtgatgcatttagcttttctataagctgatactgtgctagctcttcaggggggcgcaagtcaggtgaacctttcgatgagtaaaattgcgccataatcagcatcacgatagttacaaaatatagtattgaaagccactgcgcgccccagttagcaaaatatctccttaaagtgactttatatattgcctgttttctggcaggatttaacttgcttttgcgtgccttcatacgccatgcgaatcgtatttctcgcatgagcgacccagctcttttttttccgtacataagtttgttaattgatttttgagcataaagtaaattcataatcagcagcaatacaccaccaatcaaaagaatcactactgggatatatgatgtcaagggttggctctgcgcctcaacccgcgctcgtaacagtcctgcaccaagaatcattgctccggctatcccgacattccgtacatggtcaaatatggctttggggtcctcagataagtaggctactatcgccccccaagtcgtcctgacttccttcaatgacagcataaaatgtgtgctcatctggataggtgaatatttccctatagggaaatgcatgataatggaatatgtacaagttatgcaatgcaagcaggctgctcgtggccgatgtagtgcttccgtacagcctcagatgataaataaggtggaaaaatttggctctattagaatctgtccgttttgctcttcgaaggtatcctttagacacattcgctatctttttgaatatgttggtcagaaaagctatcctactggagtaaatagcggatgattgatggctgggtcagcctactaataggctgtgatcaagctcacatcattgtgcgcactgtctgcttctggctgttttctgcctagcgccaggatcagaaatcaacccgcagaggacaggcacttccgatggccgtggtagttgggcgcgccgaaaatagattgtctcggaaaggctaaaaatttatttttcatcggattgagagcccaaccgcccaccaccatagtaattcaagaactcccacataaccggcgtaaccacctcctgcgaagcaatctgccaaaaccttctctcccccaaaaccggctccaaccgcttgataagttcctgcgccgtattgtgctggcccgtacgcaaccagtgcctgaacatatcctcattttcctgcctcggtagctgcgcagcctggagcagtttgagtgcgtatcggtagttcagcggccacagctgcctcaaaaaatcgagtctctcagcaatgggaagccccactaaccactgcctcacatccttatccgcctgagcagtgccagatcgggatgccacctgttccggtgtgaaacgaatgtcgtccatggtgtgcgaggccgaagagatctaaggaagatctcattctgtcccaagcaaggaataacgggcagctttattttgtctctcacacggctctcaattcgtagcccacccaaaaacgaaaaaaccacccacaccccagccgcaaagccacgatatggatggtccctttaatcactctcaaaccactccattcagctacctcaaaccccgctcaccaacttccccccatccatcctgcgcttatacgaactgtcccgactcgccacccattggccaaaagcggttgcttgcaagcatgcttcaccagggcgtcaaagacctaacccgaacgatatggacagacgccattttaagtgaagttacttcgaagccttacgaggatcatcatggctatcaacatactcaaggcctagcggacccgttccgtaaacctgtgaaatgtactcgcctgatttagcccagtgaaagtgtggcgtattggccggaagtatcactacgctgcctggcccataagccaccagtttggccggatcgaaaacggtaccgaagccaatgtagaaaacaccagacatgacggtgtagatacgatcctcaggatgggtatggggcattaattttgtgccattcggcactttgactctcaccacatagggtgctggcttactcgggtcgccggccaacactgccagcttcacttccttcgggaacgctggaaagctgcgccactccacgtcttcatcgtgcacagcaccgactttatcgagtggcattggttgtgcctgggcgaacggcattgctgcgctggcgacaagaagtgcagccagacccgcagtgttcataatgttccgaatcatgaaaggcacctaaattacgtagtaaacacattgagatcgtcgcctgtgccgccagtacatccggcgggcaaaatcgtggcgatcgcgtgcggcttactgtatttgtcaccggcggcaatgagaatggcgttgtcgcgcattacagttgatacgcaatgtaatcaatgcgcggtcacatgccggttgcgaaggctgccctccatcatcacgctcaccagaggcagaccgctcaccctataaaaataataggggcatctctcaggggcagagcacatctagatatgggtggtcttaccccaataatttttccttcaatcaacgcttcaacgcatcacattgcgcacgcaggtcacggtcggagatcgagccgcagctgccgttgttggttttagcgttacacaaatagcgctgatcactgtcgtcgatgctattgcagctgcctccattggtttcagcattgcaggtatagcgcaggtcacggtcggagatggagttgcagcttccatgattggtcttggcattgcagtaataacgctggtcactgtcgctgatgctattgcaactgctcccatttgtttccgcgttgcaggtgtagcgcaggtcgctgtcggagatagagttgcagctaccatggccttccttggctttgcagtaagcgcgttggttggaatcgccaatgctgtcgcagccggcaaaggcgttgccgctaatcaacaacaacagcacaaaaatcactctcatcactttcttccttggtttaccgggacgctattcggtatttttggtccggctggccatgctgcacaacggcacgtcaaattgctatcaccttcaggaaaagctcgcgtgtttccagccgtcttatttacgcctccagcgccgagccgtcgcgaaacgcgcgagttctgtcatggggcaataaaccctatcgagtctgattggtgcgaaagcttcgcaggttgctaacagccactcactgacgttcgtatttggccgaaagcaaacggttcgcccacccaaaaacgaaaaaaccacccacaccccagccgcaaagccacgatatggatggtctcttcaatcactctcaaaccactacattcagccacctcaaaccccgtttttcaatgcccgcttttggcggttagctacacctcgtgtaaggcagctttgggtcgtaagccgcaccatgggttcttgctagcggctagagcgcagtcatgacttatttaacacttcataaccactcctggagaactgcaccatcttgccgatctcggtcttagggtcatccaagagtccgcctagccttccagactctggtcgtctgctttggccccttcgcaaactagggtcgttatcaatgaaatgagccacatgcgccaagcggtacatggcatcggcacgagattcagggtctggattgtttttggtgaagtcacctacgcgccttatcagggcgtcgcgaatcctcagcggatatccttcctgcgggttacggtccattatttcctgcataattcctgcgttcagaatagggttgacgtcgaagatatcctcggctgaacgttgatcgcctgcgggacgcgtttcctcgcgtgaaggcggactcgacacattggcctcaccgcgtacggcaggttccgtcccaagaggagcgttttttttctgagccgcgtcattggcggcatccatcaacgcgggataaccgccccgagcaaacgccaataccagtcgcgcttcggagccttcaaaagaaaaatactcgctctgcgggtctagaagcataggaacaatgtgctgttcgccgtcgattttgccgtttccggccgttgaatcggcgccaccctgcctgtcgatgaagcgaagtaccgcctcagctttcagtgcattagccttttgaacgtccgggggcaggcggtagtcatcccactcacccgtgtgcgttttaaaggctttcaggtcttcagggttcaatatgtagtcaagattcttgaacaacgggcccgccgtaatttccgataccgaacgttggtcaaccctctcgccttgaacagaaattggttgctttgggcctggggcgactttactaagtgtacgttctgtaacgggagggttttgaattaggctggatatctgagtactcacagaaggaatcgtcatatttacctgcatctataaaggttggataggcaaccacacataggcgtggccccactctaattggtcagggcgcaggaattggttccgtctcagtggatggcgcttctgtactttccagagaaagcttgctgtaggtaagatcgggagcgccttgggagaaggcactgggaaatttctctatagaattgcgggggattaaatggtctttgaatatatcggcatgtgcgctggggtcgccatgatattaagcttcccgctttttttgtgccatgttcaaaaagctcgacgcagcagagcgctatgtggagggcagcgcttacatcgctgtgcacagggatattatttgtcatgctccatttgatggaaggcctcagcgcctggtgctatcggtatcatcattcttattccaaaaatacttcaatggaggcgtttagtacgggtcgaggacgttgaaaaaatcccccgacatctcaagtactggatggtcataccgacactgattgctttcacatccgtcaccgtcatgtgtatcagttggctcttgatagaaaactaaaccgcccgccccaaactgaaaaaccacccaaaccccggccgcaaaaccaggatatgggtggctcaaaacatcacgatcagatcactacaggcagtcggctcaaaccccactcaccaacttccccccctccatcctgcgcttatacgcactgtcccgactcgctaaccaaaaatacaacggcgatgtcaccaccaaccccaccacccaggacaagtccgcgccgttaatgtgttccgaaatcggccccacatacagaggcgtgttcataaacggaatctgcaccgcaatccctaccgcgtacgccagcagcgcctgtgggttgtacttgccgtagatgccgccatccacgcggaagatcgaggcgatgtcgtatttgcctttgtggatcgcgtagaagtcgatcaggttgatcgccgtccacggcaccagcacgacgagcaacaccagcaccatgtcgacgaagtggccgatgaagtctttggaggcgaacacggctgcgatggcgcaggcggcgagtacgaggatggagatcactgcgcggcttttggcggtggggatccagcggtaggcgaaggtctgcaccagggtgatgatcgacagtaccgcgccgtagaggttgagggcgttgtggctgatcacgctgagcaaaaacagcacgagcatcagcgggccgatggcgccggtggcgagtttgacggcgtccatggtgtccatgccgacgggggtggcgagcacggcgacggcgccgaagatgaaggccaggctggagccgagggcggagcccaggtaggtggtccagaaggtggaggcgacgggcacgtcggccggcaggtagcgggagtagtccgacacgtagggcgcgaaggcgatctgccagagcgcggcgagggacacggtggcgagccagccggaaatgttgaagctgccgcgggtcagaaagtcggtggtttgcacgtgggtgaagatgtagccgaagcccagcacgatgccggcgccgagcacccaggtgccgatgcggttgagcacgtggatgaagcggtagccgatgatgccgatgatgcccgacccgatggcgccgatgacgatgccgacgggcacgggcacgctgtcgaccacgccgtgcagggatttacccgccagcacgatgttggaggcgaagaagccgatgtacatgacgccggcgatgaccaccaccagcagggcgccgagtgagccgaactgcgcgcggctctggatcatttgcgggatgcccatttgcgggccttgggccgagtgcagcgccatcagcacgccgccgaccaggtggccgacgaggatggcgacgatgccccagaccaggttcaggtggaacagttgcacacccagcgcaccggtgacgatcggcagcggcgcgatgttgccgccgaaccacagggtgaacaggtctcttacctttccatggcgatcttccgggggcacgtatccaatcgtgtgtttttcgataagcggggcggaggatgttgcagtggtaaccatgacgagctccaaggcaaggtgagtacgttgacgtacttcgctgtgcgacgcgtgtgcggcgctttgttgttggagtgatcatctgcaatgggcgcggggaggtaaattagtaagtttgttgctatagaccttaaaaaaagtatctcgccggattttttgctccggtatgttgcaggtgcttgaatcagtgtgaaaaagccgatttttacgcacgtgtctggggcgaagtcccccgttttcggaggtcccgatggccgcgtataacctgcgccagctcagatattttgtcaccacggccgagtgcggcagcgtcgccgaggcctcgcgcaagctgtatatcgcgcagccgtcggtgtctacggcgatcaagcagctggaagacagctttggcgtgcagctgtttatccgccatcacgcccagggcgtttcgcttacgcccagcggcgcgcggttttatcgcaaggcgctggagctgttgcgggtggcccatgagtttgagcagaacgccttggccgacaatgacgtggtggcggggcagatcgatatcggttgctttgagacggtggcgccgttgtatttgccgcgcttgattgccggcttcaaggcgcgctggccgggggtggaaatccgcattcgcgacggcgagcagcaagagctggtgcaggcgctgacggcgggcagtattgatgtggcgatgctgtttgagcatgacttgggcggcacgattgaaaccacgccgttgatgccgccgcagcagccgtacgcgttgctgccggcggaccatcggtttgcgcagcaggctaaagtgtcgctggcggacctggtgctggagccgatgattttgctggatgtgctgccgagccggacgtacttcgtgagcatctttgaagagcgtgggctgacgccgaatattgtgttcagctcgccgtcgattgagatggtgcggggcatggtagggcgggggtttgggttttcgattttggtgaccaagccgtttaccgagtacacctatgatgggcagaaggtggtgtgtgtgccgttggctgaaaccgtgaccgggtcggggctgtcggcggtgtggttgcggcgggcgccgttgaccaaaccggtgcagctgtttgtggattattgccgcgaagagctggcccgtttgctgggctagcgctcgatcgtacccacgctctgcgtgggaatgcatccgctgacgcttgcgctgaggtcaatggcgggacgcggagcgtccctggcggcattcccacgcagagcgtgggaacgatcacgatcagaagggcgggcctttaccggttaactttcaggcgcgtagttcttgataccctcaacgcgcagccaatcgttaaacaactggtttgtgttgtttacggcgtcccgatattttggactgtaagtaccgtcggctttgtctgggtcgaagttgaaactgaaggtttcagtcttcatcggcccatcgccatagtccaggtcacttgatgtcggctcctgaattgacacttgggtatcattgcgcctggcggcttcactgagcaggtcgatcactctcggatagttttcttccgttacggtgatgcgattgtattcattgttcggcctgttatgtgcgtcagcactccctgcgcttggcgccacttgaggtgtcatgggggggagaataaaagcagaaggcgcaatgttagtcatggtgtacacctaaaaattgatgggtatgtaagcatccaagttggctgcctctttaagtggcgaacaaattccttcagttcccaggcattgttgagtaggcgtgaggcgaattttcactctcacttcccagcagtttttacacctttggcaccggtcggttacatcattgccagctagatccggcttatggaaatgttcaaacgcttcgggccggcaagttgctgtgggaatgctcaccggggccgaatttattcggccggtgcgtaatttctgatgccagcctcgtcaagcttcacttggaattcgcgacgaaaatcactgatcctcatctgtaaggcggggctgaaggtaccgtcaggtgtgtcgggtctgaaaccgaaatgaagggtgttgtgcatgtcgactccgccgccatggtcatcgaaatcaaaggtgtcagattcgcgtttgataccgatgtcctttaacctggcgagctcatcgaagatctgtatcgctttcggggtgtcttctattttcaccgtgaaacgcatctcggtgttgttcggtgtgtgatccttggggcgcgagcgcaacgcctcaggtgcttcctgaagtgccaaagggttggaagatgagtgaataggttgcatagtcattacctacgagctgattaattacgcacggttgaatctgccttctcactatgtgggaggcttagtacgctcagttcctggctatcctcgtcgagttaaatcaaaaaatttcagaccgtcagcgcagaagtttgggctagcgattgatcgttgccacgctctgcgtgggaatgcatccgctgacgctccgcgtcacgcttgcgctgaggttaatggctggacgcggagcgtccctggcggcgttcccacgcagagcgtgggaacgatcatcataggcggcccaggttcgtactgcatgagggcgactgaataccgcgctgccagggtgagcgcagatctaaatgtgggagctggcttgcctgcgatggcggtgggtcagttgcagaggtgttggctgatacaccgccatcgcagacaagccagctcccacagtcgatgtgtattgccaatccgaactgcgctcggctccagccttcacggtgatccgcaattgttggcctgaacacaggcccaaattgtgggagcgggcttgctcgcgaaagcggtgaatcagccagcacatcgagtgactgacacactgccttcgatcgttcccacgctctgcgtgggaatgcatccgctgacgctccgcgtcacgcttgcgctgaggtcaaaggcgggacgcggagcgtccctggcggcgttcccacgcagagcgtgggaacgatcatcaagcccgctcccacatttggcctgtatggtcagggcgcaatgccggcgatgagcttgaaaaagggctcttgcttcaatgcagcactttggctttcggagcccacccggttgcttcggtcttcattgcgataagacacgtatccccacgctggcgccgatacatcggaggcgggtttgtgttcgcttttgctgatgcctgcctcttgcagcgcctgctcgatggcctttaccagcgcctggattttccccatgtgctcggggctataggtgccatccgtgcggtcgggtttgggataaagcgtgaactgagcgccctgcgatatgcgcgtgtcccttgggtcggcacggctgacatcggtggctttccagctattgatcgggctgtcttctgaattaataagcttgccgacaacttcaaaggccttggccatatccttttgcgcgacgctgatgtggaacttgtcgcccactgatcggccttcttctttggcaggcgtgcgcgtgaatttgataaaggggaagtttttatattgaagggctttgttttggctgctccatcccgcaaagatctcacccgtggactgcttggcgacctcataggtgggcacgccatgattgggggtaaaacctacgtttgcatggcgcgcaacctcggcgttgctcatgccctccaagccgccggtgtcaatagggctgcggccgttaaacagtaaatctttgaagcctgaaccgaaaaaggaggccgggggggtgtctactcgcatgtggaatacctttttttcgaaaagatgcggcagtcacagggttgctcatcgcctgggcttttcggatacagatgaaagttgatatctgtgtggtttcacacacgttgcgagttccaattcagcccctcgcaacgggcttatgcgctgcgcacgactgtcgcgaagaggggcgtgaacgtgggaacgatcatcataggcggcccaggttggtactgcatgagggcgattgactaccgcgctgtcagggtgagcgcagatctaaatgtgggagctggcttgcctgcgatggcggtggctaagttggcagaggtgctggctgacaccgccatagcaggcaagccagctcccacagtagatgtgtattcgatcgttcccacgctctgcgtgggaatgcatccgctgacgctccgcgtcacgcttgcgctgaggtcaatggcgggacgcggagcgtccctggcggcgttcccacgcagagcgtggcaacgatcagggtgacaggttcgtgttcggcttaagcgcgaatcgagtcgagcatgcgcagcaacatcgcatcacagcccgccagctgctccacactcacaaactcatccggcttatgcccctgatccatactcccaggcccgcacaccacggtgggaatgcccaccgcatcaaacaacccaccctcggtgccaaacgccacggtgccaaattcccgggaaccgctgaacgccgcaatcagttcggcagcctggctgcgctcatcggtgaccaaccccggataggccgacaactcggtaaaccgaatcgcactctgcgcactcacggcctgcatgcgcggcagcacctgttgctgtgcgtaggcttgcagttctgaagccacctcggctgggtcttgcgacggcaacgcgcgaatctcgaaatcaaaccggcaatccgccggcacgatgttcagcgccttgcctcccgaaatcacgccggtctgcactgtgctgaacggcgggtcaaagcgcgggtcttgcgtctcgcgcaggcgttggccgatccggcccagttcaccgatcaactcggcggcatgctcgattgcattcacgccatagggcgcatacgccgaatggcaggcctcgccatgcacatcacagcgcatcgccaacttgcccttatggccaagcaccggcttcagttcagtcggctcgccgatgatgcacaacatgggtttcaccggccgctgctccagcaccgccaacaaagagcgtacgcccaggcatccgacctcttcgtcgtaggacagggcgatatgcaccggcacgcgcaaggtggccctgaccaacgccggcaccagcgccagcacacaggcgatgtaacccttcatatccgccgtgcctcggccatacagcttgccgtcgcgctcggtcagcgcgaagggcggcacggtccacggttggccgtccaccggcaccacatcggtgtgccccgacagcacaatgcccggcagttccgccgggccgatgctggcaaacaggttggccttgctgcgttcttcgttgtagaccagctcacaggtcacgccgaacccggcgaggtaatcgcgcacgtactcaatcaactgcaggttggactcgcggctggtggtatcaaaccccaccagcgtctgcagcaactcgcggctgctgctcatcgctcgtctccggccacgccgtagccgggggaacggtcgggggcgagggcgcggtcgatgtagtcctgcacttgcgggcggtaggtgtcccagagtttttgcagttcggcgatgggctgctcatcggcccaatccacgcgcaggttgatgatcggccaggtcagttcgcccaccaccaccaacgcggcggaatgcaccgggccggcttcgccaccggcggcgatggcggcgtgcatggccgccagcagccggtctgccagttggccttcggcgtgttcgaaggccttggccatcgcctcgaccaccgcgcggtcggcgagcatattgcccgccgccacacactgttcacccgacaccgcgttgtgggtgccaagggtctcgctgccgctgaaatgcacgctgcggcccaggtgatcaatcgccgtgagttgccggtattggctgtagccgttgcgcgtgagggcttggtcgacggcggcggcgggttcaaggccttgttcgagcaggtcgagcacgtccgggcccagcgccggcagcgtgatgttctgggtcgacaccgcgcccacgccgggccgtagccacgggcagcgcgcgcccacggcgatgctcgatgagctgatggcgatgcccagctggccggtgtccgcgcaacgcgcgacgattgaaaaggtcatgtgcggctccttattcggggatgacggcgatcacgtcaatttccatcaaccactgtggctggcccagggccgaaaccaccagcccggtggagatcgggaacacgcctttgagccacttgccgacttcctggtacaccggctcgcggtagcgcgggtcgatcaggtaggtggtggttttgacgatgtggctaaggtctgaacctgcctcttcaagcagttgcttgacgtttttcatcgcctgctcggcctgggcacgcgggtcgccgaggccaatcaggttgccgtcgaaatcagtcccgacctggccgcgcacatacacggtattgccggcacgcacggcctggcacaggtcgttgtccaggctttggttcgggtaggtttccttggtgttgaacatgcggatgcgagtgtgagtaggcataaaaaaactccagaaaatagggatcaggcgctgacgggcgatttatgaacaagcggcgcggcttcgcggtattcgaggtactggcgctggatggcaatgtggtcggcgacgtatttggcgtcgtgccacaccccccagataaacgacgagccacggcgcgactgccatggcaaaccgaggaagtagatacccgactcaggggccacgccgcgctggtgttgcggcttgccgttcgcgtcgaaggcatcgactttcagccagctgtaatccacggcaaaaccggtggcccagatgatcgaggtgataccggccttggccaggtccagctcaaggatcgggtgtttgatgcactccgcatcggggaatacgcggcgcgcttcgggctccaccggcaggtcgaggccgttgcgctcgatgtaggcgtcggcggcgtccagcagggccaggtagttttcgtcaccgcgtgccaggttttccaccaggttcgcctggaaggtggcggtggtgccgttgaaggcttgggtcaaaccgaccagggtcatgccttgctgggccagctcgcgaaaatcaatggtcttgccgccgtgggcgccgctgactgcgatggtcacgtgctcacggccgggtttcatcgcggcctggtcccactcgcccaacacgcccagccaccagcagaagtcgcggttgcgataggcgcggggcgggcggtcgtgggcgccgactgagaggtacacttggcgcccggagcgctgcagttcatcggcgatttgcacgccggaagaaccggcgcccaccaccagtacggcaccggcgggcagttgcgcggggttgcggtagtcggcggaatggatttgatgcagcgtggtgtctttcggcgcaatcgcgggaatcaccggtttctggaatggcccggtggcggcgaccacgcggttggcttcgatcacgccttcgctggtgtgcacggtaaagcctgggcggccgacgttgcgcaccactgaggttacgtccacgccggtgcgaatcggcgcattgaatttgcgtgcataggcttcgaaataatccgccacgcgttcttttggcgcgaagccatcggcggcgacatcatcgaattccaggccaggaaagcggtcgtgccaggcggggccgttggctaccagcgaatcccagcggccggtgcgccagcgctcggcgatgcggctgcgttccagcaccaggtgcggcacgccttgcttgctcaggtgctcgctcatggccacgccagcctggccggcgccgactaccagcgtgtctattgttgttattgcttgggtcatgtgtctgtccttgcgtaatgcagttggattcagcgtgggcatgacttcaaggctagggggagggcggtttttaataaaatattattaagctgggaacagagcataaatatcggatgcagagcggtgtgcgtaacgccacagatcaaatgtgggagcgggcttgcccgcgattgcaatctgccgggcgatagcgtcatatctgacccaacgccatcgcgggcaagcccgctcccacaaggtttctgccatgcccgcgcttcgcgtaatgaccccagccgactacgacgccgtcctcgccctcatgcaaaacacccccggcatttccctgcgcgatgccgactcccgcgaggccaccgagcgctacttggtgcgcaaccctgagatgagttttgtcgctgaagctgacggccgggtgattgcctgcgtgatgtgcggccatgatgggcgtcgcggttacctgcaacacctgctggtgctgccggactatcgccgccagggcatcgcgcaggcgctggtcgagcgttgcctggctgcgctggagcaactgggcatccataaatgccatctagatgtattcaaaaccaacacccacgccgcccagtattggcaagcccagggctggacacttcgaacggatatcgaccgttattcattcacccaaaagggcaatgaaaacgcatgaaaggagaacgtaattagcgcaggcatgtatccccatcatcaagagacttaccgcgctctaaccaacacagctaatcccctgtgggagccctcgagccttggcgaggccgcgaaagcggtgggtctggcgacaactatgctgaaagtgccgccgccttcgcagcctcgccaaggctcgacagctcccacactggatcttcactcgacacaaaaggccatgcgcaaccgctcaaagcggctatccccgatttaaccaacacagcaaatctcctgtgggagccgtcgagccttagcgaggccgcgaaagcggtgggtcaggcaaccactatcccaacagtgccgccgccttcgcagcctcgccaaggctcgacagctcccacactggatcttcactcgacacaaaaggccatgcgcaaccgctcaaagcggctatccccgatttaaccaacacagcaaatctcctgtgggagccgtcgagccttagcgaggccgcgaaagcggtgggtcaggcaaccactatcccaacagtgccgccgccttcgcagcctcgccaatgctcgacagctcccacactggattttcactcgacactgaaggccgcacgcaaccgttcaaagcggcaacctccgatctaatcaacaccgcacatcccctgtgggagccgtcgagccttagcgaggccgcgaaagcggtgggtcaggcaaccactatcccaacagtgctgccgccttcgcagcctcgccaaggctcgacagctcccacatttgatcttcactcgccgctgaaggccacgcgcaaccgctcaataacccgctcaaccgaatcgccctgaatcgccggcggtgtcaaactctcgccaaattcgcgccacacaaacagcgtcaactccgccccatctgtcagcgtctgcgccaggtccggcgacccaaagttttgcagcaagcgataacgttcatcctgccaaaacgcccgctccacccagtcatacaccgggatgaaatgaaagtgcagcgggtagcccggcatgtgcccatagcggctgatgtacagccatttcggccgcagcagcgcctcgatcactcgctgggtgttggccagcaagccgcccagttctgccagtgcggccgccggcatatcggccagtgagtcgatcggcgtcttggcgcccagcatcaggtaacccggcagcttcgacgccaggtgatggttgagccgccagtgctcggtctcgtgaaggatgaaagcggggtcgatctgcatgagtacgcgtccttgatgggcgaagctgtttgtcgtgggctgagcctcaccctcggcgatacaccccacccaattcccgcgccaaggcaataaagttctgtagcggcgccgatggattgaacgtgcgccgcaccaaagtaatcggcgccagcagttttggcctggcgtccttgatccggcagtacaccacgctttcgcggtggacatcgcgcatcgacgccggcaccaccgagatgccttcgccggccgccaccaggctgacgttggtgagcatgcgttccacctcaaaggcgatcctgggctcgaaaccggcgttctggcaggccttgatcaggttggcgtacatgcccggcgcgccggggcggcggaccaggatgaagcgttcgtccttgagcgcggtgagtgggatagcgctggcggggtctttgagcaagggatggccggtgggcagggccagcagcatttcttcgttgagcaggcggtgaaaggtcaggctttgatgagtgctgacgggtgcgcggaggatgccgatgtcgaggcgtttttcgatgctgtcctcggtcacttcgcgggcgctgccttcgttgatcgacagttccacgccggggtagcgttcgcggtaggcgcggatgatgcgcgggatcagcgggtgagcagccgcggagctggtgaagccgatcatcagcgtgccttcgatgccgtgggcagcgcgggtggccttgagggcgccgtgttcaacgcgggcgaggatcacgcgggcctcgtcgagaaacaccaggccaccggccgtcaggtcgacgcctttggggtgacgtttgaacaggtcgaaacccagctcttgttcgagggcgcgaatctgttggctaaggggcggttgctgcatgttcaggcgcgcggcggcccgggtgaagtttcgctcttcggccaccatgatgaaataacgtaaatggcgaagttccatggtggtatatcccgtggcaagactttattatttgcgacctgcagcggccaggcggtcaatatgccgaaagccgcggacaacgacaataacaataaagaaaaataggcgggagcgttgatgtcagcccgattggccaaacatgcaacactgcctattttaattgccatcgcacttggcatgctcttgggtttagtgtatccggacctggcgattgaaatgaagctgctcagcgacggctttataaagttagtcggtttattaatgccgttcctgctgtttgtattggtcgccaccggtgtcgccggtatcaagcgcgagcccaaccaccggcatgtggtgcggcggatcattgtgtattttcaactgatgtcctgcgctgcgctgatggtcggcatggccaccgggtgggtgttcaacctgcaacatagcgcgttgcctgttccgcctttacccgcgcaaagcctgctgcacgaactgtcgctgttgtcggcgtcgtccacgctttatcacgtatttacccaaagcctggtgctgcaagtaatgctcgcggcgctcatctgcgggttgctgctggggcgtggcagcgccttcggcaatcgctgcctgggtgggttggaagcgggcgttcaagggctgttctacctgctgcggattatcttgaaattcgcgccgttggcggcctttggggcgatggcctttgtagtgggaaagtacggtgttagttcggtattgccgctgtttaagtttgtgctgattatctacctggcgtgtgggttatttgtcgtggtggtgatggcaactgtcactcggatagtgggggttaagttgtcgcgtctgattgtttatttaaaagaagagttgttgttggagacctttaccggttcttccgtggcggcacttcccggctgcgtgaataaacttgaagccttgggctgtgaccgtcaactggtgcgactggtgttgaccaccggctacaccttcaacctggcgggcaccaacctgtacctgaccacagcgattatgtttttagcgcatagggcgggcgtggaactggcgctgcctcaattgctcgcggtgttgctgatttgcctggtcacctcgttgagctcgaccagcgtggcgggctctgcgttattcaccctgatcgcgaccttgaacatcctgcaactggtgccgctggaaggcgtggggttgctgctgggcgtggagcgcttgatgaaatgccggtcgctgaccaatgtgctgggcaattgcgtggcgtgcctggcgatttgcgggtggcagcggttgattgatcgtgaggtgttgcagcgcgaaatggcgatctgaagtgaatgccggttcagtgtgggagctggcttgcctgcgatagcattccgtcagccctgcatgtgtcggctgacccaccgctatcgcaggcaagccagctcccacatttttgaacgtatttcagcctttgagtttgtcgaacgccttatcgaggttttcctcggcgcccttgagcttctcacgccgctctttcagccactgctgatccccctccaaggtcttgcgtgcctccaccagcatgcgcttgacctcctgcggctgcgggcctcccgtgcctttgcgggtttgtaccatggtggtcggcgacagggccgcacgcaagcctgcttcatccagtggcaaggtgttcggcgcccacttgtacttgtccgccgcctggcgatacagcttctgcgcgtcggcataggcgaaggttttcggcgtggtgccgttgctgcgggcttcggtgacgatcagcgaagcaaagctgtggccgatgcggaacggcaccttgtattggcgctccagggtgtcggccagctccatcgacgtggtccattccgattcgagttcttccagcgcgcgctgcgggttgatctgcagggcgtcgagcaccgcgtccatggcctcgaacatctctttggtcgagcggaacacgcccagcgagtcgaaggcaaacttgtagtcggtcatgccggtggtgacgttgtgcgcacgcagggtcacggcctgggccaggccgaccacgtcggaggcgctttcacgcgcacgcatcagcaggccagggttgcgtttttgcggcatggcgctgctggtgtaggtggcttcttcatcgagcaacaaccacgggcgaatctggtggtactgggtgtggatgtcgccaatcatcgcgccgacgcgaatggctgacgacgacgccaggttggccgcctcgatgggaatgtcgtaggtcgagacctggcttgaatccagcgagttttcgcgcacgccatcaaagcccagcagttcggccaggcgctcacggttcagcgggtaagccgagttcgccagcacggcggtgcccatcgggcttttgttcaggcgcgtgtagagctcacggatacgctggccgtcgcggtcgaacgcggcttcaaatgccagcaggtagtgcgcgtagctgatcggcatggcctgcacgccgttggtgtaggcgggcaccagcgtgtcgacgttcttgtcggcgatgttcagcaagcgcaggcgcgtggcattcagcgcctcgctgtaggccagcacttggctgcgcagggcggccaggcggtaagtggcgagcatgtcttggcggctgcggccggagtggatcaatgaggcttcagggccgatcttgtcggtcatgattttttccagctgcagcacgtcgcttgggcgcgtgccgccgggctggtcggcctgggcgatggcgtaacgcacgccaccggcgatcttctggcccatggccggtgcgacgataccttcttcggtgagcatcacgatcgaggctttgttgatgcggttcagccaggcgaactgggtttgggtcgggtcgcccttggccttgtgctcggtgtgtgagctatccggcgtggcgccgaccttggccgcctgggccgcgcattgttcggtggtggtgcagggcagctcgccggtgttggccgcataggcgccgaagctgttgaacagggcgaaggccacggccaggtgaagcaggcttttgagggcgcggggagatgtgttcacagggatacccgattatttttggaattatgagccgccgcacgctgtgaggcgcgcgcgtcaaaatcaggctatcgggtctgtttgcagattgaaaatatagagtaagtgttgatggtagaggttttggatatggggtctgtggcgagcgggcttgccccgcgctgggctgcgcagcagccctaaaaccagacgccgcgttcttactgatgtattgcagtggattcactggggctgctgcgcagcccaacgcggggcaagcccgctcgccacaacaagccccggctcaccacaactgactcattcaccacaaaagcacttcagtgcatcttgctatggtccataccatccagcccgcgggccggcgctttgacttcaatcgactgtttctcgcccttggcgttttccaccgtcagggtcagcggcacctggtcgccttccttgatctgcccggtcaggcccatcagcatcacgtggtaaccgttcgggtcgagcttcaccgctttaccggccggcagttccacagagtccaccgggcccatgcgcatgacgtcgtccttcatgctcatttcatggatctgcacgtccttggccaccggcgacgccacgctgagcagtttgctgtcagtgtcggcagtgacagtcatgaaggcgccgctggacggctggcccggcaccgaggcgcgaacccatgcgtcagttaccagcacctgggcgctggcgtgcgccgcaaggcccagcagggacaagccgatgagggtgcgcttgaggtgttgaacggcagtcattagcagacctccatgacggtgagcaggtcttctgcgcactctttagcggtaagggaagccgacaggcccaggcgcaggttgccgcgggtgtcgaagacgaaactggtcgcggtgtgcgacagggtgtaggtgtcgccggcggggatcttttcatagaagatcccgaactccttggcggccacggcgatttcttccggggtgccatacagcgcttcgaagctggggtcgaaggccttgacgtacttgtcgagaatttccggggtgtcgcgttcggggtcgagggtgatgaacaccacttgcatgatctcgccgtcgcggcccatcagcttcttggcctgggcggcgcgcgccagggtggtggggcacacggccgggcattgggtgaaaccgaagaacaccaccggcatcaggccacggaacgagctcagggtgacggtttcgccgtcggtgttcttgagcttgaaggtgcggcccatgatcttgtcactgaggtccttgccgtacttgaagttcagcttggggctgtagtcacagccgcccagcaggctgcccaggcccaacaggcccatgccggtcagcactttgcggcgggtgaataacgtactcatcaactgtgcatcctgtgaaacgcctgccgtgcgctggatcaacatttcaggctttgaaaaggagtaatgatgcgggtgcacattctaccaacccaggccagcccacgtaatctgcgacgttctgccacaggcgcgcgcggtgcttcatccctttagggcgtcggtggtagagtcgccgccatgaaattgagccaccccgaccgttcgctgatcgcctgggccctgtacttttgcctgctgatgaacctgttcgcctgcggtttgggccatgggcaaatggtgggccagcagctcaatggcatcggtggcgcattctgttcggtggacggtagccaggcgccactttccgacaaagggttgggaaacccatcttccggcaacatctcgaactactttgcctgcccggtgtgtgccgccgtgaccgtggccatcgtgttcctcatcggcctggcctggctgttgggcctcgagcaaaccccacgcccggcccatgagcgccgcaacaaagccccgccgcgttactcctggccctcggccaaccctcgcgcttcccccgcattctgacgtgtgccttgggcctcctgtgaacaggaggcgttctatcgtcacgactgtgagtgcgtttcatgaatcatgtagtgcctgctggcgccagccgtctggtcagcaaggcgacccgccgcgtgcgcgcggaaccgccgctgcctgaatacccgagcaattcccgctgcttcgtgcatctggatgcgcgtttgttgccgtattggcacaccttgttcgacatctgcccggcgctgctcaagctcgacccgccggagggcttgaacctgtttcgcagcttcatgacctgggcctatcgcaaccagccgccgcaggactggacctatcacctgaacgtctgccgatggctgctcagttcgccgtatcgatcacaaattgatgaggaaccgatagaagccttcatggcggccgcggcagcatgctggataaatactgatgacagccaggcgcacggcctggtgttggcttggcgaggtacgcggatgtttgactggaaaggcgccgctgttcccggcgccgaacagcagatattgccagcgagtacaggcgatttcgcctggagcccgctgacgcggcagggtggtttcagcggctggctgccggtgccctgacgttgactttcgcccggcgcgggagcggttcgccccgcgctatgaccttagctgtccttgggcggtgccttctttttaggtttcttgctgtctggctgtttctgggacgagccgccggtagcagccttttccttcggcggtgtttccgcttttttgtcgctgtcggaggggctgctcgggtaagtgccgggtggcagggcggaaccggcggcgctgttgccgctcagcgaattggctgccggcgcgatggcatcgccgaaggcggcgaaagcagggctggccagcagggctgaaaagccaacgatgagcattatcctgtgggaagttctggtcttcatgactcaatccccttgcttgaaccgcagcccggaaaacccgggccacggtaacgcatcaatcaagacttcttgccggccccgccggagctatgggctccgccttttttgccggcttcggaagccttttcacggtcattggcaaaattgccgccggagccctggccgccgcttttcttggctgcgtctggcttggctttaccgcctgcacctgttgtggtttttccgctggtagccatttcaaaatccctcttcaatgaatgaatcaacggtgtcgcttaattgggaatgccgaatcgaaatcaaagtttgaaaaacttcgtgcgcatgcgacgaacgggtatcaagccgcgatcggcttggcgcccagggcttttttgtgggctgccttcatcgcttccatttctgcgcccagcgcttcaagcacggtcttgcccagcagctttttcgcctgcgggaacatctcggtttcctcttcttcgatatggtgctccagcagctccttgacgactttcacacggccggaaaattcggtggtggacggctcggtttgcttcaggtcgggcagcaccaaggcgtcgacagtgcggtgctcttccttggcttcgtggtacatgatgtcttgctctttaccgccagccttgcggaacgccgggtaaagaatctcttcctcaagccgcgtgtgcaggctgatctccatctcgagtttggccagcaattcagtgcgtttcttgacgccgcgctcggtggactcactcagttgagtcagcagtgccttgacgcgttcgtggtcagctttgagaaggtcgatggcattcatggtggaacctcacggatagcagtcgggcgtgtcgaagtgcgcgcctcgtccgctaacggttgcatcagttgtaccaacttgaatgatttctaaaatgctttgctaatcagctaattgcgacggcagttggcgagtcgctgccgtgcagcttgcatggtcgggcgagtggccggttgcaaaataccgattagccaccgctgaccttccaatgcttgatgtcttcggcaaacaccacctgctgcacctcatgggcgattccatacgcgagcgactcgtgggcggcgatgactttttcttcggccgacaggcacttgaaaatatccagctgggtttcggcccgggtggtctccagttcatagatcttcacgtaacgcgccaggtcgttatccaggctcgacaggtattcgcgcaggcgctggtggtccaccgagctctggctgaaataccagttcatcgggtggatcaaaaaccgtgagtgtggcgtggtgatacggcggtcggcggccaggaacatgatgatgcccatggattcgatgttgccggcgttgatcgcgcacaacggcaccggcagcgccttgagaaaggtgtagagggtaaagccgaaattggtgctgccaccggtggtcgacaggttcagcagcagggagctggcgccttcgccgatggcatccaggcagcaatcgcgaaagcgttcggtggtgccctggtcgatctggcaatgaaagtggataacgtgctcggtcatcctgaacctccttaattcaatgcaggcgaggtgattcagtcttgagtctagaaggtcgctcaggattagctgcaaccgttgggcgtgagcgcccgggtgcaaatcggatggaaccctcgggccatctgcttgacctaatgcatagacctcaggaggtgaactatgcaattggaaactatctggatcattttggccgtcattctgctgatcctggaattgtgggcgatcaacgttgtattgcgcagcaccggtggctgggagaccaaggggctgtggctgatcattctgatttttgtaccgctgttcgggctgattgtctgggcgctgttcgggccaaaacgtgagatggccgatcaacgcaaaagctgaccatggggtagtgccggcaaccagtaacctgtggcgagggagcttgctcccgttggactgcgcagcagtcccgttcttaaaagagcgggccgcttcgcggcccagcgggagcaagctccctcgccacagttacgatggtgtgcttcaagcggcgggtttagcccgcaaccaccttggcaatcgccgtgctgaacgccggcaagtcatccggtgtgcgcgaggtgatcaatgtccagccattggcctggcattccttgacctcggcatccacccaaccggcagcgccggcgttttccaggtcgatgcgcacgcttttgtaggaggtcagggtcttgcccttgatcacgccggcgtcgatcagcgcccatggcccgtggcagatggcggcgatggttttaccggccttgacgaagtcattgatcagggccaatgcggccgcatcctggcgcaacgtatcggcgttgacggtgccgccgggaatcaccagcgcgtcaaaatcgctgcccgccacgtccgacagcttggcgtcggattccacggtttggtccttctccgtgtcgccgacgaaagtctgggtggtgccgcctttgctggacgcgtgcgtcaccgcagcgccataaccacgcagcgcttccagcggcttgagcagctcatcgcgctcgatgccggtgttggaggtgatgatgaggattttcttgccgttgagttgcgaactcatggtcgagtgtctccttgggtcagaggttatttagcgtgattggcttgcagctccttggccattttcaggtgggcttcaagggtcggcagggtctttgtggcgaaggccttcagctcggcgttgtccgaggaggcggcttctttcttgaacaattcgacggttttctcgtgggcggcgacctggttattggcataggccttgtcgaacgattcgtcgcgcatttccaggatggctttcttggccttgtcagtcagggcggcatcatccggcacttcgatatccagcttcttcgccaatgccacgagttcttcgttggctttggtgtggtcggtgaccatgtgctgggcgaacgttttcacgtcggccgcgctgcttttttccagggccagcttgccggcttccacttcggtaataccgccttgggcggcgtcctcgacgaagctgttggacgtggcggccatggccgtggacatcgagcctgcaaccagtgcaaaggtcaggcccatttgtttcatcagcagagtagtcatggtggatctccttgaaatcgacagtggcgtgatgccgtacctgactgttgagcggggccttcgccaaaaggtttaaattaattcgcgcttttttctccggtggtgctgcacggcaatttccttgaactatcgaatttcagtgggctctgctgcatacgtgcccgccatttttcgtgggccttcaactgcttggagaaacgccgtgactgccgacaaaaccccaaccccgatcagctcgcaagacgcccagaaaggcactgaaaaagccgacaagggccagaccctggaacgcccgaacccgaagaccgaaaccgtcgacaaggtgctcacgcccacctcgatcaaagacaccgaacgtcagaccgatgcgatcaatgagcaggcggccaaggtcgagcgcaagctgggccactgagcatggccaggtcgattaccgcgtccgaattgggcatcgaactcacacccgaagacgacagcagcctgttcaagtggtttatcgccagcttcctgatgggcaagcgtattcaggcgcccatcgccgcgcaggcctacaaggtgattgtggaagagcaaggccgcgataccgcgcgcaagttgcagcactgcacctcgcgcgaactggtgacgatgctcgggcgtgcgcattacgtgcgttacgacgaaagcaccgcgcagcgcttgctggatctcagtgccaagttgaacgctgaatacggcggcaagatcagccatatccgcagcgccagcgtcgaccgcaaggcgtttgaaaaacgcctgggtgaattcgatggggtagggcccaagaccatcgagattttcatgcgcgatgcggccaaggtgctgttttgaccaaccttctgtggtgagcgggcttgctgtggcaagcgggcttgttgtggcgagcgggcttgttgtggcgagcgggcttgccccgcgttgggccgcgcagcggccccagtaaacacaccaaggttttcctgataaaactcagcgcctattttggggctgctacgcagcccaacgcggggcaagcccgctcgccacagccgcgcagcggccccaataaacacaccaaggttttcctgataaaactcagcgcctattttggggctgctacgcagcccaacgcggggcaagccc

SEQ ID NO: 61 - DNA, 65337 bp, Pseudomonas poae FL10F
acgatcatcaggcctgactgacttggtcccaagtgatcgtccccacgctccgcgtgggaatgcatcccgtgacgctccgcgtcactcgtgtgatgggacgcggagcgtcccagtcggcgttaccacgcggagcgtgggaacgatcatcagcgctcgatcgagcggctccagcgcgcattccactccggtcgtgcctgattcacctgatcccaatcaatcgaaatcgccgtctgcaggtaaccctgcatggcctccacccgcgcgcgggttttatcggtggtcggcgtggtcgggttggacggaatctggtcgccttcttccaacgccggcgcctgggcttcggcggtcagcaagaaggctgcgagtttttgcgccagttccggctggtcgttacgcgcgatcacgcactcggccacgttcaggactacggcgccttccttgggttgtgcatattccatcgggatgccgagcagtttctgcgtggtcacctgggtcggggtcagcgggaagatcgcggcttcgtcggtttgcaccatctcggagatcttcgccgagctggcgatgtattcgagcacgttggggccgatggtttttggccaggccttgaagcccggctccacgtttgtttcggagccgccctggatgcggttgaacatcaagaagccgtgcaggccgaaggtggaggaggccagggactggaacaccaccttgtctttgaaacgcgggtcggcgaggtccatccacgaggtgggcgccgcccagcctttctccttgaacatcttggcgttgtagcccaggcccgtgacgccgagggtcacggccacggcttcgtccttgattttggccttggccgggatctgctccagggtcgggttcggcgtgagcttgtcgcacaggcccatggaaatagcgcggtacatgatgccgtcgtcgaggaacatcacgtgcatttgcgggttgtctttgttggcctggaccttggcgaggatgtccgacgaggtgccgggcacgatcaccactttcacgttattggccttctcgaacgcgggcagcaccttgtcggcgtatacccgctccatggtgccgccgttcatgcccaggtacagcgtgggctcggcatgcgcagtggttgcgagcaacgcgagggtcaagcaggacagcgcgatacgtgtgtgcatgggtgtttttcctctcaggcttggaaacgacggatggaaaacgcttcgatgggctggcggctggcaccgttgcagacgagctctgccagggcttcaccgaccgccgggccgagctggaacccggcgccggcaaagccgaaaccgtggagcaggccaggttgggtactgctggggccgatcaccggctcatgatcgggtaagtaaccttcggtgccgctccaggttcgaatggcctgggcacccttgagaaacgggtacaactcgccagcgttgcgcaaaatctgcagcaccgccgcctgcccaggacgcgccgtcagcgggcccagcgcaaagccacggccgccaccgaggatgcaattgccacgggcgacctggcgcgcataaatgccgccgccttcaactccggtgctcacgttcatcaccaccggcagtggctcggtcaccagcatcgccgggtgcgccgaggtgatcggcaccggctcgccaaattgcgcggcgacactccctgcccacgcgccggcacagttgagcagccatggcgcctgcaggtgcaggccgttggcgcaatgcacctggaactgctggccgtagtgttcgattcgagtcacttcggcctgctcgtagacatcggcgccatgacgctgcgcggcgcgggcaaaagccggcgacaccaggcgcgggttggcgtgcccgtcttcagggcacagtgaagcgccgaccgcgatatcgccgacccacgggaaccgcgcgcgcagctcggcgtgatccagcaactgcaagcccagcccaaagcctcgggtatgctcggcataggtttgcagcgcggcaaaatccgcatggctgcgcgccaacttcaaatgcccggagcgcacgtactcgccgtcgatgccgatcaaccccggcaagtccgcccacagctggtgagcgcgctgcgaaagcggcaattgatgcaagggccgaccctgacggcgcacaccgccgtagttcacaccgctggaatgcgagccgcaaaagtcgcgctccaccaacgccacgcgctgacctttgtgcgccagcatcaacgccgccgacgcgccgacgatgccgccgcccaatacgatcgcgtcaatcatggctgcacctccacgccaaacggcagcggcttgatcggcgcctggccgcgcaggcgtccgacgtgttcaacttcacggccactgcgctcagcgacaatttccgccgccgccaacccgcacatacgcccctggcagcggcccatgccaacgcggcaatgggctttgacccgattgatttcccagtggccctcatccaccacggcgcgcacatcgccgacgctgacttcctcgcagcgacacaggatcagcgcatccggtgcctgcgcggcccagttctcggggaaggggaaggcggtttccaggccctggcgaaagcgctggatgctcgccaactgctgctcaaggacggcggcgcggcgctgatcaatggcaatgcccgcgtcttgcaataccgccaacgctgcgcgttcaccggccatttgcgcggcatcggcgcccatgatcccggcgccatcgcctgccaggtacacgccgttgatgctgctgcgcccggcgctgtcgcgttgtggcagccaggcgcggttcaagctgttccaggcaaactcgcagccgagcaaatccgccagttgcgtctcgctgcgcaaggcatgggcgaaggccacggcatcgcagtccaaggtgtgcttgccccagcgaatacctttgacgcgttgctcgccatcgatctgcgtgagcgtcgcgccctgatgcacgggaacgccatgggccgtgagccaggcgcggtaatacactcctttggccaacgtcgccggttgcccgagcagcgccggcaaggcgcggcattgcgcgctgaacggtgcgctgtcgagcaccgcgaccaccttggccccagccttggcgtattgatacgccaccaggtacagcaacggcccgctgccgcaaaacgccacgcgctcaccgatggcgcagccttgatacttcaaggcaatctgcgccgcgcccaggctgtagaccccgggcaaggtccagccgggcaccggtagaatgcggtcggtggcgccggtggcgacgataatctgcgcgtactcgaggctctcggcacggccgtcgttgagcatgtccaggcgcccgtcctcggcgttccacaccagggtttgcgggcggtagtcgatcaatggcgccagctcatccagcgtgcggtgcacggcctcggccttgctggcttcaaagccatagagttgcttggccgagcgctggaagttggccggttggcgccgataaacctgcccgccgccacgcaggctttcatccaccaggcaaggcttgatgccatggtcgagcagggtgcgcgccgcgctgatgccggccgggcctgcgcccacaatcacaatcggcttcatgcttggcgccccggatcacggctgatcgcctggccttcttccaataacgtcgaacaggcgcgcacgcggcgcccatccgccaggcgcacccagcaatcctggcaggcgcccatcaggcagaaaccggcacggcgttcggcgctgaaatcgctgccgcgcaggtgctcggcacaggtcagcacggcggtcagcaacgtgtcgccgagcaagcccgtggccggttgcccatcgagggtgaaggccaccgccgggcgctgggtttcggccaatcgtttgaacagcgccatcaatgtttccccaccagcacgcggtccaggccgtagacccggtcgagcagaatcatcgtcgctgcggtcagcgcaatcaccagcgccgacaccgccgccatcatcgggtcgatggactcggtggcgtacacgtacatgcgcaccggcagggtttgtgtggccggcgagctgacgaagatcgacagcgtcacttcatcgaaactgttgatgaacgccagcaaccagccgccggccacaccgggcaaaatcatcggcaaggtgatctggcgaaatagcgtaaagcggctggcgcccagcgactccgctgcctgttcggcactgcggtcaatgccaatcgccgccgccagcaccaggcgcagcacgtacggcgtgatgatcaccacgtgggcgagcatcagccaggtgaagctgccattcacgcccatcagcgcaaacacacgcagcatcgccacgcccagcaccaggtgcggaatgatgattggcgagaggaacaacgcactgaaaaagttgcgccccgggaactgataacggctgatcgccagggccgccggcactgcgatcagcgtggccaacgtggcggcagtaaacgccaggatcaggctgttatagaacgcctggataaagtcggcacgctcgaataccgcgcgaaaccagcgcagcgagaagcccgaggtgggcaggctcaaggtgttttccggggtgaaggccaccaggcacaccaccaccagcggcgccatcatgaacagcaccaccaggccgtgaaagccgagggccaaaggaccgtttctggacatgcgcttaaacccccagggactttttgtagcggctttcaaccatgcggttccagctcagcatgatcagcaggttgaccaacagcagcaccaccgcgatggtcgcgcccatgggccagttgagttccgagaggtactggtcgtacaccaccgtggcgaccattttcaggcgccgcccgccgagcaggccggggatcgcaaacgagctggccgccaggccgaacacaatcaaggtgccggacaacacgccgggcatcacctgcggcaacacgatcttgcgcatcaccgtggcctggctggcgcccagcgacagcgccgcctgttccgccgacgggtcgagtttttgcagcgaggtccacaccggaatgatcatgaacggcagcatcacgtgcaccagcgcgatgatcactgcgaacggcgtgtacagcagtttcaccgggcgcccgccaagcgcctggatcacttggttgaccagcccgtcggcacccagcagcaggctccagccgaaggcgcgcaccaccaccgaaatcaacagcggcgtgaggatcagaatcaaaaagatcgagcgccacggtgtgcccatgcggctgaggatgtaggcctcgggcacgccaatcaccacgcagagcaaggtcaccagggcgctgatccagaaggtgcgccagaagatctcgtagaagtaagcatcgctgaacagcgacaggtaatgggcgaaggtccactcatcggccttcacgccgacttggtagtcgaacacgttgaacgacagcaccagcgtcatcaccagcggcagaatcaacagcccggtgaacagcgccagggccggcaacgacaacagataaccgcgactcatgcgtgcacctcatccgccgccagcacgcgcagcaagccggcgtgccagtccaggccaaccgccgcgccgcagccgagcggcgcgctgccgtcgttgctgcgcaccacggtgatttcgccgaggctggtgtggacgcggtacagccattggctgccgaagaagtagctgtcgaggactttgccttgcacgcggccgctgccggcagccaccaaggtgattttttccgggcgcaggctcagggtcagctcgccgtcgccgctggcatggcgtacttgtggggtgccgagttcgtcgtagtcgccgggcagcaggttggccttgccgacgaagtcggaaatgaagcgcgtgcgcgggtgttcgtagagcgtgtacggcgcgtcgatctgggtgacacgcccggcctgcatcaccaccacgcgatcactgatcgacagcgcctcggcctggtcgtgggtgaccatcaaggtggtgatacccacggcgcactggatgcggcggatttcaaactgcatttcttcgcgcaggttggcgtcgaggttggacagtggttcatccagcagcaacaccggcggctcgatcaccagcgcgcgggccagggccacgcgctggcgttggccgccggacagctcacgcgggtagcgctcggcgtgtggggccaggcgcaccagttccagcacggttttgaccttgctggcgatctcggcggccggcactttgcgcatcttcaggccaaaggcgacgttgtcgcgcacgctcatgtgcgggaacagtgcgtagctctggaacaccacgcccaagccgcggctggcgggtttggcgtgggtgatgtcgcggccgtcgagcaggatttgcccgccgctcacgtcgacgaagccggcaatcatctgcaaggtggtggttttgccgcagcccgaggggccgagcagggaaacgaactcgcctttttccaccgcgaggtcggtggcgaccaccgcatcgacggcgccgtagcgtttgctcaaggcgttgagttggagaaatgccatgtctgcgttccaccttttttgagtcgcgtcgaaacgcgcttttttgttttgggcagatgcgaatgaggtgttgccggtgcgttggcgctcgatcttgagtcggctgccgtttgttgttcatttcgcccctgtggacgcagattaggacgaagactaggatgggcggaagatggaatttcactcaatggactattattttcagatttattcattcaccagaatttataccgagattaagtgttatggattccactgagcggaatgacaacagcaaagaagtcggtgccggcagcgtgtcgcgtttgttcgcgctgctgcgtaccctgggcgaggtgccggaaggcggcgagcgcgtgacccaactggcgcaacaggtcggcctgtcccaaccgaccacccaccgtctgttgcgcagcctgatggacgaaggcatggtcgagcaggacgcacgcagcaagcgctatcgcctgagcctggagttcttcgccctggcggccaacgcgggcaagaccggcaacctgcgcgacctggtgcggccgagcatgttgcgcttgagtgcgtcgttgggcgattcgctgttcctgctggcgcgcagcggttttgatgcgatctgcctggaccgcagcgaagggccgtacccgatccgcacctttaccggcgacatcggtggccgcgtggcactcggcgtggggcagggcagtttggcgatcctggcgtttttgcccgaggaggagcgggaaacggtgatccgctacaacctgccacggctcaaggactttcacctgtatgacgaggtgctgctgcgttcggaggtcgagaatgtgcggcgcctgggctatgcggcgcgcaacacgggggtgctggaaggcatggcggggctggcggtgccgatcctcaaccgcgacgggcacgcggtggcggcgttgagtgtggcgaccatcagtgatcggctggggccgagccggttgccgatggtggtggagttgctcaagcgtgaggcggcggcgatcgggccgaggatcaacccgtttgatccgaccctgcgccggccttcgcagacgtttggcggctaacccatctcagccctgatgaagatcggctttcctgtgggagctggcttgcctgcgatgcaggcacctcggtgtatcaggcagaaccagtcgatgccatcgcaggcaagccagctcccacattgaccgagtgcagcctgaggttttagggcaatacagatcagcacaccctctgcctgatgtactgagatccaactgtgggagcgggcttgctcgcgaatacggtgggtcagctaaggctatttcaactgatacaccgcattcgcgagcaagcccgctcccacacaagcctcatacacattcagatggcggccagggcgactgacgtcgccgccgtgcgggtctcccacattgaccgagtgcagcctgaggttttagggcaatacagatcagcacaccctctgcctgatgtactgagatccaactgtgggagcgggcttgctcgcgaatacggtgggtcagctaaggctatttcaactgatacaccgcattcgcgagcaagcccgcgcccacacaagcctcatacacattcagatggccgctaaagctactgacgtcgccgctgttcgggtctccacgccgagcttcacatacacatgctccaaatgcttgttcactgtcctggggctcaaccccaggatatcgccgatatcccgattggttttcccgcacgccacccaacgcagcacctccacctcgcgctcggtcagttgaaaccgcgcggatagcagccgttgcgccgatgcgtcctccagcgtcaacacactcggctgtgtcgccgcgcgcgccgagagcaaaatccgtgacgtgcgcaaatgcgccgcgacccgtgccagcacttcatcggtctggatcggcttggtcacgtaatcactgccacccacctcaaaaccttgcaccacgtgcttgctgtcggtcagcccggtcatgaacaccaccgggatatccgcgctggccggttgcgccttgagcctgcggcaggtttcgaaaccgtccaggcccggcatcattgcgtccagcaggatcaggtccgggcgcctgcgttgcacgcggttcaacgcgctgaggccgtccagcgccaccaacaccatgtagcccgcgtcgtcgagggcgtcggagagcatggccaggttgtccggggtgtcatcgacgatcagcactacgccgggttcagtgctgcgggtgagcgcattcatcttcggcctccttgagggttcggttgagttcatccaggcggtagctcttgagtaagccgcgcactttgttgatgaaaggcgcggcgtccggctgatgctccaggatggtgtcgagtttttcatgcaggccgcgtacgtagccgatggcgctgagttcggcgagggcggcgaggtcttccgggctgggcagtacgctgggtggcgccggcggcgtgaaggttttggtacggcgcagccactgcagatccaggtgcagttgcaggcgcccgagcagctccggggtgcgcaccggcttggccaggtagtcgttacaggcggcggcgatactgcgttcgcggtcgtcggtaaaggcgttggccgagatcacgatgatcggcgcgctggacagcgcgttacgccggatcaagcggctggtttcccaaccatccagggttggcatcgacaggtccatcaggatcaggtccggcgccagcagcgccacctggcggatggcgtcctggccattgctggcctggatcacttcaaaacccagcggcgtgagcatgccgctgagcactttgcgatggtccacatggtcgtccaccaccagaatgcgtcggcgcacgccgtgatagccgatgatgtcgtgttcgacgtgcaccacggcttgcggcgcgcgcacttgcgagaggaacagccgcacatgaaagcacgtgcctttgtccagttcgctggtgacgcgcaactcgccgcccatcaaggcggtgagcatgcgtgtgatggtcaggcccaaaccgacgcccttgtcctggcgcatcaaatcgccgcgttcgaacggctggaaaatccgctcgatctgcccgggatcaatgccgatgccggtgtcgatgatttcgaaattagcggtctcgcgccggtagctgacacgcaggcacacctcgccgctgtcagtgaaattcaccgcgttgccgagcaggttgatcaggatctggcgcacgcgtttttcgtcaccgcgcaccaccgccgggattttgccgacgcagtcgaggcgaaagcgcaggcctttgtcctgggcttgcggggtgaacatctgctccaggtcgtggatcagttcgggaaaggggatttcggtgagttccaggcgcaatttgccggcctcgatcttggccacgtcgagcagcccgtcaatcaacgataacaggtgcgagccactgcgcaggatggtcgccagggcgtcctggtgctggtcgggcatggcggtgtcgcgctgcaggatttgggtaaacccgaggatgctgttcagcggcgtgcgcagctcgtgggacagcccggtgacgtagcggcttttggcggcgttcgcagcttccgaggcttccttggcctgttgcagggcttggtcggtgaggctgtgggcgtcgatttcctgcatcagcagcagggtctggcggtcggattcttcctgggcgacgcggcggctttcgcgggtcagcaccacccaccaggcgagcacggcggccagtaccgacagggtcaggaacgccttgaaaaacgcctgatacaaggtctcggaatgcggcagcccttgggcggcctgcacgtaaatcaacgccagggcgccggccagcaacagcaccagcaccaataacagccccaagtaatgcgccagccgcgtgtgcaggcgcggcatcaaggtgttgggcagcagccagcgcaatacgccttcgaactgcgtgaccagccgcgcatggggcttgcaacggtcgccgcaacgcgcgtccagcgagcaacacagcgaacagatcggcgtgctgtaggccgggcagaacgccatgtcggcggtttcgaacgggttgctgcacagcccgcacaccgcgtgggtggcgggcgccaccgggtgaatcaagtgcagatcgctggtgcgcgcgatgtagtacttgcccttggtcagccaggccagcagcggcgccatgatcaacgccgtgcccagcgccacgaacggcggcgcggcctgggccagggcaccaaacagaccgaagtgggcgaggatcgacagcaacgaggcaatcagcatcgagccaacgcccaccgggttgatgtcgtacaggtgcgcgcgcttgaactcgatatgtttgggcgacaggcccagcggcttgttgatcaccaggtccgccaccagcgtgccgatccaggcaatcgcaatgttcgcgtagagccccagcacctggtcgatcacatcgaacacgcccagctccatcagcatcagcgcaatggccacgttgaacaccagccacaccacgcggccggggtggctgtgggtgacgcgggcgaagaagttcgaccaggccagggacccggcgtaggcgttggtcaggttgattttcatctgcgagatgaccacgaacagcaccatcgcgccgagcgcccattccggcgagctgaacacgtagcggaacgcgacgaggtacatctgggtcggctcggcggcgcgttccatggggatttcatgttgcagcgcgaggaaggcgaggaacgccccggcgaacatcttcagcgcgccggggatgatccagccgggcccggcgcagagcagggcggcccaccagcgcttgcggttggcggcggttttttccggcaggaagcgcaggtagtcgacctgttcgccgatttgcgtcaccagcgacagcgccacggtgcaagcggcgcagaacgccaacaggttgaacccgccgctgtcgccgctgcgcccgacaaagctggtccagtcgctgaaggcgtcggggtttttccaccagacgaaaccgtagggcagcaccagcaacagcagccaaaggggttgcgtccacagctgcaggcggctgatcagggtcacgccgtaggccaccagtggaatcaccagcagcgagcagatcacataggcgatggccagcggaatgtggaaatacagctccagggccaaggccatgatcgccgcttccagggcgaaaaacaggaaggtgaagctggcgtagatcagcgaggtgatggtcgagccgatatagccgaagcccgcgccacgggtcagcaggtccatgtccacgccataacgcgcggcgtaataactgatgggcaggccggtgaggaagatcaccaggctgacggtgaggattgcccagaaggtgttggtaaagccgtaactcaaggccagcaccccgccgatggcttccagcgccaggaatgaaaccgcgcccagggcggtgttggcgatgcgcagttccgaccatttgcgaaacgacttgggggtgtagcgcagggcgtagtcttccatggtctcgtcggcgacccaggtgttgtagtcgcggcggatcttgacgatgcgctgggtgccggaagaagggtgcacggtgggaggctccggggagtgggcgaatgtgaatgagcaagttccatgccccgattcaaaatgtgggagcccgctcgccacagcaagcccgctcgccacaacttgctcgaaaatggtgcaatgtggcatacgtcaaatgacgtacgccgttacgtcaggctgcgtatacccgcgctggcccgctgccgccatgctgaacccctcattgcagaggagtcgccccatggcaccacgattgattcgctccaaaccgctgttggccttgtccttactggcggccgctctgttcagccagggcgtgctggccgataacgaaggcctggccgtgacccccaccgaagtcaccgtcggccagttgcactcggccaccggcaccatggcgatttccgaaaccggctcgatccaggccgaacgcctggccatcgaacagatcaacgcgtcgggcgggatcctggggcgccagatcaaggtgattcaggaagacggcgcttccgactggccgaccttcgcggaaaaagccaagaagctgctggtcaacgacaaggtcgccgccgtgttcggctgctggacctcggcttcgcgcaaagccgtgctgccgatcttcgagaaagaaaacggtttgctctactacccgaccttctatgaaggcctggaacagtcgaaaaacgtgatctacaccggccaggaagccacccagcaaatcctcgccagcctcgactggatcgccaagaccaaaggcgccaagaccttctacctggtgggctcggactacatctggccgcgcacctcgatgaagatcgcgcgcaagcacattgaaaacgtgctgcacggcaccgtcgtcggcgaagactactacccgctgggcaatacccagttcggctcgctgatcaacaaggtcaagctgaagaaaccggacgtggtgttcgccgcagtggtgggcggctccaacgtggcgttctacaaacagttgaatgcggcaggcgtgaatgcctccaaacaaaccctgctgaccctgtcggtcaccgaagacgaactgctcggcatcggcggcgaaaacatggccggtttctatgcctcgatgaagtacttccagagcctggacaaccccaacaacaaagccttcgtcgaagccttcaaggccaaatacggcaaggacgcggtgatcggcgacgtgacccaggcggcgtacctcggcccgtggttgtggaaagcggcggtggagaaggccggcagtttcgacgtggataaagtcgtcgcagcgtcgcctggtatcgaactgaaaaccgcgccggaaggctacgtgaagatccacgagaaccaccacctgtggagcaagtcgcgcatcggtgaagtgcagccaaacgggcagttcaaggtgatctacgagtcggatctgatcgagccgaatcctttccctaaaggctaccaataacctcaagtctggcattgatctaaatgtggtaactggctttgtgtgggagctggcttgcctgcgatggcatcacctcggtgtaactgaaagaccgagtcgccagcatcgcaggcaagccagctcccacataaatcaacagcagaatgcatttcaacctcccgctcaggagaccatcatcatggaatggctatcggaatttggagccatcgcggcgatgcaggggttcaacggcttgtccgtgttctgcgtgctgttgctgatggcattggggctggcgatcatctttggccagatgggcgtgatcaacatggcccacggtgaattcctgaccatcggcgcctacaccacctacgtgtgttccagcctcaccgcgcactttgcgccgagctttcaaccctattactttttcttcgccatcgccctgtcattcctcgtcgccggtgccgtcggctggctggtggagtgggcgatgatcagccggttgtacaagcgcccgctggacaccttgcttgccacctggggcttgtcgctggtgatgcagcaaacctttcgctcggtgttcggtgcccgcgaagtcagcgccgaaccaccggcctggctgatgggctcggtgaacttcaccgatgccatcgagatcccgcgcaacggcctgttcatgatgggcctgaccttgctgctgacgggcgcgatcttcctgatgttgtaccgctcgcgctggggcctgcaggtgcgcgccaccgtgcagaaccgcctgatgagccgcgcagtgggcatcaacacacgcaaggtcgaccgcatgaccttcgccctcggctgcggcgtcgccggtgttgccggtgcggcctttaccaccatcggttccaccgggccgacggcgggttcgcagtacatcgtcgacaccttcctggtggtggtgttcggcggcgcgcagagcctgttcggcaccattgcttcggcgttcgtgattgcccagacccagtcgctgtcggagtttttcctcagtggttcgatggccaaggtgctgaccttgtcgtcagtgattctgatcctgatgctgcgcccgcaagggctgttctccatcaaagtgcgcaagtagaggcgagcagatgaaggctttagacaagctgctgggcggccagcaaaacctgatcggcattgtgctgttggcactcctgattctggtggtgttccccctgaccctcgacgcgttccgtttgaacatggtcggcaagtacctgacctacgcgttcgtcgcggtgggcctggtgttgtgctggggctatggcggcattctcagcctggggcagggcgtgttctttggcgtgggcggctactgcatggcgatgttcctcaagctggaagcgtcggaccctgagagcaccaaaatccagtccacaccgggcattccggactttatggactggaaccagatcaccgaactgccctggctgtggcagccgtttcatagtttcagctttaccctgtttgcggtgatcgccgtgccggtgttgctggcatttatcatcggcctggcgctgttcaagcggcgcgtgggcgatgtgtatttctccatcgtcacccaggcgattgcgctgatcctgacggtgctgattgtcggccagcaaggcctgaccggtggcgtcaacggcatcaccgacctcaagaccctgctcggctgggacctgcgcaccgacagcgcgaaaatgatcctgtacttcatcaacgccagcttgctgtttggctgcatctttatcggccgctttatcctcgcctccaagctgggccggttgctgatggcgatgcgcgacaaggaagaacgcgtgcggttttccggctacgacgtggccagtttcaagatcttcgtgttctgcgtggccgccgcgttttcggcgattggcggggcgatgtttgccttgcaggtgggctttatgtcgccgtcgttcgtcggcatcgtgccgtcaatcgagatggtgatttttgccgcggtgggcgggcgcatgtcgctgctcggcgcggtgtatggcgcgctgctggtgaactacggcaagacgtatttttccgagtccttccccgagttgtggctgtacttgatgggcgggctgtttatcgccgtggtcatgtacttccccaacggtctggccggtttgtgggagagccacgggcgccaggcgttggcgaaattgctgcggcgcaaacccgtggccaaggccccggtcaagcctgtggctaaaagcaaaatcctggagacccaaccatgaccgccgtcggctttgaaatgaaaaaaccggtgctggccatcgaaggcctcaccgtgtcgttcgacggcttcaaggcggtcgacaacctcaacctgtacatcgaccgcaacgaggtgcgcgtggtgatcggccccaacggcgccggcaaaaccacggtgctcgacctgatctgcggcaagacccgcgccaccagcggcagcatccagttcgacggccaggaactgaccaaaatgcgcgaatacaacatcgtgcgggcgggcgtggggcgcaagttccagaacccgtcgatctacgaaaacctcacggtgtttgaaaacctcgagatgtcgtatcccgccgggcgcaaggtctggggcgcgctgtttttcaagcgcagcgcccaggtggttgcgcgggtggaagaagtggcacgggaaatcttcctcggagatttgctgcaacagcaggctgacctgctgtcccacgggcaaaagcagtggctggaaatcggcatgctgctgatgcaagacccggagttgctgatgctcgatgaaccggtggcgggcatgagcgtcaacgagcgcgcgcaaaccgccgagttgctcaaccgcatcagccagggccgctcggtgctggtgatcgagcacgacatggagttcgtcaaaagcatcgcgcataaagtcacggtgctgcaccagggcaaggtgctggccgagggcagcatggagtcggtgcaaagcaacccgaaagtcatcgaagtgtatttgggccactgaggagtccggcatgttcaagatcgaccagttgtcctgtggttacgggcagagccagatccttcacgatctgcagttgaacgtggccaagcgcgagatcgtcgcggtgatgggccgcaatggcatgggcaagaccaccttgttcaagagcctgatgggcatccttcctcagtggaaaggccaggtcagtgtggacgggcacgacgtgtcggcactggagacccatgagcgcgtggcgcgcgggattgcctatgtgccccaggggcgcatgattttcccgagcatgacggtactggagaatatccagaccgggctgccggcgtcggcacgcggcaaggtgccggaagatctgtatgcgctgttcccggtgctgcatgacatgcagtcgcgcaagggcggcaacctgtcgggcggccagcaacagcagttggcgatagcgcgggcgctggcgacaaatccgaaagtgctgttgctggatgagccgaccgaagggattcaaccgtcgatcatcaaggacattgcgcgcacgttgaaggaaatccgccatttgcgcgatctgacgattgtggtgtcggagcaggtgttgtcgtttacgttggagatcgcggatcggtttttggtgattgagaaggggcggtttgtggtggaagagacgcgggatcgggtcgacgaggcaagcattagccggtatttgtcggtttgagtcatggcggcctgagcacattggctacctgatcttccccgtaattggatatttctcctgacaacagcggtgactactctagcgaccaatccccaccgttctggagtatcaccatgcaaacccgtaccgatttctacaccgcttccccagacgccatgaaagccatgctcgccctggaaaccgctgtcggcaaactgtctatcgagctgccgctgctggaactggtgcgcctgcgcgtctcgcaaatcaacggctgtgccttctgcctcgacatgcacaccaccgacgcccgcaagggcggcgaaaccgagcgccgcctgtacaccgtgtccgcctggcgtgaaaccccgttcttcaccccgcgtgagcgcgccgcgctggcctgggccgaaagcctgacgctgatcagccacacccatgctcccgatgaagacttcaacgcactcgccgccgagttcagcgcgcaagaacaggtcgacctcagcgtggccattgccaccatcaacagctggaaccgcctggcggtgggctttcgcaagatgcccaagtaactagaagttgaccgatgcactcaagcgcgccgttaacggcgcgccctggaacaggtagtcatcgcccatgtattcgccggcgtcgcgccagtagcgcttgtcgaacaggttgtcgacgctcaggcgaaacaccgtttcatagccgtcaaccctggtggtgtaacgactgccgacattgaccaccgcataatcccccacctgcacattgccggtgcggttggcgtacttcttggcgctgtattgcacgccgcccagcacggccaggccattgacccacggcaacgcgtagtcggcgtacacactggcgcgcagcttgggcacgttgatcgcctggtggccttcgtagtccggcgtgccgctgtcgtttacccgtgcgcgaatcgccgccacgctcgttgcaatctgcaggcggtcggtagcccagccattggctgacaattcaaccccggtgttcttttgctggccttgttgcacgtaggtgaagttgccggcgccatccggcttggcgtactggtaggcctggcgtgtctggaatacggcggcggcgaagctgatgcggcgccagtcgtatttcaccccggcttcgagttgccttgagacggttggggccagggtttcactttgattggtggcaaaccagggcgctgtgccacccagcgacaggcctttgctgtagctggtgtaaagcgagatgttttcaatcggcttgtagatcagcgcggcttggggcaggaatacgtattgttgggtgtggcgcgcttcggtgccgttctcatcgaaggctttttcatccaggcgcacttcgcggccgccaaggatggtttgccaatgctcgttgaagcgaatgcggtcggtgacgaacaggccgtactggcggctgtcgaggttgcggtggctgtcgttcagcggtttgtcggtgggcgcgaaggtgggggcatcctcgttgatattgccgctgccgatgtagtcgttgaccgcctcgcgcttgtcgatcacccggcgaaatgcgctggtgccgaaagtcagttcatggcccaggcctgcggtgtcgaacagcccggtcatggccgcctggacttcatcgtcacggcgggtgtcatcggggctgcggtagtcgtagatgtcgtagtcgccctcagggctgaaggtgttggcgttgcaggtgcctacgtaataacagccccacgcaaaagagctgtaatcatcaatcaccaccttgctgcgcgccgcactcacgctgcctttccactgatcgctgaagcggtattcaaacttgccattgaggttcagcgagtcgattcccacctgatgcgaaccactctggtgccccagcagtttcttcggcgacgcatcgtgcggcacctcagtgccgcccagcaactgataacccggcaccgagcgctgttgcttgttctggtactccgcatccagttgcagcagcgcgtcggggctgatgttccagtcgaaggccagcgacacaaaatcgcgctggccattggcgtgttccacataggaattaaggtcttcatgggcgacgttggcgcgcaggccaaactgctgctcgctgccaaaccagccgccgatatcggtggcgatataaccgctgccacggtcatcggtggacaccgtcactgagcgcacatcttccgggcgcttggtcacgtagttgatcacgccgctgggctcggaaatcccgctctgcaaacccgccaggcccttgagcacttccacttgctgcttgttttcgagggcgacgttctgctcgccggtgatggtgcgcccgttgatcttgtagctgctcgctgcgttcaacgagaaaccgcgcaccacgaagttttcgtagtagccgatgggggcatagctgtcgccgaccgaggcatcgttgcgcagcacttcactgagcaggcgggcttgttggtccttgagcatggcggcgttgatcacggtgatcgaggcgggggtgtcgagcaacggggcttcgttgaagccgccgaccgaggcggtatccgcgcgatacccggactcatcctggccctggacgttcaccgccggcagttctatctcggctgccaggctgttgccgatgctgccgctaagcagcaggccgagggcgaaacgtgaagtgacgacaggacgaaaacgcaaaaccatggggcagggcctataagcgcggggcggagagggcgcataagctaggggtatgtgcgaggttttacaagttattgagaatggttctgccaaatgtgggagctggcttgagtcagaagcagcacacatccctacctgatgtacccagaacccacaatttgaccgagttcaactgccaggaccgcagtgccctgcttttctgtgggagcaggcaagccagctcccacaggtggttttgcatttcagcaggaccgtttgagggtttcgctgggcagctctttgaacagcgcccggtaactgttggaaaaccgccccaaatgccagaacgaccagttcatcgccacttcggccacggtggtgtcggctgcggtcagcagctcgcgccgcgcgccattcagccgccgcagccgcagccactgcgccgggctcatgccggtgtaggtcttgaagccttgctgcaattgacgcaacggcacgccggcaatctgcgcgagttccagcaggttgacggtttcgtccggcgcgtccgccgcccattcgccgatacgtgccatcaaccggcgttcttcgccgcgccgttgcaacgaattgcggtccaggcacacgcaggcgttgtcgaggataaacagacagtcatcgagcagttgctgggtaagcgcatcgcggctgatcgggtcgacggtcgcggccaggcgggtgagggtgccactgagccagcgggtgaacagcgcattctgctggcaggtcagcggcgccatgaacaggccttcgagtttcgccacatccaggccatggcgctgcacgaactgcgggccgaacaccacggccacttcgcggtagttttccggagtgatccaggtgttgcggctttcgccattgagcatgtacagcgcgttgtcgctgccgtcgaaacagaatgccaacgagccgggcggcgcgttgaagtgctgctccacgcgggtgttcatgcattcctcgtagacctcgacgccttgcaggtcgaggtagcgaatctgcccggcgaaatgccctggggacatctgctggtactgctgcacccaaccgggtgtcgcactgcattgagcggccacatcaccggtggtgaaggcctgtacgcgcaaagctgttgcctgtgtcatgggtgatccgtgcgcactctattggtgcgttgtggttcgtgcaaagtggatagatgccgtttcaaggctggcccaagatagacctcaatgcgccgagagtacaagccggcgcatgcacccaacccatgacgaggtctttatgaacgcccccttcgatcagctgcacgcctggctgaaagaacacaagattaccgaagtcgaatgcgtgatcagtgatttgactggcattgcacgcggcaagattgcgcccaccaacaagttcctgcatgagcgaggcatgcgcctgccggaaagtgtgttgctgcaaacggtaaccggggactttgtcgacgacgatatctactacgacctgctcgacccggccgacatcgacatgatctgccgcccggtggccaacgccacgtatgtggtgccgtgggccatcgagcccaccgccattgtgatccacgacaccttcgacaagcagggcaacccgattgagctgtcgccgcgcaacgtgctgaagaaagtcctgcagctgtacaccgacaagggctggcagccgattgtggcgccggaaatggagttctacctgacccagcgctgtgaagacccggacctgccgctgaaaaccccggtggggcgttccggtcgtgccgaaaccggtcgccagtcgttctccatcgacgccgccaacgagttcgaccccctgttcgaagacgtctatgactggtgcgaactgcagggcctggatctcgatacgctgatccacgaagacggcccggcgcagatggaaatcaacttccgccacggcgacgccctcgacctggccgaccagatcaccgtgttcaaacgcaccctgcgcgaagccgcgctgaagcacaatgtggccgcgaccttcatggccaagccagtggccgatgagccgggcagcgccatgcacctgcaccagagcgtggtggagatcgccaccggcaagccagtgtttgtcgacgccgacggcaagatgagcccgctgtttttgcaccacatcggtggcctgcaaaagtacatccccaaactgctgccgatgttcgcgcccaacgtgaactcgttccgccgcttcctgccggacacctcggcgccggtcaacgtcgagtggggcgaagaaaaccgcaccgtcggcctgcgcgtgccaacctccagccccgacgcgatgcgcgtggaaaaccgcctgccgggcgcggatgccaacccgtacctggcgattgccgccagcttgttgtgcggctacctgggcatgatcgagcagatcgaaccgagcgccgccgtcgaaggccgcgcctatgagcgccgtaacctgcgcctgccgttcaccctcgaagacgcgctggcgcggatggaggattgcgacacggtcaagcagtacctgggcgacaagtttgtgcgcggctacgtcgcggtcaagcgcgccgagcatgagaatttcaagcgggtgatcagttcctgggagcgtgagttcctgctgttgagcgtctaaaaaaatctaaaggggtgtcgatatgcgtcttgtgaaaaagcttctcccgctggccctggtggcggcgttcagcagtgccggccaggccgcgccgacggtcagtgtgtataactggaccgactatatcggcgagaccaccttggccgatttccaggccaagaccgggatcaaggtgatctatgacgtgttcgactccaacgaaaccctggaaggcaagctgctcgccggccgcaccggttatgacgtggtggtgccgtccaaccacttcctcgcccgccaggtgaaggccggcgcgttcctcaagctggatcgctcgcagctgcccaacttcaagaacctcgaccccaagttgctcaagctgctggagaaaaacgaccccggcaacgcccactcggtgccgtacctgtggggcaccaatggcatcggctataacgtcgacaaggtcaagcaagtgctgggcatcgaccatatcgattcgtgggcggtgttgttcgagccggagaacatcaagaagctgcacgagtgcggcgtcgccttcctcgattcggcggatgagctgttcccggcgatcctcaactacatgggcaaggacccgcgcagcgagaacgccgaagactacaaacaggccgaggccaagctgttgacgctgcggccgtacatcacctacttccattcctccaagtacatttcggatttggccaacggtgatatctgcgtggcgttcggttattccggcgacgtgttccaggccgccaaccgcgccaaggaagccaagaacggcgtgaatatcgcctactcgattcccaaggaaggctccaacctgtggttcgacctgctggcgattcccgccgacgctggcaacccgaaagaagcccatgcgtttatcaattacctgctcgaccccgaagtgatcgccaaggtcagtgcctcggtgggctatgccaacgccaacccggccgccaagccgtttatggccccggagctggtgaacaaccctgaggtgtacccgcctcaggaagtgctcgacaagctctatatttccaccacgccaaccccggcgaccatgcgcctgatgacccgcgcctggagcaaagtgaagaccaataaatgatccagtcccaagaccacgcccggtcttactaccgggcctcggcgaatgccatgcctgagcgcccatcgctgggcgccgacctcagcgccgatgtgtgtgtgatcggcggtggtttcaccggcgtcaacaccgccatcgagctggcccagcgcgggctctcggtgattctgctggaggcccggcgcatcggctggggcgccagcgggcgcaacggcgggcagttgattcgcggcatcggccatgacgtgtcggggttcgccaagtacgtgggcgaggagggcgtgggttacctggaacgggcgggtattgagtcggtcgcgctggtgggcgagcgcattcgtcagcaccgcattgactgcgatttgcgctggggcttttgcgaattggccaataccccggcgcagttcgctgcgttcaagggcgagcaggatcacctggcggcgcttggataccgccatgaaacccgcctggtcggcccacaggatatgcatcaggttgtcgactcggcggcctatgccggtggcttggtcgacatgggctccgggcacctgcacccgctgaatctggtactgggcgaggcgcaggtggcagaagccctcggggtgcggattttcgagcacacccaagtactcgaactgatccatggcgacaccgtgcaagtgcgttgcgccggtggcacggtgcgcgccgctcagctggtgctggcgtgcaatgcgcaccttgaggagcttgagccacgcctgagcggcaaagttcttccggccggcagttacatcatcgcgaccgagccgttatccgaagccgtcgccgagcaattgatcccgcaaaacctggcgctgtgtgaccagaaagtcgggctggattattaccggctttccgccgaccgacgcctgctgttcggcggcgcctgccactactccgggcgtgatccggcggacatcgctgcctatatgcgaccgaagatgctcaaggtattcccacagctggcaggcaccgccgttgagttccagtggggcggcatgatcggcatcaccgccaaccgttttccccaagtcgggcggttgcagcagcacccgaatgtgttttacgcccaaggctattccgggcatgggcttaacgtgacgcattggtgcgcaaagttgttggccgaggccattcatgccggtcacagccagggcctggatattttcagccaggtgccgcacatgacctttccgggcggcaaggcgttgcgttcgccgctgctggcgctgggcatggtgtggctgcggctgcgcgaagcatgcggcgtgtaaccgacaggtgctgatgtggaaaggatgaagggtcttttccacggcacttttgcgacgggttggctactgaccgtacggttagttaccagccctggaatctttacgtaaattccgccccgcacaactttgtccagggaggatgcgtatgttcgatatcaatcaacaccgtcacgattacttctacaacctcgccaccgtcatcggcgggctgatccccgatgagctctgcgatacgctcgccaaacgggtcaacagtatcattgcggtgcagggcgtcgactgggtgaagcaccaagggctgggcaccgatgcggtgtcggacctgggtggcctctacaaccaccacattttcaagggcgacgatatccggcgttatgtgccggaactgaccgcgatctaccacagcctggtgccgctgatcagcctcatcacccacaccgacaccgtggtgtcgccgtacccactctgcgatatcaatatcaaggtctacccgccgggtggcggcagccttgggctgcactacgacaccaacggcattaccgtcctgctgttcctgaccaccaaccaggaagcgccgctgtgcatgcagatcgagcgtcatcaccccagccaggaaaaaccctggatccagtaccgccgaatctacgccaccaaaggctcgctgttgatcatgcagggccgcaaaaccctgcaccacagcgagccgacggtgaccgagcaaaagctctcggtggtgtacaactactacgagcgccacgacacctatcgccacgaagactttgacacgctcatgtactgcggcaagcagccgaagacgctggcatagcgcgcgtgccgtggttgacggggcgcctcagatcaaccctggggctcagtcaacaccttcctgaacgtttccaccagcggccgcaaattgacccgatgccacgccgcccacagcggtgtggtgtagctcagccacggcaactcgcgcagcaccacgccgggcggggcattgcggctcaggcctttttgtaccatcgccaggcccaaccccgaagccaccaggcccaacgccgtaaatggctcgctggcttccatggggatttgtggagtgaaaccggcgcggatgcaggcggcgacgaagtcgtcggcggggttggcgccgggtttgcgttgtacgccgatccactcctggtcggccaagtgcgcgggcagcagctcgctatggcgcgccaatggatgatgctcgggcagggccagcagcatcggctcgtccagcacttgcagcgcggtcaggtccgggtcggcggcggcgggtggctcgccgaccagggcgatgtccaggctgcgttggcgcaaaccttcgagctgttccagggacggcaagttgtacagcttgatatgcacggtgggccggtcgtcgcgcaatacccgcaaggcattcggcagcacgccggcatgcatggcgttttcgatatagccgatgcacaacccaccttcttcaccccggcccagccgtttgcccaacgattccaggcggttggcgtgggtcagcagcgccttggtttcggccagaaacgtctggccgtcgcgggtcaggcggatgcgttgctggctgcgttcgaacagggtcaggcccaggcgttcttcgagctgggcgatctgccggctcaagggcgattgggaaatgtgcaaacgctcggcggcgcggccgacgtgttcttcttctgcgacgacttcgaagtagcgcagttggcgtaaatcgatcatgtaagacctgcgaggactcaagtaggtcgcagtatgtcttggacggtccgatctaggcaatctaggatctgctcaacggtcacagcgaccctgaacccaattgaggaatcaccatgagcttgaaagacaaactgcccggccaactgggctttggcaccgcaccgctgggcaatatgttccgcgccattcccgaagacgaggcccaggccaccgtcgaggccgcctggaacagcggcgtgcgttactttgacaccgcgccgttctacggctcggggctgtcggaaatccgcctgggccaggccctgtcgcaatacaaccgcgatgacttcgtgctcagcaccaaagtcggccgcgtgattctcgacgaagtcgaagagagcgcccgcgacctcggcgaaaaaagcggcgtatttgaacatggccgccccaacaaaatgctcaacgactacagcgccgacgccaccctgcgttccatcgaagacagccttgagcgcctgcaaaccgaccgcctggacatcgtgtggattcacgacatcgcccaggacttctacggcgaccagtggctggactacttcaatcaggcccgcaccggcgctttcaaagtgctgacccgcctgcgtgaagaaggtgtgatcaaggcctggggcctgggcgtgaaccgcgtcgagccgtgcgaactgaccctggacctgacggaagcgcagcccgacggcttcctcctggccggccgctacaccctgctggaccatgagcgcgccctgcaacgcttgatggacgcagccctggcgcagaacgtcgagatcgtcgtcggcggcccctacagctcgggcattctggccggtggcgcgcacttcgaataccagaaggccagcccggcgatcatcagcaaggtcgagcagatcaaagcgattgcccaggcgtttggcgtcagcgtgaaagccgcagcactgcagttttccctggctcacccggcggtggccgccgtgattcccggtgccagtcgtccggggcgcatagccgaagacgtcgcggcgttgtcagagaagattccggcagccttctggcaggcgttgcgcgatgcacagctgatttcggcgcgcgcacctctgccgctttaactcgaggattcaccgatgaaaattgacgtaagcggcaaagtggccatcgtcagcggcagcaccgctggcattggcctgggcatcagccaggcgctggccgcatccggcgccaccgtggtggtgatcgggcgggaagcgggcaaggttgacgacgcgttggcgagcattcgccaggcagtgccgggcgcagacctgcgcggcctggtggcggacctcggcacggctgaaggcgccgagaaactgttcgccgccgaaccgcgcgccgacatcctggtcaacaacctgggcatcttcaatgatgtggatttcttcgacgcgccggacagtgaatggacgcgcttctacgaagtcaacgtgatctccggcgtccgcctggcgcggcattatgtgccaggcatggtcgagcagggctgggggcgggtgatcttcctgtcatcggaatcaggtgtggcgacgcctgcggacatgatcaattacggcgtgaccaaaagcgccaacctggccgtgtcccatggcctggccaaacgcctggccggcaccggtgtaacggtaaatgcggtgctgccggggccgacgtttactgacggcctggagcagatgctcaaggacgccaccgccaagtccgggcgcagtgcgcgggaagaggcggatgtgtttgtgcgtaatgcgcgaccaacctcaatcatccagcgcgcagcgaatgtggatgaagtggcgaacctggtggcgtacattgcttcacccctgtcttctgcaaccacaggtgccgcgttgcgcgtcgacggtggtgttgtcgacagcatggcgatctgaattcttgttatttttttggagtatttattgtggcgacagcttcttctgtaattgaggttccggtttcggccgatcaggtctggcaattgattggcggcttcaacgcgctgccggattggctgccgtttatcgtcaagagcgaggccagtgatggcgggcgtgtgcggcatctggaaacggcggatggcggcgtggtggtcgagcgtctgcagagctttgacaatgtggcacgcacttacagctacaccatcgagcaatcgccgtttccggtgagtgcttacctggcgacgttgcaggttgaggcgttgacggaggcgtcggcgaaggtgacgtggtccggtgtgtttaccccggcagcggggaccacggacgcggcggtggaagagctgtttaccggggtgtacagcggtgggcttgaggcgctgcgggctaacttcccggcttgatgatcgttcccacgctctgcgtgggaatgcctcttgtgacgctctgcgtcacgcgttgggacgcggagcgtcctgggctgcgttcccacgcggagcgtgggaacgatcaaaacaccggcatcgcaggcaagccagctcccacactgttgtgtgggcttgatgatcgttcccacgctctgcgtgggaatgcctcttgtgacgctctgcgtcacgcgttgggacgcggagcgtcctgggctgcattcccacgcggagcgtgggaacgatctgtcgatctgtcactgttttgtggggtttggactattcgggcatcaactgctgccgacactccaacaccaggcacgcgccgccttgctggctgctgccgacttccagcttgaacccgtgcaagttgatgatcgccgccacaatcgacaagcccaacccgaacccgccttgctggtcgctttcatccacgcgataaaaccgttggaacaccgcgtcgcgttctgcagccggaatacccggccccgagtcgtgcacttcgatgcgtgtgctgccggcatcattgactccacgcaagatcacttcgccgcccggtggcgagaacttgatcgagttgctcaacaggttggccaatgcttcgaacagcagcgcgcggtcgccggtgatccacggcagcgaatccggcacttcgaggcgcagctgcaattcgccttcttccgccagcggcaggtaaaagtcatgcagttcgcgcaacagtggcagcgggtccattaccaggaagcctgagcggcgctggtggtcttccagctccgagatgcgcaacagcccacgaaagcgcgccatcagggtgtcggtttcggcaatcgcgtcgtcgagttttaccgcgtaggccgagtcctgttctgcttcctgcttgatacggtacaagtgcgcgcgtaagcgggtcagcggcgtgcgcaggtcgtgggcgatgttgtcgcacacgcccttgacctcgttcatcagcttctcgatacggtcgagcattgcgttgacgatggccgcgagcatgtccagttcgtcacgccggtcggacagcggcaggcggtgcgtcaggtcaccggcgacgatggcctcggcgcttgcctgaatcccgcgaatacgccgcagcgggcgacggcgcaacaagtgccagccggccgcgccggggataatcgtcaaagacagcgcccacagcagggcatgccagataatgcgggtcacgccaaacagcgaaccgttggcgcgcaccagcaccagccagcggccgtcttcggtgtgggtggccacggcgtcgcagctgtccttgggcagtttagggtcgttggagtcgacacaattggccagcgcgtggatcttgccgtccagcggcaggtcgggcggcacggcgcggatcggcccgctcagcggtcgaaattgctcatcgaacaggccgtaggcgtccacgcccttcatgtcgaaggtcatgctggtggtcagggcttccaccagttcttcgccgtcgaagcgctggaacaggtgctggcgctgcataagcgagtgacgcgaaaggtcgcccagataacccgacacttcgtaatacagcacccccatgaggatgcaactccaggccacgaacagcgaactgtacagcgccagcaagcggctgctggaggagcgccagcccttagaggggttcagcaatgacataaccggaacctcgtaccgtgcggatcagcggcgtgaggcccggtggatcgattttcttgcgcaggcgaccgatgtgcacatcgatcaggttggtgcccgggtcgaagtgataaccccagacttcctcgaagatcatcatccgcgacaggatctgcccggtgttgcgcatcaggaattcgagcaatttgtattcggtgggcagcaggctcagcggctgctcggcgcggctggcttcgcggctgatcaggttcagttcgaggtcggccacgcgcagggcggtctcgaactccttgaccgtgcttttgcggcgcagcagcacttcgacgcgggcggccatttcgtcggaggcgaagggcttggtcaggtagtcgtcgccaccggcgcgcaagccacgcacgcgctcgtcgacgtcggagagggcgctgatcatcaggatcggcgtcgacacccctatagtgcgcagggtcgtgacgatggccaggccatcgagttccggcagcattcggtcgagggtgatcagatcgtaatcaccactcacagcacggaccaggccttcacggccgttgtccacccagtccacatccagtccatggctactcagctcggcgacgatctcgcgggctgttacggcgtcatcctcgatggtcaaaatacgggtcataggattacctggtgagcgatacacactagaagtgggggcattttgccaagaaatgcctgaacgcttcctaaattaaacttcatcttggcaaaactgacacaagtttcattggcgctgcctggatctgtgggagctggcttgcctgcgatggcggtgcgtcagttacacattgcttgcctggcagaccgctatcgcaggcaagccagctcccacagggatgctgtttgcggcgagattgcataacgcccgctctttgcggtcatttcttgcaacttgcatggttcaagttagttcaaaatttatatcttgttgaaatataagaagtttattttttagccagactggcatggtgcctgcactgtcccttttgagacttgtaacactatttttcctgccgggagcaaaacaacaatgatcacatcctcatccacgctgcaagagtcaagttcgctctccggggtttcctggggggcgattttcgccggggccgctgcggcggctgcactctcgttaatcctcgtgctgttgggtttcggcctgggcttttcggcggtgtcgccgtgggccgacagcggtatcagcgccaaggggcttggcatttccacgattgtctggctggcattcacccagatcgtcgcttcgggcctgggcggttatatcgccggtcggttgcgcgtgaagtgggccagtatgcacggcgatgaggtgtactttcgcgacaccgcccatgggttcctggcgtgggccgttgccacgctggtcaccgccatgctggtggtcggttcggtcagcagtgtggtcagcggcggcgttaaagccggtgcaggcgtggctgccggtgcggccagtggcttgacccaggccgcaggcagcgcagccaaaggcgccaacggcggcgactttgactactacgtcgacagcctgtttcgcgatgaccgcccagctgccgtcagcgatgacgcggtgcatggcgtcgtagcacgcatcttcacccgtaccctgagcaatgacggccagctggcccctgaagaccgtgcctacctggcccagttgatcagccagcgcaccaacctcagccaggccgacgccgaagcgcgcatcgacaaggtctacggcgacgcccgtaaagccgttgaagacgccaagctcaaagccaagcaagccgccgataccgcagcgaaagtcgcggcctacacctcgctctggaccttcatcaccctgctgatcggtgcgttcttcgccagcttcgcagccaccttcggcggtcgccgtcgggatgccgtggtgtatgtcgagactgaaaactacgttcgttaattaaggagaacatgatgcgctcattactgctgtggttcctcggtgtgcctatcccggtcattattctgatcgcgatcttcatgcactaaacctgagcctggctcggtcccctgtgggagcgggcttgctcgcgaaggcggtgtgtcagttactcatgagttgactggcacaccgctttcgcgagcaagcccgctcccacatttgttttgcgtagtgtcagccagctggtgaggagtagtgcgctcgcgactgaggtcatgatgaccaacggcagcgacgtaccgtccgacaacaacccggtgacccaactgctcacggcagtgagaaacatctgggtgaagaagaacaaccccgacgccgtcccggcaatcgcgccatacggctgcaacactgacagctgacacgctggaatcaccatcccgaccgacaccatgatcaccaccatcggcagcacaatcgccagccacccctgcggcagcgcgacggtggcgcctgcgagcatcacgcagccgagcacattcaaggcgatggcggcgttgatcaaacggtcgggttcaaagcgcagcaccaggcgccggaacaggttcgcgccgagcatgtagccgctgatcgtcgcggcaaataccagcgcgtaagccgtggcagacaggtggtaaccgcgttgcagcagggccgaagactcgctgataaacgggaaatacgtgctgtacacacagccgattgccagggaataacgcaggaaatagcggtctcgcagcagttggccgtagacgcgcagcaggctgctcggcggcgcggcggcgacttgcggtgggcgggtttccggcaggcggcgatacaccgtgaggtacaagccggcgccaattacgccgagcactgcaaacagtccgcgccagctgataaagggcagcatcaggctgcccagcaccggcgcagccattggcgagatggccatggccatggagatcaggccgagcaggcgcgcttgttggtcgcggtcgaaatagtcgcgcacgatcactcggccaatcaccgtggtgcagcaaccgcccaaggcctggaacagccgcgcaacgatcagcacctcgaggccgtcggcgagagcgcagaccaccgtcgcgacgacgtacaggaacaggccggccaacaataccgggcgacggccgaagcggtcggtcaacgggccgctgaccagcaaggaaatcgccgagccgatcgcgtacaccgtgagggtcagttgcagttggctgtcgctggcgtggaagtagtcggccatggtgggcagcgctggcaggtgcaagtccagagtgaggcgcggcagggcgatgagcacggtcagcagtaccagccagaagccgaaggagagggtgcgttgagtcatgggagtcttcttcgcaaagagtagagcccgaactctagcctcattgtggtttaatcctgtgggccacttatgcttgatgggaatggaccactatgagccgaggaaaagccgcctccaacctggacttgccgcgcccggacaccttgggcgcgggcaagcagcagggcgcctacgacgccttgcgcgccgccatcctgaatcgacaactgcccgccggcagccgcttgccgtcgacccgcagcctggccgagcgctggctggtgtcgcgtggcacgttggaagcggcctatgaacgcttgcacagcgaaggctatgtgcagcgggtcgcgggttccggtacgcgggtgtgtgcggtgattcccgagcaattcattgcagccccggcgccgagcgaaacgccacggcgcgtggccgtgcctgatcaactcgatacgggcgtacaaagccatgtgccctttgtggcacggcgcccggatgccggcctgttcgacctcaaagcctgggcgcgctgtatttcccgtgggctgctcgccgccgggcctggcgtgttggaggctgcccatcctgccggcttgcccgcgttgcgcgaacagatcgccgactacctgcgcagctatcgcggcatgcactgcgaggcggatgaagtgatcgtcacgaccggcattcgccacggcctggacctgatcgcccgcaccgtactcaaacctggcgacatcgcctgtgtcgaagaccctggctataaacccgcgcgccgcctgttcagcctggccggcgcgcatgtcctggcgattccggtcacggccgaaggcctggacaccgcccaactgcccgacgctgcgcgcctggcctatgtcacgccggcgcaccaggccccactgggcatgaccctgagcgtctcccaccgcctggcgctgctggattgggccgctcgcgctgacgcctgggtggtcgaggacgactacgacagcgaatacaactacaacagcgcgcccctggcggcgcttaaatccctggactccggcgaccgcgtcatctactgcggcagcttcaacaagaacctgttccccggcttgcgtgtgggtttcatggtggtgcccaaggcgttgcgcccagcgttgctgcgcaccctgcaacttaccgggcactcagtgggcgccacggatcagttggggctggtggagtttctcggcagcggcgcctttgtgcgccacctgcgagcttcgcgtcaggcgtatcaggcgcgacgcgatgcgttgctcggctgtctgccagcggagtgcgcggtgagcggtcagcaagccgggctgcactttgtgctgtggttgccgagcggcattgaggaaagcgagttctgcacccgcgccgccgccgttgggctgacgttgcagccgctgggcaagttctgcgtggacgtccgtttgccacctgcggtgatcatcggctacaccgcattgaccctggcgcagatccgttatcacggccgagtgctcacgcaattgttaatagcggcttaactcgcgcttggctagactcgcgccccatgagccgccttctgcgtttaatcctggtcatgctgttaagcctcacgcttcccctgaccgggatggcgggtgtgccgtcgagcaccgagccttgcccgatgaaaatgtcgagcatgcagatgatgaccgacatggccccggactgctgccaggacggcgtcgaccatggcaaggcctgcaaacctggccaggagtgcaagaccggcggcctgctgcaactctccctggcggtgcttaaggcaccgttgcccctggcgcatccgctggctgccagcctttctgcggatttcatccccgaccgcacgccgtccggcgtctggcgcccaccccgttcctgattccggttgcacctgaagacccatcccccacacgggatggccttgctgtgggccgcataacgcggcgcgcagtggaaccgatcaggaatcttcaagatgaattccctctacctgcgcgccctggtagtgggcgtgctcacatggcccgcgcttgcccatgcgctgaccctggatgacgccctgcgcctggcgcaaaacaacgcgccttcgctgaccgccgaagcggccaaactgcacgcggcaacccaagcggccatcccggccggcgaactgcccgacccgaaactggtggtgggcctgcagaattttcccatcggcgggccgaatcgcggcacgttgtatggcgatgacatgaccgaccaaatgatcggtatccagcaacaggtgcccagccgcgacaagcgcaaggcgcgcatcgagctggccgatgccacggtgcaaaccgctgccgccgaagggcgcattgaacgcctcaacgtgcgccaggccacggcccaggcctggattcgcgcgtacgcggtggaacgcaaagaggcgttgttcaatgacttctaccaacagaaccgcctgctgcaagacagcgtgcgcgcgcagttggccggtgggcgggggcaggccgccgacagcgtggtgcccaagcaggaagccgcggaactggccgagcgcgaagacgaactgacccagcaacgcgcccaggcccgcgccgctctcaagcgctggatcggcgcggccgccaatgaagcccccagcggccagttgccgaactggaccatcgacagccacggctacagccacaacctgcaccagcatccggaactgcaagcctttgtgccgcgcacccgcgaagcgcaagcgcgcgtgcaggaagccaaggcgcaaaagacttcggattggagttgggaggtggactaccaacaccgtggccgtgaatacggcgatatggtcagcctgcaattgagcttcgacttgccgatattccccggccgccgacaaaaccccggcatcgccgccaaacaggcggcgctggaccagttggacgccgagcgcgaagccgccacccgcgagcacacacagatgctcgatgacgcgctggcggtttaccagcgcctggaccgcgcggtgcagcgcagccaggacagcctggtgccgctggccgaagagaaagtcgccctgagcctcgccggttatcgcgcgggcaaagccgacttgatcagcgtcgtcagtgcccgccgtgagctggtcgacgcgcgtttcaaacagattgatgccatcgagcagcgggccttgaccggcgcccagctgtacttcgcctatggggaacccaacaatgaataatcgaatcgcggcagcgctgctgttgctcggcctgggcgggggctacggcgtggcgcaatggcatcccacggcatcggtgcctgccgaaaacgacaaacaggcgctgtattggtacgacccgatgtacccgcaacagaaattcgacaagcccggcaggtcgccttttatggacatgcaattggtgccgcgctatgccgacaacgctgcggcggatacgccgacggtgcagatcgacccacgccaaacccagaacatcggcgtgcgcctggcgacggtcagtcgaggtgtgatgacgtccactttggagctgtcgggaatcctcgcgttcaatgaccgcgatgttgcggtggtacaggcgcgggccagcgggtttgtcgagcgggtttacgcgcgagcgcccggcgatgtactcaaggccggcgcgccgttggcggacattctggtgcccgaatgggcggcggcccaggaagaattccttgccctgcgccgtagcggtgacagtggtttattgagcgccgcgcgccagcgcctgcgcctgagtggcatacctgcggggcttgtcgcacagatggaacgcagcggccgggtgcactcggtgttgactgtcaccacgccgttgagcggcgccttgcaaaccctggacgtgcgcgaaggcatgaccgttgcggcggggcagactctggcgcgagtcaatggcctggatcgggtctggttgcaggtggcggtgccgcaagcccaaggcgccacgttggcggtcgggcaagccgtgacggcgcactttgtcgggttgccggggagcgccgttaacggcgtcgtcagcgcgattctgcccgctaacgccctggacagccgcaccgtgcaggttcgcgtcgaactacccaaccccgacggccacttgcgccctggcatgaccgcccaggtgcgcctggcgcaaaccagcgggcaagcggtgttgcaggtgccgagcgaagcgttgatccgcaccggcaaacgcgtgctggtgatgctggccgaggcgggcgggcactatcggccggtggaggttgaagcgggcgcggaaaaccaggaccagaccgtaattcgcagtggcttgcaggaaggccagcaggtggtcgcgtccggtcaatttttgctggattctgaagcaagtttacgcggtttagtatcgccatcgtccggcacttctgaaatgggcatgcagcccggagcccagccatgatcgccctgttgattcgctggtcggtggccaaccgctttctggtgctgctcgccaccttgtttgtcaccgcgtggggcgtttgggcggtgcaaaacacgccggtcgacgcgttgccggacctttccgatgtgcaggtgatcattcgcacaccgtaccctggccaggcgccgcaaattgtcgaaaaccaggtcacttacccgatgaccaccaccatgctgtcggtgccgggtgccaagacagtgcgcggcttctcattctttggcgacagctatgtatacgtgttgttcgacgaaggcaccgacctctactgggcgcgctcgcgggtgttggaatacctcagccaattgcaggcgcggctgcccgcatcggccaaacccgcgctggggccggacgccaccggcgtcggctggatctatcaatacgcattggtggaccgcaccggccagcacgatctggcgcaattgcgcgcgctgcaggactggttcctcaagttcgaactcaagaccctgccgaatgtggcggaagtcgcgaccatcggcgggcaggtcaagcagtaccaggtgcaactcgacccgctggccctggccagtcgcggcatcacccaggcccaggtggcggacgccatcggcaaggccaatcaggaaaccggtggctcggtgctgaacatgggcgagtccgagtacatggtgcgcgcctccggttacttgaaaacgctcaacgatttccgcgccattgcgctgcgcctcgacagcaacaatgtgccggtgaccctcggcgatgtggcgactattcaactcggcccggacctgcgccggggcatcagtgaactcgacggcgagggcgaagcggtcggcggcgtggtgatcctgcgcagcggcaaaaatgcgcgtgaggccatcgcggcggtcaagaccaaactggagcaattgaaaagcagcctgccgcccggcgtcgagattgtcaccacgtacgatcgcagcaaactgattgaccgtgccgtggacaacctcagccacaaactgctcgaagagttcctggtagtggcgctggtgtgcggaattttcctgtggcatttacgctcgtcattggtggcgattatctcgttgccggtgggcgtgttgatcgcgtttatcgtcatgcgtttccagggcatcaacgccaacatcatgtcgttgggcggcatcgcgattgcgattggtgcgatggtggatgcggcggtggtgatgatcgaaaacgcccacaagaaaatcgaagcctggcatcacgccaaccccaaccgcgcactgaagggcgaggagcattggcaggtggtgacggcagcggcggtggaagtcgggccggcgctgtttttctgtttgctgatcatcacgctgtcgtttatcccggtgttcaccttgcaagcccaggaagggcgcctgttcggcccgctggcctacaccaagacctacgccatggccgccgcggccgggttatcggtgacgttgatcccggtgctgatgggctattggattcgcgggcgtatccccgacgagcagcgcaacccgctcaatcgcggcctgatcaagctctatcaaccggccctcgataccgtgctgcgctggccgcgaatgaccttgctgctggcgctgttgacggtcgccagtgtggcgtggccgctgtcgaaactcggcggtgaattcctgccgccgctggatgagggcgacttgctctacatgccatcggcattgccggggctgtcgacgcaaaccgcaggtgaactgctgcaacgcgccgatcgcctgatcaaaagcgtgccggaggtcgctcatgtgttcggcaaggccggtcgcgccgaaaccgccactgacccggcgccgctggaaatgttcgagaccacccttgagttcaaaccaagggaccaatggcgcgccggcatgaccccggaaaagttggtgaaagaactcgaccgtgtggtgcaggtgccgggcctgaccaatatctggatcccgccgatccgcaaccgcatcgacatgctcgctaccggcgtgaaaagcccgattggcgtgaaggtggccggcaccagcctgatgcagatcgacgcggtgacccaggccgtggaaaaggtcgccaggaccgtgcccggcgtgagctcggcactcgccgagcgcttgaccggcgggcgctatatcgacgtggatatcgaccgtacggccgccgcgcaatacgggctgaatattgccgatgtgcagtcgattgtgtccggcgcgattggcggtgaaaccataggcgaaaccgtggaaggcctggcgcgtttcccgatcagcctgcgttacccgaaggagtggcgcgattcggtaacggccctggacaacctgccgatctacacgccgcaaggcagccagatcaccctcggcaccgtggccaggctcaaggtcagcgacggcccgccgatgctcaaaagtgaaaacgcgcggccttccggctgggtctatatcgacgtgcgcgagcgtgatttggcgtcggtggtgaaagacctgcgtgaagcgatcaaccagcaggtgcagttgcagccgggcatgagcctcagttattcggggcagttcgaattcctggaaagggcgaatgaacgcctgaagctggttgtgccggcgaccttgctgatcatctttgtgttgttgtacctgacgttccgccgcgtggacgaagcgttgttgatcatcgccacgttgccgtttgcgctaacgggtggcgtgtggctgctgtactggcttggcttcaatttatcggtggccacgggcgtgggctttattgcattggccggtgtatcggcggagttcggcgtgatcatgctgctgtacctgaaaaacgcctgggccgagcgcaaggacggtgacttgctggccgccatcaccgaaggcgcggtgctgcgtgtacgccccaaagccatgaccgtggccgtgatcatcgccggcttgctgccgatcctgctgggcggcggcaccggcagcgaagtcatgagccgcatcgccgcgccgatggtcggcggcatgctcaccgcgccgctgctgtcactcttcgtaatccccgccgcctaccagctgctccgccgccatcgatgagtacaaaaaactcccgtgccgagcggccgtgtcgtggcgagcgggcttgccccgcgttgggctgcgaagcagccccattaaggccaccgcgcttctctagttagaatgcggtggctggttttggggccgcttcgcagcccaacgcggggcaagcccgctcgccacaacaagcccgctcccacaggataaaaccatcaccaccaactcagtcatcaaacccaacctgctcatgaatctcatccaccttcaactccaaccgatacgccaccgcaataaacagcgcctggcacaggcacaaggtggcgctcaacgagcgaaacgcaaacgacgacccttcattcaccaacaacaccgcgttcgcccgcttggccagcggcgacaggttgctgtcggtgatgatcaaggtcttggcctgatggtgctgggcaatgcgcaagcaatgctgagtctctttgccgtagggcgtaaagctgatcgcaatcaccagatcgttggcacgcacactgcgcatctgctcgcggtaactgccgcccaaaccggaaatcaagtgaatgcgcttgttggtgtgctgcaggttgtagaccaggtaatcagccaccgcaaaggaacggcgcacaccgaccacgtagatgttgtcggcgttgaccaccagatccacggccttctcaaacgccacatcatccagttccagccccagccgctcgatgcccgacagggtggcattcacgcactcgcgcgccaggtcgccgccgctggctttttgcgacttgttggcgatcatgctgcgaatgcgctgctggtagttctgcaccggcgtggtcttgtgggtgtaggcctcgcggaacaacgcctgcatctcactgaaaccgctgaacccgaaacgctgggagaaccgcacgatggccgaggggtgcacttcacattcacgggcaatgtcgctgatgcggtcgaccatgatccggtcgctctgctggctcatgtagctggcaatgcgtttgagctggcgcggcaggctttcgtattcgtcggtgatcagctgcaacaggcgctcggcattgatcggagggctggcgagcgtggcttccagggtggtctcgggatcggtgcgggacatgggcaatccttttggcttgttcttctgatgcgctgatgggtgggcgcaagtctacagggtaggcgcaaaaaaataccccggcatcacggcagccgtggcccgctgaaacgatgcaggagggctggagtgccattatgctggcttattggaaaaaatattccactaaaaataattatggaataaatattgattggcgctgctgaacgttctagtctgctctcaccaagagcgtgtgccgtcacctcggcggcaccacgcaggctgataaaaataacaggagccagcatgggccagactcgttttgccagtgggcgtcaattggatctgatttgcctcgggcgcctgggcgtcgatctctacgcacagcaagtgggtgcgcggcttgaggacgtgtccagcttcgccaagtacctcggcgggtcctccgccaatatcgctttcggcaccgcgcggctggggcttaaatcggcgatgttgagccgggtcggcgacgaccacatgggccgcttcctggtggaatccctggcccgtgaaggttgcgatgtcagcggcatcaaggtcgacccggaacgcctcaccgcgctggtgctgctgggccttaaagaccgtgaaaccttcccgctggtgttctaccgcgaaaactgcgccgacatggccctgcgcgccgaagacatcaacgaagcctttattgcctccagcaaagccttgctgatcaccggcacgcatttctccaccgacggcgtctacaaggccagcatccaggccctggattacgcggccaagcacaacgtcaagcgcgtgctcgatatcgactaccgcccggtgctgtggggcctggcgggcaaggcggacggcgaaacccggtttgtcgccgaccagaacgtcagccagcatgtgcagaaaatcctgccgcgttttgacctgatcgtcggcaccgaagaagagtttctgatcgccggcggcagtgaagatttgctcaccgcgctgcgcactgtgcgtgaactgaccccggctaccctggtggtcaagctcggcccgcagggctgcacggtgatccacggcgcgatcccggcgcgactcgaagacggcgccgtctacccgggcgtgcgggttgaagtgctgaacgtgctgggcgccggcgatgcgtttatgtcgggcttcctcagcggctggctcaacgacgccagcgatcagcgttgcagccagttggcgaatgcttgcggcggcctggtggtgtcgcgacacgcctgcgcaccggccatgcccacgcctgccgaactcgattacctgttcaacagcccggtgcccatcacccggcctgaccaggacgtgaccctgcaacgcctgcaccgtgtcaccgtgccgcgcaaagcctggaagcagctgttcgtgtttgccttcgaccaccgctggcagttggtggacctggcgcaaaaaggcggccaggacccaacgcgcatcagcgccatcaagcagctgtttatccaggccgtcgaacgcgttgaagccaagctgcgcgagcagggcgttgaagccgatgtgggcctgctggccgaccagcgtttcggccaggacgcactcaacgccgccagcgggcgcggctggtggatcgcacgcccggtggaagtgcagaactcgcggccgctggcgttcgaacacggccgttcggtgggcagcaacctgattgcctggccccaggaacagatcatcaagtgcctggtgcaataccaccccgatgacgagccgatgttgcgtctggagcaggaagcgcagctcaaggcggtgtacgaggcctcgctggtcagcggtcacgaactgctgctggaagtcattccgcccaaggatcacccgtccacctatcccgatgtgctctatcgcagcctaaagcgcctgtacaacctgggcatctacccggcgtggtggaagatcgaagcgcagtcggctgaagagtggaaaaagctcgatgaactgatccaggagcgcgacccgtactgccgtggcgtggtgttgctgggcctgaatgcctcggctgaatgtctcgccgacggcttccagcaagccagccaaagcaccacctgccgtgggttcgccgtgggccgcacgatcttccaggaacccagccgcgcgtggatggcgggggaagtcgatgatgaaacgctgatccagcaagtgcaacacaccttcgaacagctcatcaacgcctggcgcagcgcccgaacctaaacatagctttcaacttgaaatgcaatcaaaagtgggagctgctttttgtgggagccgggcttgcccgcgatgcaggcgactcggtctaactgccgagtcgaggtgatgccatcgcaggcaagccagctcccacaaaagcccgctcccacataaagcagaactcatgcaactttgaaaataacaaaaaggtgcagccatgcccgcaatccgaattggcatcaacccgatctcctggagcaacgacgacctgccggccctgggcggtgaaacgccgctgagcaccgccttgagcgaaggcaaggagattggctatgaaggttttgaactcaacggcaaattccccacggacgccaaaggcgtcggcgatgtgctgcgcccctatgacctggcgctggtctccggctggtattccagccgcctggcacgccgctcggtggcggaagaaatcgaagccatcgccagccatgtcgagctgctgaaactcaacggcgccaaggtgctggtctacggcgaagtcgccgattcgatccagggcgccaaggtgcgcttgatcgagcgcccgcgttttcatagcgagcaggcctggcaggactacgccgacaaactcactgagctggcgcgcttcaccctgtcccaaggtgtgcgcctggcctaccaccaccatatgggcgcctacgttgaatcccccgaagacattgaccagctgatgcgccgcaccggcccggaagtcggcctgctgttcgattcgggccattgctacatgggcggcggcgagcccatcgaggtgttgcgcaaacacatcgagcgcatctgccacgtgcatttcaaggacgtgcgcaaaccggtggtgcaactggcgcgcaaccagatgtggagctttcctgattgcatcgtcaacggcaccttcaccgtgcccggcgatggcgatatcgacttcggcgagctgctcgatgtgctgctggcggcccggtacgaaggctggctggtggtggaagccgagcaggacccggccgtggcgcccagctatatctatgcgaaaaagggctatgacaccttgcgcgcgcttctcaacgagaggacttgagtgatgagcttgttggtcaaaagcagcaaacgtgggcaaaccatggttgccctggaagccgggcgcctggaatacgtgggctttgccgcctaccgcctgagcctcggcgaaaccctgccggtgaccgccggtgataaggagctgtgcctggtgctgctcagcggccgggtgaatatcgagggcgagggcttcaactggcagaacctcggtgatcgccactcggtgtttgaagacaagtcaccctttgccgcctacctgccgcccggcaccgatgcgcagattactgcattgagcgacgtgcaaatcgcggtgtgcgccgcgcccggtgccacaggttttgagccgcgcctgatccggcccgagcagtgcaagcgcagcgtgcgcggcaagggcgccaacacccgttatgtgtgcgacatcttgcccgacagcgagccggcccattcgctgttggtggtggaagtgcgcacgccgtcggggcattcctccagctacccgccgcacaagcacgacaccgacgacctgccgcaccagagctttcttgaagaaacctattaccaccagatcaacccgccgcaaggctttgtgttccagcgcgtgtacaccgacgaccgcagcatcgaccaggccatggccgtggaaaacagcgacctggtggtggtgcccaagggttatcacccggtcagcgtgccgtacggctacgagtcgtattacctgaacgtgatggccggccccaagcgcgcctggcatttccataacgacccgcagcacagctggctgctggacctctaatcggtttgaacggagagcaacaacaatgaagtcgccgctgcgttttggccttaaccgcatggtcgcgcccaacctgtccctgccggatttcattcagttggcggccgcgctcaagtgcgacgccatcgagattcgcaacgacctcaacggccacgaaatcgaattcggcacacccgccagccgcgtgcgcgaattgtgcgcggtgcagggcatcacggtgctgtcgatcaacgcgctgtacccctttgatgtgtggaatgacgagcgccgcgcccaggcgatcaagcttgccacctatgcccgcgaatgcggcgcgcaaggcctggtgatgtgcccgctgaatgagcgcggcgacacgcgcaacgacgcccagcgcgccgccggtttgcgcacggcgttgagcgagctggcgccgatcctgcgcgagtacgggattctcggttttatcgagcccctggggttcgaagaatgtgcgctgcgccgcaaacgcgtggcggtggatgcgatccagtcgattggcggcctggatgtgttccgcctggtgcacgacaccttccaccatcacctggccagcgagcaggagttcttcccgcaactgaccggcctggtgcatatctccggcgtcgaagaccgtgacgcgccgctgaattctatccgcgacggccaccgcgtgctggtgggcgagggcgatatcctcggcaatgccgcacagatcgacaccttgctcagcagcgggtacggcggttacctgtcgtttgagccgtttgcggaaagcgtgcatgcgttggcggatattcagcaggcaatcggggcaagcatcgcccatctacaaaaccctcgaccctgacgctgcttaacctgtgggagctggcttgcctgcgatagcggtctgtcagttgataaatagttggctgatacaccgctatcgcaggcaagccagctcccacattggatctctgttgaacaatggatctgcattcacacaaggtgcaagtgatgaccacaacaagattgaccatggcccaggccctggtgaagtttctggataaccagtacatcgaagtcgatggcgtgcagagcaagtttgtcgccggggttttcaccattttcggccacggcaacgtgctgggcctgggccaggcgctggagcaggacagcggcgacctggtggtgcatcagggccgtaacgagcaaggcatggcccacgccgccatcggtttcgccaagcagcacctgcgccgcaagatctacgcgtgcacctcatcggtcggccccggcgcggcgaatatgattaccgccgccgcaaccgccaccgccaaccgaatccctttgctgctgttgcccggcgatgtttacgccagccgccaacccgacccggtgttgcagcagatcgagcagttccatgacttgagcatcagtaccaacgacgctttccgttccgtgagcaaatactgggaccgcatcaaccgccccgagcagttgatgaccgccgcgatccacgccatgcgcgtgctcaccgacccggccgaaaccggtgcagtgaccttggccctgccgcaggatgtgcaggccgaggcctgggattatcccgattacttcctgcaaaaacgcgtgcaccgcatcgagcgtcgcccgccaacggcagcgatgatcagcgacgcattggccgccttccgtggcaagcgcaagccgctgatcatctgcggcggtggggtcaagtacgccggcgcgaatgccgcgttgcaggcgtttgccgagcgctttgatattcccttcgcagaaacccaggccggcaagagcgcggtggtctcaagccacccgctgaacctgggcggtatcggcgagaccggctgcctggcggcgaacctgctggccccggaagcggacctgatcattggtatcggcacgcgctacaccgacttcaccaccgcgtcgaagtcgctgttcaagcaccctgaagtgaagtttctcaacctgaatatcagcccttgcgatgccttgaaactcgacggtgtacaagtgctggcggacgcccaagtcgcccttgaggcgctggccgatgccttgggcgactaccgcgctggctggggcgagcaggccaccgacgccaaggcccagttggacgcggaagtggaccgcgtgtatcaggtgcaataccagggcgacgactttgtgcctgaggtcgatgaccacctggaccgcgcggtgctgcgcgaatttatcgaactgactggctcgtgcctgacccagagccgcgtactcggcgtgctcaatgacaccctggccgatgacgcgatcatcgttgccgccgctggcagcctgcccggtgacttgcagcgcagctggcgcagcaaaggcgtcaacacctatcacgtcgagtatggctattcatgcatgggctacgagatcaatgccgcccttggcgtgaaactggccgaaccgtccaaggaggtgtacgccttggtcggcgatggctcctacatgatgctgcattcggagctcgccacctcgatccaggagcggcgcaagatcaatgtggtgctgctcgacaacatggccttcggttgcatcaataacctgcagattggcaacggcatggagagcttcggcaccgaatttcgcttccgcgaccccgacagcggcaagctcgacggcggcctggtgccggtggatttcgccatgagcgcggcggcctatggttgcaagacctacaaagtcagcaccgtggaacaactcgaagcggccctggccgatgcgcgcacgcaaacggtgtcgacgctgatcgatatcaaggtactgcccaagaccatgatccacggttacttgtcgtggtggcgggtgggtgtggctcaggcgtccaccagtgagcgcaccaatgcagcggcgaaacaactcaatgaacagctggccaaggcccggcagtactaataacaagaggagtgaaggtatgtctttgaagctgggtgttatcggtacgggcgccatcggccgtgaccatattcgtcgttgcagccagaccctgctcaacagccaggtggtggccgtgaccgacatcaaccttgagcaggctgccaaggtcgtggcggatttgcagctcaccgccgaggtgtacgcggacggccatgcgctgatcaactcggcgcaagtcgaggccattttggtgacctcttggggcccgagccatgaagaattcgtgctcgcggccatcgccgccggtaaaccggtgttctgcgaaaagcccttggccgtcaccgcagaaggctgccgtaaaatcgtcgacgccgaaattgccttcggtaagcgcctggtgcaagtgggcttcatgcgcccgtatgacgaaggctatcgcgcgctcaaggcggtgatcgacagcggccagatcggcgagccgttgatgctgcactgcgcgcatcgcaacccgacggtgggcgagaactacaagaccgacatggcgatcaccgacaccttgatccacgagctggacgtgttgcgctggttgctcaacgacgactatgtgtcggtgcaagtggtgttcccgcgcaaatcgagcaaggccctggcccacctgcgcgacccgcagatcgtgctgctggaaaccgccaagggcacgcgcatcgatgtggaagtgtttgtgaactgccagtacggctatgacatccagtgcgaggtggtgggggagaccggcatcgccaaactgccggagccttcgcaggtgcaactgcgcagcggggccaagctgtcgaatgcgatcctgatggattggaaagaccgctttatcggcgcctatgacgtcgagttgcaagccttcatcgacagcgtgcgcgccgggcaagtcggcgggccgtcggcgtgggatggctttgcggcggcggtggcggcggatgcgtgtattgaagcgcagagcagtgagcagatcgtcaaggtcagcctgccgccacgcccgcatttttatggctaagcccaaatcttcacttgaaatgcattaaatgtgggagctggcttgcctgcgatagcggtgtttcagtgatgggttcattgactgacacactgctatcgcaggcaagccagctcccacacttgattgggtttccagttccagaaggagtgtatgtatgcgaatcggactagtcggctacggccatggcggccgcttctttcacgcgccgttgattgcaacgctgcccggcgcaaccttcgtcggcgtggtgacgcgttccccggagcgccgtcagcaactggcgaccgatcacccaggcctcaaggcctacgactccatcggccagatcgtcgaggccggtgtggatgcgctggttatttccaccaccctcaaaggccgcccggccctggtgctggaagccatcgaacatggcgttgcggtggtcagcgacaaacccttcgccagcaatgccgagcaggcccaggcgctgatcactgccgccgaacgccaaggtgtgttgctgagcgtctaccagaaccggcgttgggattcggacttcctcaccttgcgcaaactgatcgacaccggcgccctgggcgaggtcactcggtttgaatcctgtgtggagcgctacaacccgcaatcggtgggcaatgccagcggcggcggatggctgcgcgacctcggcagtcacttggtggaccaggcactgcaactgttcggcccggtggatcgggtgttcgcgcaattacacttcagcgcgcaatacccaacgctggatcacggtttttttgtctcgctgacccacgccaacggggtgatttcccacctgcggggcagtgccctgcaaaacagccaggccccgcgttttcgtgtcagcggcacgctgggttgctacaccgtcgacggcctggacggccaggaagaagcgctgatggccggcaagacgccaaagaccgaaggcgagcactggggcgcggaggaacatcgacgctggggctggtttgaacaaggcgcggagcgcgaacgggtgccgtcggaaaaaggctgctggacgcagttctatcgccaattgcagagtgctgtgcaagggcaggggccgttgccggtaagcgcctatgacgcgctggaaaccacccgtatattggacgccgcacgcctcagtaacgagcgccagcaggtggtttcaataaaaatagaatgaaattctaaaaatggttgatatggaaattattttccaatagagtcttttccaggttgcaaaaagtacgtctcgggctcgatccgggcgactcaacaaaaacaagatcaaaaacaaccaggtaccgtcagatgaaaatcttcaacgctgtactgcgagttttacgccctgcccagcaagcgccacgcgatctgcctcgcgcccggccgttttatttctccttccttaatgtgctgtgcgtcgaaaacaaaggcgccctggtgtgctgcatcccgggagcaccgatcgttcgactgcccacttcctcgctctgaaaaacgcaacgtccacaaaaccaacaagaaattggagacagaccgttcatgaagaccccgatccgttttaccgcgctggccttgtccatgttgcttgccagcggctttgccacggcggccgatctcaagatcggcgtgagcatgtccgcctttgatgacacctttctgacttacctgcgcgaagacatggacaagcaagccaagtcctatcccaagggcgacggcgtacagctgcagttcgaagacgcccgcgctgatgtggtcaagcaactgagccaggttgagaactttatcagccagaaggtcgacgcgattatcgtcaacccggtggacaccgcgtcgaccaagaacatcatcagtgcggcgaccaaggcgggcattccactggtgttcgtcaaccgtcgtccagaccagaaggatctgcccaaggatgttgtggccgtgacctccgatgacgttgaggccggtcgcctgcaaatgcagtacatcgccgaaaagctcggtggcaaaggcaagatcgtgatcctgttgggcgacctggccaacaactccaccaccaaccgcaccaaaggcgtgaaagaggtcctggccaaataccccggtatcaccatcgaacaggaacagaccggtacctggctgcgtgaccgtggcatgacgctggtcaacgactggctgacccagggccgcgagttcaatgcggtgctggccaacaacgatgagatggccatcggtgcgtcgatggctttgaagtcggcaggcgccaagccgggcagcgtgttgatcgccggggttgatggaacaccggacggcttgaacgcgattaccaagggcgacatggccgcgtcggcgttccaggatgccaagggtcaggcggtgggttcggtggaagcggcgcgcaagatggccaagcacgagccggtcgagcagaacgtgatcatcccgttcaagctgatcacccccgacaacgtcaaagacttcaagtagcccttcataacaacaataagcgagcagggcggccacggtcgccctgctgatggagtacccgatatgcttgctcaagcggttgtctcgcagcctcccggtatccagccccaggcaccggaagaaccctatctgctggaaattctcaatatcagtaaaggctttcccggcgtcgtggccctggccgatgtgcaactgcgcgtacgcccaggttcggtgttggcgttgatgggcgagaacggtgcgggcaagtcgacgctgatgaagatcatcgccggcatctaccagcccgacgccggggagattcgcctgcgcggcaagccgatcgtgtttgagacgccgctggcggcgcagaaggccgggatcgcaatgatccatcaggaactcaacctgatgccgcacatgagcatcgccgagaacatctggatcggccgcgagcagctcaacagcctgcacatggtcaaccaccgcgaaatgcaccgctgcaccgccgagttgctggcgcgcttgcgcatcaacctggacccggaagaacacgtcggcaacctgagcatcgccgaacggcagatggtcgagattgccaaggcggtgtcctacgactccgacatcctgatcatggatgaaccgacttcggccattaccgaaaaggaagtggctcacctgttttcgatcattgccgacctcaagtcccaaggcaaaggcatcgtctacatcacgcacaaaatgaacgaagtgttcgccatcgccgatgaagtggcggtgttccgcgacggccactatatcggcctgcagcgcgccgacagcatgaacagcgacagcctgatttcgatgatggtcgggcgtgagctgagccagctgttcccggtgcgcgaaacgcccattggcgagctgctgctgtcggtgcgcgacctgcgcctggacggtgtgttcaaggacgtgtcgttcgacctgcacgtcggtgaaatcctcggcatcgccgggctgatgggctcgggccgcaccaacgtggcggaaaccctgttcggcatcaccccaagcagtggcgggcagatcaccctcgacggcaaaccgatacgcatcactgatccgcacatggccatcgagaacggttttgcgttgttgaccgaagaccgcaagctcagcggcctgttcccgtgcctgtcggtgctggaaaacatggaaatggccgtgctgccgcattactcgggcaacgggtttatccagcaaaaggccctgcgcgcgttgtgtgaagacatgtgcaagaagctaagggtgaaaaccccgtcgctggagcagtgcatcgacaccctgtccggcggtaaccaacagaaagccctgctggcgcgctggctgatgaccaacccacgcctgttgattctcgatgagccgacccgcggcatcgacgtcggcgccaaggccgagatttatcgtttgatctccttcctcgccagcgaaggcatggcggtgatcatgatttcctccgagctgcctgaagtgctgggcatgagcgaccgggtgatggtgatgcacgagggcgacctgatgggcaccctcgaccgtagcgacgcgacccaggaagaagtcatgcagttggcttcgggtatgaccgtagtccactgacgaacagcagcgtaggcccgcggttggcctgtgccacagaataagaaggtgattggctatgaacgcaataacagacaacaagcccgccacggcaccggtcaagcaccgcaggcgtttgcccaccgagctgagcatcttcctggtgctgatcggtatcggcctggtgtttgaactgttcggctggatcgtgcgcgaccagagtttcctgatgaactcccagcgcctggtgctgatgatcctgcaagtgtcgatcatcggcctgctggcgattggcgtaacccaggtgatcattaccaccggtatcgacctgtcttcgggttcggtgctggcattatcggcgatgatcgccgccagtctggcgcagacttccgatttctcccgtgcggtgtttcccagcctgacggatttgccggtgtggatcccggtggcgatgggcttgggcgtcgggctgctggcgggggcgattaacggcagcatcattgccgtcaccggtatcccgccgtttatcgcgaccttgggcatgatggtctcggcccgtggcctggcgcggtattacaccgaaggccagccggtgagcatgctctcggattcctacaccgccattggtcatggggcgatgccggtgatcatcttcctggtggtggcggtgatcttccatattgccctgcgctacaccaagtacggcaagtacacctacgccatcggtggcaatatgcaggcggcacggacgtcggggatcaacgtcaagcgccacttgatcatcgtctatagcatcgccgggctgctggcgggcctggcgggtgtggtcgcctcggcacgtgcggcgaccggccaggccggcatgggcatgtcttatgagctggatgcgattgcggcggcggtcattggcggcaccagcctggcgggcggggtagggcgcatcaccggcaccgtgatcggcgcgttgattcttggggtgatggccagcgggttcacctttgttggggtggatgcgtatatccaggacatcatcaaggggctgatcatcgtgatcgcggtggtgatcgaccagtatcgcaacaagcgcaaactgaaacgctagggctggcattcagcgcctatcaatgtgggagccggacttgtgtgggagctggcttgcctgcgatcgcatcaactcgttatccctgacaaaccgagttgcctgcatcgcgggcaagcccggctcccacacaagcccgctcccacatttgaaccttcttcagccagtttcaaccgtctgtcttctatatagctccacacgactgaatttcttgctataaacgcactccgatgaccattcgccaagcccgtcctggtgcctttgggggttaattgggaaaaaatgcctgtcatttcagttgctgagccctcaagtcggccttagactgccgcccctcgtaaattgagtgccgggtggcgcttgaaatgaacggcgcctttccgaggcctgcagaggtctgccggaacgctcccttattcgccttaatgcacgtattttttatagagaaatcaatgacaaaggaaaagttgctggccatgccggcggatgactacatgaatgccgaacagcacgctttttttgagcagttgctgcaggacatgaaagtggaacaccacgagcgcattgagcagaaccgcatcgccattgaaagcctggataccccggctgacccggctgacgccgcttccgttgaagaagagcgcacctggctggtgaatgccatcgaccgcgaccagcgtatgctgccgcagcttgagcgtgcactggaacgcatcaaggaagattcctttggctggtgcgacgacagcggtgagcctatcggcctcaagcgcttgctgatcagcccgaccaccaagtactgcatcgaagcgcaagagcgccacgagcagatcgacaagcaccagcgtcaagcgtgatgtgctgaagttgggcgctgctgacgtggcgcccaagcgaaataccggttacgcccctgtctattgatctgttgcaagctccccactaaaggctcatggataatggcccgatagtggcgtttaatgcagcaacaataacgacaaagcagtggggtaacgacgatggctggagacggatctctgatgggcgcagcagtgccaccgcacacggtggcgcgcgtgctgcccggctggctgacgccgctcctgcagagtaccgccctggtgctgatactgctgggcctggcgtttgccggcttgccgatctacctgtgcctgcccctggttttgctggtggtctggctaccgcgctttaaaacccgaaagcccgtacacgcaggctccgccgcgtccgatgcgatgggtgagctgacccgcgacctttcctacaccaccagtcataacgcgctttccgctgcaggcgtggcctattcggtcaagcaactggcggcccgtttgcagtcgcagttgagcgcggccaggcaaattgtcagcagcgccgaagtcatgatcggcactgaaaaggtcacctcgcaactcagccgccaagccctcggcgcggccagccaggcccaccagcgcagcaccgaaggccgcgaagtgttggcccagtcgatcacccgcatgcaccaactcagccagcgcgcgaatgccagccgcgagctgatcgaggccttgagccagcgcagcgaagagattcaacgcgtaaccctggtgattcagtccatcgccagccagaccaacctgctcgcgttaaacgcggccattgaagcggcgcgcgccggtgagcacgggcgcgggtttgccgtggtggccgatgaggtgcgcggcctggccgggcgcaccgccacggccaccgatgaggtcggggtgatggtcgccgatatccagcaacgcacggcgcaggtggtggagcagattcgccagttgtcggcggacttgcacaccggcgtcgagcaagtggagcacgccggggagcaactggagagcatcgccaacctggcggcggatgtggaagggcaggtcaacgaaatcgcccagggcaccgacaccaaccgcgtgcaactcgacagcctgttccatgccgtggagcaaatgcgcagcgacttgagcgtgagcgaccagcaaactcgccaactggcagacgccgccgtgcaaatggaagggcaggccgaaaccatcagcgagcgcctggccgaagtcgggctggatgactatcaccagcgcatctacgacctggcccgtgaaggcgcgaaccgcattgccgagcagttcgaagcagacgtactgcaaaaccgtatcagcctgcaggacctgttcgaccgcagctacacgccgatcgccaataccagcccaagcaagtaccacacgcgttttgacggctacaccgatcaggtcttgccggcgatccaggaagcgctgctgccgcgccatgaaggcttggtatttgccatcgcctgcacgcagcaaggctatgtgccgacgcacaacaaggcgttttctcaagcgcttacgggcgatccacaggtcgacgcgctgcagaaccgtaccaagcgcaagttcgaagaccgcacgggtattcgctgtggcagccatcagcaagcggtgctgttgcagacctacacccgtgataccggtgagttgatgcacgatttgtcagtgcccatcatggtcaacgggcggcattggggcgggctgcggttgggctataagccggaggcggccaagcccccgcgctagggattgttgctgtttatgcaatggagctattccggggatagctttttccaactggcagaaaaccgtagcatggcgaacattgttagccagctaactaatgctgcggagaagcaccatgcaaaacaaagtcgatgtcgccgtgatgatcggcagtggcgtacccgaaaccctgcgtgcgctgggccagaaggcttgctgggtggtgttgctcaatggcgagcaacgcggcacggcgtttgccagccgcgatgaggcggaggagtgcagggctgcctggcaggcgctgttgcgcctggaacagtcagacagcctgcattgagttaccggggttgatgcaggcgctggttcaactcatccacagcgatggcccattcggcatcatcacgcaattcttccttgagaaacgccgcctgttgcggcgtccagaaaggtgcgtcgatcagcttcacgtcttcggtcagcggatgtgcaccgatgaatgcgtcgattgcttcgggggttgattccaggccaagttgttcaaacaagttttcaagcgttgggattggcgcgtccatatttcgttctccatgcaaggtgatggtcttgtgcatgtgaggcgctggaggcggcagagttctatcggattatcaggaattgagtgcgcctgaatccacagcggttttcagggctttggcggcatcttttgcggcaatggcggcggcgtcgacagttttgaaccagcggtctttttccacttggtgcgtggtcacggtcgtcagcggaggtttggcccgcatgatgatcaccgcttggaactcaccgtctacttctcgcacatcgccatggatgaaaaattcgccaatatcaaattccgtcacgtatagccttcccttcaaggtaaccgcactgatgaaacctgacccgcagggggcaaacttcatggacgggtcagtatggcagttgttgaagggcggcggcgcagtaaagtcatcaggatgacgaaacgatcccgccgtgaacggtgtgcaagctggtttcgagttttttcgccagttcacaggcctgaatgtggttgctgcgaaagcctctgatccggccgctggtcacttccaggatatgaaagaagttccgcccggcaggtacaacttggtaaagaacagaattggagtacccgttggggtcaggcaagcagtagtattggcgctcgtcttgacatgatgaacgagtgcgggaagacatggcgtcgtgttggcgtggttgcatgctcagctcctgtcgaacgatcttgttgaccctccagcaacgtttcgggtggttttgacccgtgttgctgttttagtattgtcgtcggcagccaatgcttggttccacgccaggtagttttttatgtgtgtgttgtcggaaacagcgcttttaattgagttattctctgaagctggtcggcccgtgttctcgggcggttgaacctgtgatttcctgtggtgcctgatgacctgcataaggtctatcgcgcatgcctgtactagtcttgcggcgcagcagtgggttctcttcagtttcttaacgaatgtgtgatcgtgccccagggccgtttttttgtgctgcccgctccggcaggtagcagtaattttgatgtgggggcgtttccttggcagtcagtaatctggatatgcacgcgttattcgtgctgggtgatttgcgcgcgaagttggtcaagcagtttcaatcgcgtttcgtctacatcaccgaacaaacgccggaaggcatctatatcgccgaaatcgataccgaatcggcgatggtggtggatgacaaacagcgtctggagctcaaagtgggcgaccattttcgcgcggccgtgttgccgagtcgcgagggtggcaagttcgagttgaagttccgcgacatcaagttgaccgtgtatggcctgggcgattacgcctttgttacttcgaccgaaggccagggcatcgtgttcaaggaaggccacaacgtcatgctggtgtttgccgccaacgagcaattgcaggaaggcctgaccaaaaccctcaaggccgtgaccggcaaggccgccaagtggcgcaagggtgagctggtaacgttcaaggccagtgagtagtcgataaacgtcgcgtgtattcttgctctcccggaacctctactacagttgagttgacttaactattcagaggcttcgcgcattggcagcaaagccatccgctattgctgcgaaaacgcgaggtgcaaaggcatgaaaggatttaaaaccctattggcagcgtccctgacggccttgagtctgtcagtggcttcagtgccggtttcggccgcccaggcaccggtgcatttcgccgacctgaactgggaaagtggcagcctgatcactgaagtactgcgctttattgtcgagaaaggctacgacctgcccaccgacactttgcccggcaccaccatcaccctggaaaccgcgctggcgaaaaatgacatccaggtgattggcgaggagtgggccggccgcagtcctgtttggatcaaggccgaggccgaaggcaaagtggtgggcctgggcgataccgtcaagggcgccaccgaaggctggtgggtgccggaatacgtggtcaagggcgaccccgccaaaggcctcaagccactggcgccaaacctcaagagcgttacggacctggcacgttacaaggacgtgttcaaggaccccgaatccccaggcaaggggcgctttctcaacagccccatcggctggacctcggaagtggtcaacaagcaaaagctcaaggcctatggcctcgacgacagttatgtgaactttcgcagcggctcgggtgcagccctggatgcggaaatcgcctcgtcaatccgtcgtggcaagccggtgttgttctactactggtcgccgacgccattgatggggcggtacaagctgatccaactggaagaaccaccgtttgacgccgacgcctggaagacactgaccgatgcggataaccccaacccgagaccgacccgctcgttggcgtccaagttgagcatcggtgtgtcgacgccgttccagcaggaacatccgcagatcgccgagttttttaccaaagtccagtttcctatcgagccgctgaataaagcgttggcgacgatgagcgagaaccataccgcgccgcgcgaagtggcccaggcgtttctcaaggagcaccctgaggtgtggaaggcatggttgacggcggatgtggcgcagaaggttgaggcgggtctgaagtaagccgacactctttctattggatgcagatccaaatgcgggcttgtgtgggagctggctcgcctgcgatagcatcacctcggtctaccttgtaaaccgaggtgcctgcatcgcgggcaagcccggctcccacacaagcccggcttccacattttttaatgtatttcaggcttagaacctggtttgaacggccacctcgaaggtccttggcgaacctaaataataagccggcgacacatgcgcaaactctgcatacacctcattcgtcaggttacgcacccggccggtcaccgaggtgtgcgagtcgacccggtagcgcaggaatgtcccgaacagcgtgtaggccgacaccgtcagggtgttggcgttgtctgcatacacctctgcgacataccgcgcatccacaccaccttgccagtcctgtgtgaagtcataagtcagccacagattgcctacacgcttgggcacgttggtcggcgtattgcccttgcgcgagaccaccgcgccgctggcgattttctcgttgaagtcgtcgtactcggcatccacccaggcaaagttgccttctgccagcaacttgggcgtgattcgcagtgaactggccaactcaacccccttggatgactgcgcgcccaccgggatgctgttgttggggtccagcgggtcggtaacggcgaaatccttgcgctcgatcttgtaggccgcgacggtggccgaaccgcacccgtccaggtaatcgaacttgctgcccacttcccactgcttgccggtcgacacgtcgaacacttgggtggtggtcgacggctgctcggccgccgtgctgtattgcacatacacattggctgacgggatgaactggtaggtcaggccgacgcgcccggtgaccggctcccaactgcgcttgaagtgacgcgggttggtggccgtgacggctctgtggttggtgacattcaggtcgatagcgtcgtagcgcaaaccggtcagcagcgagagtttgtcggtgaggcccaggcggttttccgcgaacaacgccttggtggtgacttcgttggttttgtccttgatgaagccgggcttggtgccgggtatagcgtagaagtgtcctgggttgtagttattcgggtccacggtactgttgcctggcacgttcaacgggttgtttgtggtgctgttgaccttgtactcgaagccaccggaccaggtcgttgacaggccgaagaacgtatcgtcatggcgcagctcgaactggttgccgttctgctcgccctgatgacggacctggtaggccgtcgaacggttcaccgcactgttgtcggcgttgtattggtaagtctccaggttgcggtagtcgcgctggctgtccaagtgataaagggtgtttttcagcgtggtgctgtcgttgatgcgatagtcgatgatcgagcgcgcccagatcgtgcgctgctcgtaacggccatcggcgacgttgtaattgttgaagcggttgtgccggtcaattttcagctctccggccttcgggttgagcaccggcgtaccccaataagggctgtcttcatgctcatcctggtattccagcgccagggtgtgggacaggttgggggtcaggtcgctgagcagcgaaaacgccacgctccaggcatcccgctggtcgcggtcgatgtagctgtggttggtgttgcggctcacatccaggcgcgcgtaatgctgcacctcggcgcccggttcggtcagtgcgtggttgaggccgaatgccatgccggcggtgtcgtagctgccgtaggtgagttggccttcggccgcctgttcttcacgggttgccagtttggtcacgtagttcagcgaaccacccacggagccggcgccattgatcaaggaggagggcccgccgaccagttcgacgcggtcatagatccacgaatccactgggcgggccaaaccggtggcgacgttgatgccgttgaacatctgggtgatctggctgctggtaaacccacgatacgacacaaacccgccaaaccccggcggcgcgctggcgttaacgccaggcaaggtgttggccgcatcgcggaaggttttggcgccatggcgctcaatatcgttgcgcgtggcgatggccaccgacgccggcgtctcgcgcacgcttaaacccagccgcgacgccatgccgctggattggtcgagcgccaggccgggctcggcgctttgttcaccatcaatagtggtgggggccaactcaagcgcccagccacagacaggcaggcagccgaacaggcccgccaacaggggtaaatgtttcatggttgaatcctgaaaaacttggcttgaaaacaacgcacagccgcgcatattccccaacgggaacgtttggacggtgcagatcagaaagcgaagggatcaggctaaagcgggaggcgcgcgcgggttggccgcaggccaggtgaagcgggcagggatgtcagcggcaagcaccaccgccggcggtggcgcatggggttgtggcaacaccgccacattcaggctggaactcagtgccgggcccataccgccggtcgaacacaacgggcagccgaacgccttggacagcgtcggcaggttctcatccgtggaattggtttgcgcgggcgcctgggtacgcgggtccaccgtacagaactggccgccgatgccgttgagctgcattcccagcatctgcccatggccaatactgcacgcgaacacattgaacaggacgcagctgtaaagcatccaggcaatgagcgagcggtcggcacgggcgaatttcatggggcggcactttaccatcagccgccgacgaaatgcctacaaaaaatctcagggcgactatcatcattcgcacattttcagggagcgcccgccatgagctttgtcatcgcgcgatggatcgtcggggtttttacctgcatcagcatggtgcatttgtactgggccgccggcggcaaactcggcagcctcgccgccatcccccaactgcccggcgaattcgcccacgggccgcggccagcattcaaaccctcggcactgggcacgttcctcgtcgcgatgggcttggtggcgattgcattgcttgtctgcctgcgggccgggctgtatttctcaccggtgtcccatggcgccctgcagtgggggatcagcgcgattgccgtggtgatgtttgccagggcgattggcgattcggagttggtggggtttttcaagaaggtgggtgggtcgaggtttgccaagttggatacgtatttttattcgccgttgtgtttggtgttggggttgggtttgttggtggt

SEQ ID NO: 62 - DNA, 63333 bp, Pseudomonas poae FL10F
acgagttttgcttgctctgtgtacttacccatgacgcccccaaaggttgtgtccagcctttgggggtcagttcactccgcgtgggaatgcatcctgtgacgctccgcgtcacccttgcgtggggcatgagccgtgggacgcggagcgtcctgggcggcattcccacgcggagcgtggggacgatcggtcaggcgttgattgggcgggtaaccaaccgctccaaagcctcacccaaacccaaggccttgtcaccaatcaacaagtgccaaacgccactgtccagctggctcacaccctggcagcccagcgccgtcagatccgcttcagacaacaccgaatcatcccccaattccactcgcaatcgggtcaccgccacggcgtccaactgccgtacattttcacggccacccaaggccttcagccatttctcggcctcttgcacattcactgcaaccggcttatccacaggcgcaaccgccaccggcgcagtggcaacaaacgacggcatggccaggcgaatctcatcggcaatgctgtcggccatcggcccgaccaccacctgcaagctgccgccgttacccggccgaaccacggccatcgcgcccagcgccttcagttccgcatctaccgccttgttgcgatccaccatgtccaggcgcagacgcgtggtgcaggcgccgacactcagcaaattatccgcaccgcccagcgcacggatatacgccccggcccgttggttatcactcatcgcctcagcctgcaccacctggatatcttcacgacccggcgttttcaggttgaagcggcgaatgcagtagttgaacacgctgtagtagatcaccgcgtacgccagcccgaccgggaacaccagccagccgttggtggacttgccccagccgagcaccatgtcgataaacccaccggagaaggtaaaaccgaggtggatattcagtatgttggtcacggccatcgacaggcccgtgagtaccgcgtgaatcaggtacaaaaacggcgccaggaacatgaacgcgaattcaatcggctccgtcacgccggtcaaaaacgaggtcagcgccatcgacaggaaaatcccgcccatcactttgcggcgctccggcagcgcgttgcggtacatcgccaggcacgcggcgggtaggccgaacagcatcaccgggaacatgccggtcatgaattggccgcctttcgggtcgccggcgaagtagcgggtcaggtcgcccgtgacgacggcgccggtggtcgggtcggtaaaggtgccgaacacgaaccacgccatgttgttgaggatatggtgcaggccggtaacgatcagcaggcggttgaacacgccgaacacgaaggcgccaaagctgccgctttccatcagcagcacaccgaagctgttgatgccgtgctggatcggcggccagatcaggccaaagatcacgcccagggccaccgccgaaaacccggtgacaatcggcacaaagcgtcgcccaccaaagaaggcgaggtactccggcagcttgatgtccttgaagcggttatacagcccgcccgccatcaaaccgctggcgataccggcgagcatgcccatgttgatagtggtgtccatcaccttgagcgtggagaccatcaccaggtaaccaattgcgccggccaggcccgccgtgccgttattgtcgcgggcaaaccccaccgcaataccgatggcgaagatcagcgcgaggttggcgaaaatcgcctgcccggcatcgtgcatcaccgcaatgttgagcaagtcggtgtcgcccaggcgcagcaagaggccggcgatcggcaaaatcgcgatcggcagcatcagcgcgcggcccaggcgttgtaagccttcgataaaatgttggtacatggcgtgtctccctattcttgttgttttcagctcagcggccagtggtgttgacaggcttggcgaaccgccttggcgctgctcaggtcgagcaggccgagactcagttgccggcattgagccgcgtccaagtggcggacgcggtccttgatttctccgatttgcggcgggcttaccgacagctcgctgacgcccaggccgaccagcaccggcgtcgccagtgggtcggacgccagggcgccacacacaccgacccaacgcccgtgtttggctgcgccggcgcaggtctgcgcgatcagcctgagcagcgccgggtgcagcgcatcaacgcgagcggcgaggccggcgtggtcgcggtccatggccagggtgtactgggacaggtcattggtgccgatggacagaaagtccgcatgcttggcgagttgctcggccatcaatgcggcggcgggcacttcgatcatcacgcccagctccgggcgttgggtcagttccagctcggcgcacagctcatccaggcgctggcggatttgcagcagttcgtcgacttcactgaccatcggcagcaggatgcggcaacgctccaacgggctgacttgcagcagcgcgcgcagttgctggtcgagcaattcgggacgcacctgggccatgcgaataccgcgcaagcccaacaccgggttggcctcgatgggcagcggcaggtagtcgagctgtttgtcgccgcccacgtcgatggtgcggatgatcaccgccttgtcgcccatggcatccagcacggcttgataagcctggcgctgttcctgttcatccggcgcggtgcggcggtcgacgaagaggaattcggtgcgcagcaggccgacgccatcggcgccgttctcaaacgccacttgggcttcggcgctggaggcgacattggcggccacttcgatgcgcacgccatcgcgagtttgcgcagcctggtgcgcctgggcctgttgttgctggcggcgcagtttttgcgcgtcgcgaatctgatgcacctcggcgtgacgcgcttcgctgggagccagttccaggcgaccattgaccgcgtcgagtaccacgcgttggccttgcggcacatcgagcacgtctgcgcccaacgccaccacgcagggcaggcctttgccacgggccaaaatcgccacgtgggaggtggcgccgccttcggccatgcagatgcccgcagcgtgttgcgcgctcaattgcagcaggtcggatggcgtcagttcatgggcgctgacaatcgccccggcaggcaattcgaagtgccaggcttcacccagcagcgcgcgcaacacccgttgctgcaagtcgcgcaggtcgttggaacgctcggcaaacagcggtttgccgagtgccagcaataccgcgcattgcgcctggatcgcatcgcgccaggcgtgggtggcggcgctgccttgctcgatggcggcggtggccgcttccaatagggctgggtcttccagcagggcgaggtgggcggcgaagatctcttcttcatcgatgtttttgcgttggcgagcgtggtccagcgtggtgcggatctcgccgcgcacttgctcaagggccgcatccaggcgttgcagttgttcgtcggcggaatggttgcgggtgtctgccggcagttcgataccgctcaagcggaacagcggcccacacaccaggcccggcgcagcacacacgccttgcagtacgccaacttcggtgttcgcagggcgcgcagcaacggccaccggcgcgtgatgttcttcactgacggccaccgacagcgccgccaccaacgcctgcaacgctgcctcgcaatccttgccgcgacaggtgacacgcacctcgtcgccttcgccgatccccaggcccatcaagccaatcaggctgtcgcatggcgccgacttaccggcaaagtgcaactgcgcgtggctgctgaagccttgcgcggttttgcggatcaacgcagcggggcgtgcatgcaaaccgccacggtgagtaatgcgcacgctggcgcgcacttcggtcaccgagttatccacagccgccagcggggctgccgccgagcgcggcacaatctgcagcaagggctcaccgaccttgacggtgtttcccgccaccggccgcagttcaaagcgctcgccattggtgaggataatcaggctgaccaggcttttgcactggcgcgcaatgcggtccagatcaaactgcaccagcgcctggcctttgctgacccgcgcgccttcctttaccagcagcgcaaacccttcgccgttcagttccacggtatcgatgccgacatgcatcaacacttcggcgccgttgtcggcacgaatcgtcagtgcatgcccggtgcgcgcgacgtggatgatcacgccgtcacacggtgcatgcaggcaatcgttcagcgggtcgatggccataccgtcgcccatcgcgccgctggcgaacacttcgtcgggaacgttgcccagggtcagcaccgggccactgagtggggcgcttagggtcaattcattattcttgttggacatgggcacggtactcatcaggaaaacgcgactcagtgagtgcgggtaactttgctcaggtgacgcggctggtccgggtccatgccccgggcttgcgccaggcctgcggccattacgtaaaagctctggatcgccaggatcgggtccaggctcgggtgttcggcacggctcagggtcaggtcgcgttcgctgatatcgtccggcgcggccagcagcacacgggcgccgcgttggcgcatgtcggcggccaggctcaacagcccggcttgctcggcgccacgtggggcgaaaatcagcagcgggtagttctcgtcgatcaaggccatcggcccgtggcgcacttcggcgctgctgaaggcttcggcctggatcgccgaggtttccttgagcttgagcgcggcttcctgggcgatggcaaaaccggcgccccggccgatcaccatcaagcgctggctgtcacgcagggcgtcgatggcggtgctccaatcctgcttggcggcggcacgcaactcgtcaggcaaggcgcggcaggcttgcagcaggtcggcttcctggttccagtggccgatcaattgcgcgctggcgctgagggtggcgataaagcttttggtcgccgccacgctgtgttccggcccggcgcacagcggcaggtggaattcgcaggcggcttccagcggtgactcttcggcgttgaccagcgaaatgctcagggcaccgcgtttgcgcagcaggcgcaggctgttgaccaggtccgggctttgccccgactgcgagaaaccgaacgccacctggccgctgactttcaacggcgcctgcaacaaggtcaccaccgacatcggcagcgacgccaccggaatgcccacgtgctgcatggacaggtaggcaaagtagctggcggcatggtccgaactgccgcgcgcaatggtcatggccacttgcggcggctgacggcgcaggcgcccggcgacttcttccagcagcgggtccaggcgttgcagctgcgccgcgacggcgtcacaggaggccagagcctcttcaagcatttttgaagtcaatggtttctccttcgaccattacgtcggtgaggtgcagggagcggtccaggcgcacgcagtcggcaaagctgccgggttgcaggcggccgcgttcttccaggcccaggtaatccgcaggaaattgcgacaggcgttgtgaggcttcgctgatcggcaggccgattttcaccaggttgcgcagtgcctgatccatggtcagggtgctgccggccaaggtgccgtccgccaggcgcacgccgcccaggcatttggtcacggtgtggctgcccagcttgtattcgccgtcgggcatgccggcggcggcggtggaatcggtgacgcagtacaggcacgggatcgaacgcagggccacgcgcattgcgccggggtgcacgtgcagcaagtcggggatcaactcggcgtacttggcgtgggccagcgcggcgccgacgatgcccggctcgcggtgatgcagcgggctcatggcgttgtacaaatgcgtgaagctggtggcgccggcggcgagggcggcgacgccttcttcatagctgcccagggtgtggccgatctgcatgcgcacgccgcgttggctgagcgcgcggatcaaggcgtcatgcccggcgatttccggcgcgatggtgatcacccggatcggcgccaggcgcaggtaggcttccacttcggccatcagcgcggtgtgggcgaagttgggttgggcgccgagtttgcctgggttgatgtaggggccttccaggtgcacgccgagtacacgggcgctgccggtcgtgcgttgttcgcagaagctgccgagttcgccgagcacgcgggagatttcgttcaccggtgccgtcatggtggtcgccagcagtgacgtcgtaccaaaacgcacgtgggtgcgggtgatggtctcgaaggcgtcgacgccttccatgatgtctttgccgccaccgccatgaacgtgcaggtcgataaagcccggcagcacatagggcaggtcgttgtcggccgggtcgcacggcgtgccgtcgatggcgaccaccttgccgtgttcgtgcaccaggcggccgcgaatccagccgtggggcgtgaggatattgtcttcggacatgggcagttctctaacgtcgcagttcagcggaatagtcatgacggcgcagctctgcgacaaagtcgtagtagtcgttgcggcagtaggtgtcggtgatttcaatcggcgtgttgtcggcggtgtagccgacccgcgtcatcagcagcatggcggtgccgggggcgatgcccaccagcttggcgaactcatccgaggcgttgatcgcctggatgtgctgcagcgcacgtacgatgggcttgccgatgctttccaggtattcgtacagcgaattgccgatggcttgcggctgcggcagcaccgaggcgggcatggcggtcatttcaatcgccatcaccgtgtcatcggctttacgcaggcgtttgaggcgcgcgactttgtcggtgggcgacaggcccaggcggatcagttcttcgtgggttggcggggtgatgtcgcgttccagccattgtgacgtgggcacaaaacccttgagtcgcagcatctcgctgaagcccgacaggcgtgacagcggttgttccaagcgcggtgtgataaaggtgccggagccttggctgcggcgaatcaggccttgggcgaacaacacttccagcgctttgcgtgcggtcacccgcgaaatgctcagttgctcgctgagggcgcgttccgacggcaaggcctgctcggatttccactggccggcatggatcgccgcttccaggttgcgcgccagctgcaggtacagcggcgtggattgtttgtcgtcggggcgcagcgtcaggatggggttcatctgtgaaggttccgatgcggttattggagtgttgtcgcccggtagtggccggaaattaataccacttaaataccatgtcaatgctgccaaaacggtgcgaatcccggtttatgggcgccttaatggtgcctgttatcaagtggtattagagaggtctttatcgcgcgcagaactacgcagcccggcgcggtgaactggtattcaccggcaggcgctgccaggggcaggaattattttcagattattttacgaacggtacgaaactaggggcgaatctcgatcatggtgccgtctttgaccaggttccagacttcgcgcatgtccacgttgcgcatgccgatgcagccgtcggtccagtccagggtgtggaaccactgctccgggtattcctcggtgtcgggcgtgccgtggatcatgatcatgctgcccggtttcacgccttcgcggcgcgcgcgcgcggagtcgctgatgttcgggtaggagatgtgcatggccaggttgaagcggtcgctggttttgcgccagtcgatccaatagaagccttccggcgtgcgacggtcgccttcaaccagcttggtgcctttggggtttttaccgagggaaatgcgataggtcttcagcggcttgccgtcattgatcaactgcaactggtgggcggacttgagcaccaggattttttcgacaggtttgccgccgatgatttccaccgtggaggccgacgaaaaggtagcgaacgacaggcagatcaaagcgagcaacagacgcattaaaacggtttcccttagaggctatctgccggtttttttattcggtgggtttgcccatgggcggtacagcttcgctgcgcaccgggaacgcctgctgccgacggtcagcgaaaaagtattctaaagtacgcccgaccgtgcggaaagccagctctgaccaagggatgtcggcttcatcgaacagcttcacttcaaggctttcggggcctgcggcaaagtcgaggtcgaccagttcggcgcggtagaagacatgcacctggctgatatgcggcacatcgatcagcgtgtaaatgctcaggttgcgcacgcgggcgcaggcttcttccagggtttcgcgggcggcggcctgttcaacggtctcgccgttctccataaagcctgcgggcagggtccagtaacccaggcgcggttcgatggcgcggcggcacagcagcactttatcgccccagaccggcacggtgccggcgacgatgttggggttttgataatgaatggtcgagcagtgatcacacacatagcgcaggcgtgtgtcgccttcgggaatgcgctgggtgaccggtttaccgcactggctgcagaagttcatgctggggttcctggagagtgggtctatcttggcttgacgggcagggccctgcaagttgtcgtttcgcgacatgcgcagggtttggggttgggtgcctgcccgctttggtgcatgatgcaaggtagccaacagaccgagatgactcatgctggacgagctacttcgccgggtaagcaatcacacccctcatacactggaaactgacgggcgtttccccgaggccgccgtgttggtgccgatcacccgcagcgacgaacctgagctgatcctgaccctgcgcgccagcggcctgtcgacccacggcggcgaagtggcgtttcctggcgggcggcgtgaccccgaagacccggacctgatctttactgcgctgcgtgaagccgaagaagaaatcggcctgccgcccggcctggtggaagtcattggcccgttgagcccgttgatttccctgcacggtattcgcgtgacgccctacgtcggcgtgattcccgattacgtcgaatacctcgccaacgacgccgagatcgctgcggtcttcagcgtgcctctggagtttttccgccaggacccgcgcgaacatactcaccgcatcgactaccagggccgcagttggtatgtgcccagctatcggtttggcgaatacaagatctgggggctgacggcaatcatgattgtcgagctgatcaacctgctctatgacgacgccaagatcagcctgcaccacccacctaaaagcttcatcaatacgtaagccatcgcttgaatggcaacgccgtgaggacacaccatgaaataccgcctgggcgacgcccgcgtcgagactcatccgcaaagctgggtggcgcctaacgccacgctggtcggcaaggtcaagctggaggagggcgccaacgtctggttcaacgcggtgttgcgcggcgacaacgaactgatcctgatcggcaagaacagcaacgtacaggacggcagcgtgatgcacaccgacatgggctacccattgaccctgggcaccggcgtgaccatcggccataacgccatgctgcacggctgcacggtcgacgactacagcctgatcggcatcaacgcggtgatcctcaatggcgccaagatcggcaagcattgcatcatcggcgctaattcgctgattggcgaaggcaaggaaattcccgatggctcgctggtgatgggttcgccgggcaaggtggtgcgcgaactcaccgaggcgcagaagcgcatgctcgaagccagcgccgcgcactatgtgcataactcacagcggtatgcgcgtgacttggttgagcaggaagaatgaacccgattgaacgccctgttgcctcgccgtgcgtgagtatctgtgcactggatgacgacgatatctgtacaggttgccagcgtaccgtggatgagattacgcgttggagccgcatggacaataccgaacggcgggtggtgttggggttgtgtcatgagcgggcgaaggcgagtgggttggtgtggatgatgccggggaaatccggcgcctgagcgaccgctatcgcaggcaagccagctcccacacttgatttgtgaatactttcaaaaatgtgggagctggcttgcctgcgatgaggccctgccagacgacatccctgtaattgtgtaccctgtgcggcattacccacaggtccatctccatgctcttcctgatcgcctacatcagcagcgtcgtgctgatcaacttcgccttttccaccgccccgcacctggacgtcatctggtccgcctggggtggcctggtgtttatcctgcgcgacatggtgcaaacccgcttcggccacggtgcaatcatcgccatgctggcggcgctggtgctgtcgtatatcacctccgatccgtccatcgccctggccagtgccacggcgtttgcagtgtccgagtgcatcgactggctggtgttcagcatcaccaaacgcccactgcatgaccgcctgtggataagttcggcgctgagcattcccctcgatacgtttatcttcttcggcctgatcggcgcgctgacgccggcagtggcgggcacggcattggtgtcgaaattcgccggcgtcacggtggtgtggctgatcatggcctggcgcatgcgcaaacgcgctgtcgccaactgaggccaattcttgcagttcatgtaaaatgccggcctttctccccatgatccgctcccctgaggacctgagatgacccgaatcggaactccattgtcgccaaccgcgacccgcgttttgctgtgtggctgcggtgagctgggcaaggaagtggtaatcgaactgcaacgcctgggcgttgaagtgattgccgtggatcgctacgccaacgcgccggccatgcaggttgcgcaccgtagccacgtgatcaacatgctcgacggcgccgccctgcgtgccgtgatcgaggcggaaaaaccgcactttatcgtgccggaaatcgaagccatcgccactgccacgctggttgagctggaagccgaaggcttcaccgtgatcccgaccgcgcgggccacctcgctgaccatgaaccgtgaaggcattcgccgcctggctgccgaagagctggacctgccgacctcgccgtaccacttcgccgatactttcgaagactacagcaaggccgtgcaagacctgggcttcccgtgcgtggtcaagccggtgatgagttcttcgggcaaaggccagagcctgctgcgcagcgccgacgacgtgcagaaggcctgggattacgcccaggaaggcgggcgtgccggtaaaggccgcgtgatcatcgaaggctttatcgatttcgactacgaaatcaccctgctgaccgtgcgccacatcggcggcaccaccttctgcgcgccggtcggccaccgtcaggagaaaggcgactatcaggaatcctggcagccgcaagccatgagcccgattgccctggcggaatccgagcgggttgccaaggccgtgaccgaggcgctgggtggccgtggtctgtttggcgtggaattgttcatcaagggcgatcaagtgtggttcagcgaagtgtcgccgcgcccgcatgacaccggtttggtgaccctgatttctcaggacctgtcgcagtttgccttgcacgctcgcgccattttgggcctgccaattccgctgattcgccagttcgggccttcggcttcggcggtaattctggtggaagggcagtcgacccagaccgcattcgccaacctcggcgcggccttgagcgagccggatacggcgttgcgcctgtttggcaagccagaagtgaatggtcagcgccggatgggtgtggcgttggcgcgggatgagtcgattgaggcggctcgggcgaaggctactcgtgcttcgaaggctgttgtagtagaactctaaaccgcgtcgcgtccatcgcaggcaagccagctcccacatttgattgggttcacatattttgacgtgtgaatacattcaagtgtgggagcgggcttgcccgcgatagcggtctatcaggcgactttgttcaggtcattatcccgcgtctctttcaggcatagcacagcaatcaagctgagcaacgctgccgccgacacatacccgccgacataactcagcccacccatcgccaccagcttggtcgcgaagaacggcgcggccgacgctcccacaatcccacccaggttatacgccgccgaagcgccggtataacgcacgcgggtcgggaacagttccggcaacatcgcgcccatcggcgcgaaggtcacgcccatcaggaacaactccagcgccaggaacaatgccaccgcccaggtcgaaccatgggtcagcagtggctccatggtgaagcccgacagaattgccaggatcgcgccgacgatcagcaccggcttgcgcccgtagcggtcgctggccaaggctgccaatggcgtggccaggcccatgaacaacacggcaaagcacagcaaaccgaggaacatttcgcggctgtagcccagtgtcgatacgccatagctcagggaaaacgcggtggtgatatagaacagtgcataacacaccaccatcgacgcggcgcccagcagcaccggcagccaatgctggctgaatagctccaccaatggcactttcaccggggcttctttggccacggcgttggcgaacactggggtttcatgcaatttgagtcgtgcatacaggccgaccatcaccagcgctgcgctgaggataaacgggatgcgccagccccagctgcggaactgctcgtcgttgaggctcatggccaggatcaggaacaggccgttggcggccagaaagccaatcgacgggcccagttgcgggaacatgccgaaccacgcgcgcttgcccttgggcgcgttctcggtggccagcaacgccgcgccaccccattcgccgccaagccccaggccttggccgaagcgcaatacgcacaacaggatcggtgcccaggcgccaatgctgtcgtaacccggcagcaaaccgatcagcgtggtgcacacgcccatcagcagcaacgaggcgaccaacgtcgacttgcggccgatccggtcgccgaagtggccgaacagggccgagcccaatggccgggcaataaaggcgatgccgaaggtcaggaacgacgccagcatctgcgcagtgccggaggtctgcgggaagaacaccgggccaatcaccagcgcagcagccgtggcgtagatatagaaatcgtagaactcgatggcggtgccgacgatgctcgcggtcgcgactcgtgcggtcgagttaagcggggcggcggtcgcggcctcgttgtaggtggtgctcattgaggtatccctgacggtcattgcgcgtttggacgcggattattattggtcgaacacccatgggtcaggggtgtgcgcggggcggctcgggatgggagcaaacaccggtcagacacggtaaagcagtgcctggacgcgctgagtgcgggtagcacgcggtcgggcggggcttgggtaagccgcaccgattataggaaggggtttgcggatccaacaagggggcgctggcacgccgatagtctaagtgtgggggctggcttgtgtggggacaggtttgtgtgggagctggcttgcctgcgatggcatcacctcagttcaactgaatgaccgaggtgcctgcatcgcaggcaagccagctcccacacaagccaattcctgcattggattgtgttgtgccaggaggctaggcggccacgggcacgcggctggtgtgccagatcagcactttgctcacgcggttgtcctcggtctcgaggatttccaggcgatagcggccgatcttcaggcataccgcgcagtccggaatggtctccagcgcttcggtcaccaggccgttgagggtcttggggccgtcgctgggcaggtgccagccgaggcttttgttgagttcgcggatcgaagcggcgccgtcgatgatgtagcggccgtcgggttgcgcttcgatatgcgggttgtctcccgcctgatcgctttcgaattcgccgacgatttcttcgaggatatcttccagggtgacgatgcccagcacttcgccgtattcgtccaccaccatgcccagacggcgctgctgcttgtggaagttcagcagttgcagctgcaacggtgtgctttccggcacgaagtaaggctcgtgacaggcggcgagcagggcttctttggtcaggctggcgtcgggcagcaggtgctggatctgccgcgtattgagcaccgcttcgacctggttgatgtcgctgtggaacaccggcaggcgcgtgcgctgggaggtgcgcagttgctcgatgatttcctcgaccgagtcatccaggttgatgccgtccacttcgctgcgtggcaccaggatgtcgttgaccgtgatgttgtccagggcgtggatgccgggcatgccgggcgtgcggttttcgtcggcctcgggctccggttcatcgtcgtgatccggcagtggttcgtcgctcttttttaccacgccggatttgcgtgcgaacgggcgcagcagtaatacgctgatgccattgagcagccaggccagcggataaaggattttcagcggcacacccagcagcgtattgccaaagcccagcacagcttgcgggtgacgaacggcgagggcgcgaggcaggtagtcggcgagcaccagcaaaatcgcgcaggagatcagccagccgagccacgggccgttctgcgcccaggcgtaaatcgccagcagggtgcagagaattaccacggcggcgcggcacaggctgttgcacagaatcaggctgttgcgtgggaagttcaggcgggcggccgccttgtcaccctggcgtgtgccggggcgcagggccagcaggtgttgttgcgcggcttcgatggcggtaaacagcgccgcccataacaccagcaaggcgattaccgcgagcatcggcccaaggggcaagttgtccatgatcgctgcccgtcagatatgcaggatgtattcgcgaaccagcttgctgccgaaataggccagcatcagcaggcagaaaccggccagggtccagcggatcgccttgtgcccacgccagccgaggcggttacgcccccacagcaacacgctgaacaccacccaggccaggcacgccagcagggttttgtgcaccaggtgctgggcgaagaggttttcgacgaacagccagccggaaatcagcgacagcgacagcagcgtccagccggcccacaggaagccgaacagcaggctttccatggtttgcagcggcgggaagttcttgatcagcccggacgggtgcttgtttttaagctgatggtcctgcagcagcaggagcaaagcctggaacaccgcgatggtgaacatgccgtaggccaggatcgacagcaggatgtgcgcgaggatgcccggctcctcgtcgatcacctgcacggtgccggtcggtgtgaattgcgccagcagcaccgtgagcattcccaatgggaatagcagcaccagcaggttctcgacgggaatgcggtagcaggccagcagggtcagggcgatgacggctgcggcgatcaggctggcggcgctgaaaaagtccaggcccaggccaaccggcgtcatcaagtgggtgaacaggctcgcggcgtgagccagcagggcgacgacgcccaggccgaccagcagacgtttgtccgcttttgtgccttgggccagacgagtgccctgatagagagtcgcagcggcgtacaaaatggcggcggcgaggctgggtagcaaactgggtgacaaggggaccataaatcctgatagacaagcccgaaaggcgctgagtttggcacacacctgcgctgcacgaaagactcccgggccagacagcgggtgtgcacaggcgcagtcttcgctataatccgcgacctgcccacgccacaggctcgccgagcgctgtttttaatagcgatttaccccagcctgggccgccactacctcggtctactaatgcatttcgatgaatagggcctgaaaggatcgcgcatgtttgaaaacttgactgaccgtctctcgcagacgctgcgccatgtaaccggcaaggccaagctgaccgaggacaatattaaagacaccctgcgtgaagtgcgcatggcgttgctggaagccgacgttgccttgcctgtggtcaaggacttcgtcaactcggtcaaagagcgcgcagtgggcactgaagtgtcccgcagcctgacgccgggccaggcctttgtgaagatcgtgcaggccgaactcgaaagcctgatgggcgcggccaacgaagacttgaacctcagcgccgtgccgccagccgttgtgctgatggccggtctgcaaggtgcgggtaagaccaccaccgccggcaagctggcgcgcttcctgaaagagcgcaagaagaagtcggtgatggtggtgtcggccgacgtgtaccgtccggcggccatcaagcagctggaaatgctcgcgggcgaagtgggcgtgaccttcttcccgtccgacctgagccagaagccggtcgacattgccaacgcggctattaaagaagccaagctcaaattcatcgacgtggtcatcgtcgataccgccggtcgcctgcacatcgatgaagagatgatgggcgagatcaaggcgctgcatgccgcgatcaacccggtcgaaacgctgttcgtggttgacgccatgaccggccaggacgcggccaacaccgccaaggccttcggcgacgcactgccgctgaccggcgtgatcctgaccaaggtcgacggcgacgcccgtggcggtgccgcattgtcggtgcgtgcgattaccggcaagccgatcaagttcatcggtatgggcgagaagagcgaagcgctcgagccgttccaccctgagcggatcgcctcgcgtatcctcggcatgggcgacgtgctcagcctgatcgagcaggccgaagccacgctcgacaaggacaaggccgataagctggccaagaagctgaagaagggcaagggcttcgacctcgaagacttccgtgaccagctgcaacagatgaagaacatgggcggcctcggcggcctgatggacaagctgccgaacatcggcggtgtgaacctggcgcaaatgggcaatgctcagggtgcggcagagaagcagttcaagcagatggaagccatcatcaactccatgaccccggccgagcgccgcgaccctgagctgatcagcggttcgcgcaaacgtcggatcgccatgggttccggcacccaggtgcaggacatcggtcgcttgatcaagcagcacaagcagatgcagaagatgatgaagaagttctccgcaaaaggcggaatggccaagatgatgcgcggcatgggcggtatgttgcccggcggtggcatgccgaaaatgtaaagtattcgagcgggagcccagctcctgctccgacccacagggatgtgggatctccagcaaacccgccgttggcgggcgctgactcgccgttttaaccgacggctctatagcagatctgagtggcacgctgataggcgccagaaaaagacatttgcaaaagtccggatattccttagaatatgcggcctttcgggcacctatgcccgctgtgcatttagatttgcagcaccgactacaggaacgatgttcacatgctaacaatccgtcttgcccttggcggctccaaaaagcgcccgttttaccacttgaccgtaaccgacagccgcaacccgcgcgacggttcgcacaaggaacaggttggtttcttcaaccctgttgctcgtggtcaagaaactcgtctgtccgtgaaccaagagcgcgtagcctactggctgagcgtgggtgcacagccatccgagcgcgtagcaaaactgttgaaggactcggctaaggccgcagcctgagcaatatgaacgcgacgccagctgttgctgatgatttgatcgttatcggcaagatttactctgttcatggcgttcgcggcgaagtgaaggtgtattcctttactgatccgactgaaaacctgttgcagtacaaaacctggacgctcaagcgcgaagggagtgtgaaacaggttgagctggtcagtggacgcgggagcgataagttcctggtcgcaaagctcaagggtcttgatgatcgtgaagaagcgcgtcttctggccggttatgagatctgcgtgccgcgcaacctgttccctgaattgaccgacggcgagtactactggtaccagctggaaggtctgaaggttattgatcaactcgggcaattgctcgggaaaatcgatcatcttctggaaaccggcgccaatgatgtaatggtggtcaagccttgcgctggcagcctggatgatcgcgaacgcctgttgccgtataccgagcaatgtgtgttggccgtcgacctggcagcgggcgagatgaaggtggaatgggacgcggacttctaagcgtggctaatttgcgcattgaagtgatcagtttgtttcccgagatgttctccgccatcagcgagtacggcatcaccagtcgggcggtgaaacaggggctgttgcagcttacctgttggaacccgcgagactacacgacggatcgacatcacactgtggacgatcgcccatttggcggtggcccgggcatggtgatgaagatcaagcccctggaagacgcgttggttgaggccaaggccgccgccggggagaaggcgaaggtaatttacctgtcccctcaaggccgtcagctgaaacaggctgcggtacgcgaactggcgaatgaggaagcactgatcctgattgccggtcgctatgaaggcattgacgagcggtttattgaagctcatgtcgatgaagagtggtcgattggggactatgtcctgtctggcggcgagctgccggcgatggtcctgatagatgcggttacacgactgctgcctggagctttagggcatgcggactccgcggaggaagactccttcacggatggtttgctggattgcccgcactacacccgaccggaggtgtatgcggatcagcgtgttcccgacgtattgctaagtggcaatcacgcacacatccggcgttggcgtttacagcagtcccttggtcggacctatgaacgacgcgccgatcttctggaaagccgctcgctttctggagaagagaagaagctgctcgaggaatacatcctcgcgcgggacgatagttaacaacgtatcgatggtaggtccgacgacttaccttaggagcacagcatgactaacaaaatcatccttgcactcgaagcagagcagatgaccaaagagatccctacctttgccccaggcgacactattgtcgttcaggtgaaagtgaaggaaggcgaccgttcgcgtctgcaagcgttcgaaggcgtggtaatcgccaagcgtaaccgtggtgtgaacagtgctttcactgttcgtaaaatctccaacggtgttggcgtagagcgtactttccagacctacagcccgcaaatcgacagcatggccgttaagcgtcgcggtgacgtacgtaaagccaagctgtactacctgcgtgacctgtccggtaaagcagctcgcatcaaggaaaaactggcttaagtccagcttcccgatgcagaaaaaagcagcctacgggctgcttttttgtgcctgaaatttgtcaattttccggtaattccccatgaccacccgcctcgaagaaatccagcgtcgcaccgacctgtccgtgacccacgtgaccaaagccgtgttcccgccgaccaccaaccaccacaacaccctgttcggcggcactgcgttggcctggatggacgaagtgtcgttcatcaccgccacgcggttttgccggttgccgctggtgacggtgtctaccgaccgcatcgattttaatcacgcgattccggccggctccatcgttgagctgatcggccgtgtgatcaaagtgggcaacaccagccttaaggtggaagttgaagtgtttgtcgagagcatgagcgccgatggccgcgaaaaagccatccagggtgtgttcagctttgtcgcgattgatgccgacaagcgtccggtgccggtattgcccgggtttgttgactgatccggtaccgcgtcgcggctatcgcaggcaagccagctcccacagatttgtttggtgttgattctgctatcaggcaaaacacaaaacccatgtgggagctggcttgcctgcgataggatctaccagacacccaagaaatcagcctgagcccctatgcccgccattgaccaccctctgatcgaccgcttcctcgatgccctctggctggaaaaaggcctgtcagacaacacccgccaggcctatcgcagcgacctggccctgttcaatggctggttgcaggaaaaaaacctcgagctgatcaatgccggtcgcgagctgatcctcgatcacctggcctggcgcctggaacagaactacaagccacgttccaccgcgcgattcctctcgggtgtgcgtggcttttatcgttatttgctgcgagaaaaactgatcgctatcgacccgaccctgcaaatcgatatgccgcaactcggcaggccattgcccaaatccctgtcggaagccgacgtcgacgccttgctcgctgcgcccgacttgagcgaagccattggccagcgcgaccgtgccatgttggaagtgctctacgcctgcggcctgcgcgtgaccgagctgatcagcctgaccctggagcaagtcaacctgcgccagggcgtgctgcgcgtgatgggcaagggtagcaaggaacggttggtgccgatgggtgaggaggcgattgtgtgggtcgagcgctacatgcgtgatgcccgtggcgaattgctcggtgggcggcccagcgatgtgctgttccccagcctgcgcggcgagcagatgacccgccagaccttctggcaccgtatcaagcaccaggccaaagtggccgggatcggcaaggcgctctcgccgcacacattgcgtcacgcgtttgccacccatttgctcaaccacggtgcggatctgcgggttgtgcaaatgctgcttgggcacagcgacttatccaccacccagatctacacacatgtcgcgcgggcgcgcttgcaggatatgcacgccaagcatcatccgcgcggatgaaattacgtgggaaaccgcccaatttacccaccgcagtctgccctgtggcccaactgtggtaggctttgccggttagcaaaggggacggcctcagcccgtgtttccagaccggtgttccttcccgtccctgcatctgccttcaggagttcccatgcgcttgacccagattattgccgccgcagcgattgcgttggtttccacctttgttgtcgccgacgacgccgccgagcaaacgattcgcaagagcctggccaacctgcagctcgacacacccatcgaaagcatcagtgccagcccgatggccggcctgtatgaagtcaagctcaagggcagccgcgtgctgtacgccagtgccgatggccagtacatcgtccagggctacctgttccaattgaaagatggcaagccggtcaacctcaccgagaaagccgagcgcctgggcgtttcgaagctgatcaacggtattccggtggctgaaaccgtggtttacccggccatcggcgagaccaagacccacatcaccgtgttcaccgacaccacctgcccgtactgccacaagctgcacgccgaagtgcctgcgctgaacaagctgggcgtggaagtgcgctacgtagcgttcccgcgccagggcctgggttcaccgggtgatgagcaattgcaggcagtctggtgctcggccgacaagaaagccgccatggacaaaatggtcgatggcaaggaaatcaagtccgccaaatgcgccaatccggtttccaagcagttcgccttgggccagtcgattggtgtgaacggtacgccggccatcgttttggctgacggccaagtgattccgggctaccagccggcgccacaagttgccaaactggcactgggtgcgagtaagcagtaatcgtcgagccttgacgatcatgacccgccgaacagtcggcgggtcattaattgagagccgcagttgtgcggctgttttccacggccgaccttgagtcggccgtttcatggggagttcttcagtgaaaccggtcaaagtaggcatctgtgggttagggaccgtcggtggcggcaccttcaacgtacttcagcgtaacgctgaagaaatttcccgccgtgcagggcgcgggattgaagtggcgcaaattgccacgcgttcgccaaagcctcagttccaaacgaccggtattgcgattaccaacgatgtattcgccgtggccaccaaccctgaaatcgatattgtcatcgagctggttggcggctacacagtggcccgtgacctggtgttgctggccatcgagaacggcaagcacgtggtcaccgccaacaaggcgctgatcgccgtgcacggcaacgagatcttcgccaaggcccgtgagaagggcgtgatcgttgcgttcgaagccgccgtggccggcggcatcccggtgatcaaggcgattcgtgaaggcctgtccgccaaccgtatcaactgggtggccggcatcatcaacggcaccggtaacttcatccttaccgaaatgcgcgagaagggccgtaccttcgaagacgtgctggccgaagcccaggccctgggttacgccgaagccgacccgaccttcgacgtggaaggcatcgacgctgcgcacaaattgaccatcctggcgtccatcgcctttggcatcccgctgcagttcgacaaggcctacaccgaaggcatcaccaagctgaccactgccgacgtgaactacgccgaagcgctgggctaccgcatcaagcacttgggcgtggcgcgcagcacaccggccggtatcgagttgcgtgtgcacccgacgctgatcccggccgaccgcctgatcgccaacgtcaatggcgtgatgaacgcggtgatggtcaacggtgatgctgccggttccacattgttctacggcgcgggcgccggcatggagccaactgcttcgtcggtgatcgccgacctggtggacgtggttcgcgccatgaccagcgacccggaaaaccgtgtaccgcacctggccttccagccggattcgctgtcggcccacccgatcttgccgatcgaggcatgcgaaagcgcctactacctgcgcatccaggcccaggatcatccgggcgtgttggcccaggtggcgagcatcctgtcggagcgcggtatcaacatcgagtcgatcatgcagaaggaagtcgaggagcaaaacggccaggtgccgatgatcctgctgacccaccgcgtgctcgagcagcacatgaacgatgccatcgccgccctcgaagccctgcaaggtgtggtcggcccggtggtgcggattcgcgtcgagcacttgaactaaccgatttgttccaggggccccgcgcatttggcggcccctgttcgagaatgttttagaggagccagtcatgcgttacatcagcacccgcggccaggcaccggccctgaatttcgaagacgttttgctggcaggccttgccactgacggcggcctgtacgtgccggaaaacctgccacgcttcacccaggaagaaatcgcttcctgggccggcctgccgtaccacgaactggcgttccgcgtgatgcgcccgttcgtcaccggcagcattccggatgcagacttcaagaagatcctggaagagacgtacggcgtgttttcccacagcgccatcgcgccattgcgtcagctcaatggcaacgagtgggtgcttgagctgttccacggcccgaccctggcgttcaaggacttcgccctgcaactgctcggtcgtctgctggattacgtgctggaaaaacgcggcgaacgcgtggtgatcatcggtgccacctcgggtgataccggctcggcggccatcgaaggttgcaagcactgcgaaaacgtcgacatctttatcctgcacccgcacaagcgcgtgtcggaagtacagcgtcgccagatgaccaccatttttggtgagaacatccacaacatcgccatcgaaggcaacttcgatgactgccaggaaatggtcaagaacagcttcgccgaccagagcttcctgaaaggcacacgcctggtggcggtgaactcgatcaactgggcgcggatcatggcccagatcgtttactacttccatgcagcgctgcagctgggcggcccggcgcgttcggtgtcgttctcggtgccgaccggcaacttcggcgacatcttcgccggttacctggcgcgcaacatgggcctgccgatcaaccagttgatcgtcgccaccaaccgcaacgacatcctgcaccgcttcatgagcggcaaccagtacgtcaaggaaaccctgcacgcgacgctgtcgccgtcgatggacatcatggtctcgtcgaacttcgaacgcctgctgttcgacatgcacggtcgcaacggcgctgccctggccgagctgatgaacagcttcaaaagcggtggcggtttcagcgtcgagcaagagcgctggaccgaaacccgcaagctgttcgactccctggccgtggacgacgcacagacctgcgaaaccatcgccgaagtctatgcacagaccggcgagctgctcgacccgcacaccgctatcggcgtgaaggctgcgcgcgaatgccgtcgtagcctggacattccgatggtgatcctcggcaccgctcacccggtcaagttcccggaagcggtggaaaaggccggtgtgggcaaggcgctggaattgccggagcacctggctgacctgttcgaacgtgaagagcgttgcacggtgctggccaatgacctgaagacaatgcaggcgtttgtcagccagcacgggaatcggggcaagccgctgtaaggcgaaccgcgtagacaaaaacgccgctttcccttccttgggtcagcggcgttttttgtttgtggcaggcccggtcggtgagatcgttcaggcgagtattttcattgccagggctactacgctgctgaagaccgtaaacatggccatgacgacgcccattgggtaccagaaattctctcgggtaatcttgtgagcctccgcattgagtttgcgttgttcggcatagatgcgtgagatgtcagcatgaatcttctcaagtacagcctgttctttatcgtgttccagcattgtatttatccttcctggtaggcccttttgatatgcgctcttgtctgcacagcagtgtgaccagcgctcaccgagcataggattcaccctcagcaccagcctgcggaaacccccaaaacagccaccctttgcgtaagcagttatgtgcgcccgttttttgcctgtcatgttgcaagcgcatgctggttcacgtcactccctgacgaccgcgtaaagacgataaagcgaactttcctacgacataaccagtcacttaggatagaggcagctgccgttgaaacgattgttcccgaactattgagtggtgatcgagatggaaaatatcagcctattgctcgaagaagcactgagcccttatcaggttacgttgaccacctcgggtgtgcaggacgagtgcctggtgaccgtgaagaatccggccggtgccatcgttgtcgagcgtgaagtcgaccgcgcacaattgaccgacaagcgcgttttggtggatgtggtggattgcctgttgcgcgacctgaaaatcgccgaaggtcgcctggaaccctcggtcatcgcggccctgcgtaacgcggcacagacgcgtggcgctgccgtcgcatgaagaaaaatttaatcggcgaaacttcctacagcatggccggtcagattttttaacagcaagagcaaacattgtgctccggtgtttgtggcttgttgtactggtctttgtaggccacgtttaaccccgaagtgtctccccactcttcggggtttctttttgcctgcgatttaccctgtggctgctcagggctcgggggaatcctggaaaaacctcgggttgtcgcgcaaatactgttcacgcaggcccgggtccaaccatgaggcgtaggattgctgcagttgcgcctgtgggatctcacgtagtaccaggtcaatgcgcgtcatggcctggcggccttgcggcgtgtccgagcaaccgatatgcgtacgctggtaaggcgctgagcctttgatggcgtagaacatcaggtcttgtgcggcgatgccctgttgcttggcgtgatagcgaatttctggccaatagcccaacaccgcttccaatcgccccaagcgctgcatttgcaacaggctcccaagggcatcattgccgtaatggagcgccaaggtgtgtgagtcaacgcctttgagctgttcatcgatcacagggccgtagctgcgctcggcggttgcgccgatccgtgccttatgggagtcgagaaaggcttgcaggtcgaattggccctcgacgataaacggcgccagtgcttgctgctggctgcgtcggatggtcaccccattggccaccgccacgaatgcctgtttggaaaacaccacatacttggcgcgttccgcggtccacaacagcgacgggtcgcaggtgagggagggcgcgcgcaacatttgaatgccgcgcgcacggttgacgtgcatcaccgtgtggcggtattccggcaggcgctcgctgagtatcggcagcagctggtccagcgccccttggcctttctgcgggccctcgaaaatggtgatgggcggcaagtcgcgcagcagccaaatcaaggtttcctcggcgtgcgcaaagaatggccatacgccgaacatcgcgccggcgaggtacagacggatgaaccggcgcttgcgcggacgagccatcagatcgcgccatcctcacgcaagcgggtaatggctggcgcgtcatagcccaacgcgttgagcaccacgctgttgtgctcgcccaactgcgggccgacccattcacaactgccgggtgtgtccgagagcttgggcacaatccccggcatcttgaagtccttgccgcccggtaactgggccttgagaaacatttcccgcgccagaaactgagggtcgccgagcatgtcttcagcgctgtagatgcggctggcgggcacgtctgccgtgttgagctgctcgacgacctggtccagcggcagcgaattgacccaacggtcgatcacgccgtacagctcatcgcggcggctgtcgcgcccatcattgctggccaattgcgggtcattggccaagtcctcacggccgatcgcgctcatgaagcgcttgaaaatcgcatcaccgttggcgccgatctgcacatgtttgccatcggcgctggtatggatcgacgacggcgtgatgccaggcatgatgttgccggtgcgctcgcggataaagccgaacacatcgaactccgggatcatgctttccatcatcgcgaaaatggcttcatacagcgccacatccaccacctggcccaggccgccgttgacttcgcgatgacgcagcgccatcagcgcgccgatcaccgcccacaaggcggcaatcgaatcgccgatggaaatcccggtgcgcaccggcggtcggtcttcgaaaccggtgatatagcgcaagccgcccatcgattcgcccaccgcaccaaaccccggctggtctttcatcggcccggtctggccaaagcctgaaagacgcaccatcaccagcttggggttcagtgcgtgcagggtttcccagctcaggccgagtttctccagcacgccggggcgaaagttctcgatcaggatgtcggcatccgccagcaactgtttaaggattgccaagccatccggatgcttgagattgagtgtcagcgactttttgttacgtgcctgcacgaaccaccacagtgacgtgccttcatacagcttgcgccatttgcgcagtgggtcgccgccgtccggggattcgaccttgatcacttcggccccgaactcggcacaaatacgtgacgcaaacgggccggcgatcaaggtgcccagttcgatgactttcaggccggcaagcggtttggcattaaacgacatgatgatccttagcaagcgcagggcggtggtgtgatgccttttaacataggcgagcggcccagggataaggatgatacagcgcagtattcgttgattggccccaccatcggttagactggccgcctttccctgtctctagaagcccgttcatggcccagccgtccacgacctacaaattcgaactcaacctcaccgacctcgatcgttcggtgtacgagagcgtcaaacagaccatcgcccgccacccttcggaaaccgaagagcgcatgaccgtgcgcctgctggcctacgccctttggtacaacgagcagttggcgttcggtcgtggcctgtcagatgtagacgaaccagccttgtgggaaaaaagcctggatgaccgcgtcctgcactggatcgaagtcggccagccggatgcggaccgcctgacctggtgctcgcgtcgcaccgaacgcaccagcctgctggcctatggcagcttgcgggtgtgggaaggcaaagtggtgccggtggccaacaacctgaagaacgtacacatcgccgccgtgccgcaggaagtccttgagaccctggccaaggacatgccgcgtgttatcaaatgggacgtgatgatcagcgaaggcactatttttgtgactgacgaccgtggccagcatgaagtgcagttgcagtggctggtcggcgaacgcggctgaatctgtaggcgccagctcctgtgggagctggcttgatgtgggagccgggcttgcccgcgatagcatcgcctcggtgtggctgatagtccgaggtgtctgcatcgcaggcaagccagctcccacacaagccagctcctgcacaggctggctcctacacaggctggctcctacacaagccagctcccacagttgatccgtgttgcttttggcattgttgtttaaccgttgtactagaagagaagtttccgtcaccccatgcgtatcgatcctcgcccgttgcctgctgtcctgccgtttctcggtgaattgccaccgctgttgacccgtctctacgccgcacgcggcgtgcagtccgaggccgagctggacaagagccttgcgcggttgattccttaccagcagctcaaggggattgatgccgcggtggacctgctggtggtggccttggagcagcgccagcgcatcctgatcgtcggtgacttcgacgccgatggcgccacagccagcaccgtgggcactctgggcctgcggttgctcggcgcggcccatgtcgactacctggtgcctaaccgctttgagtacggctacggcctgaccccggaaatcgtcgcggtggcgctgcagcgcgagccacagttgctgatcaccgtggacaacggcatctccagcgtcgaaggcgtagcggcggccaaagcggcagggttgaaggtgttggtcaccgaccaccacttgccgggtgatgagttgccggcggcagatgccatcgtcaacccgaaccagcctggctgtgagttccccagcaaggcgctggccggcgtaggcgtgatcttttacgtgctgatggccttgcgcgcgcggttgcgcagcctgggttggtatgacaacaagcctcagccgaacatcggcgaattgcttgacctggtggccttgggcagcgtcgcagacgtggtgcccctggacgccaataaccgcatcctcgtccatcaaggcctggaacgtattcgcgccggccgtgcgcggccggggatcaaggcgatccttgaagtcgccaagcgcgaccacgcgcgcatcacctccaccgacctcggctttatcctcgggccacgcctgaacgccgccgggcgcctggacgatatgagcctgggcatcgaatgcctgctcactaccgacgttgccgccgcgcgggaaatggcggcgcaactggacggcatgaaccaggaccgcaaatccatagaacagggcatgcagcgcgaggcgctcgcccagctcaaggacttgccggttgagtcgatgccttacggcttgtgcctgttcgacccggaatggcaccagggtgtgatcggcattctggcgtcgcggatgaaagagcgctatttccgcccgaccatcgcctttgccgacgccggcgatggcctgctcaagggctcagggcgctctgtgcagggttttcatatccgtgacgccctggcggtcgtggcgagccagcatcccaatctgatcgccaaatacggcggccacgcgatggcggctggcttgaccttgcgcgaagagaacttcccgctgtttgccgaagccttcgacgctgaagtgcgtcggcaactgcgtgaagaagacctgactggccgactgctgtctgacggtacgttggcggtggaagagtttcacctggaactggcgcgcgccttgcggcatgccgggccgtggggtcagcactttcctgaaccgttgtttcacggcgtgtttcagctggtcgagcagcgcgtcgtgggagagcggcacctgaaggtagtgctcaagagcgaatgcgggtcggtgaagctcgatggcattgcctttggtgtagaccgtgaagtctggccgaacccgacggtgcgttgggtggagttggcctacaagctggacgtgaacgagtttcgtgggaatgaaactgtgcagttgatgattgcgcatatcgaaccgcgctaaaactcagcccccaccacaaaacaaatgtgggagctggcttgcctgcgatacaggcacctcggtttttcagttgcaccgaggtgatgctatcgcaggcaagccagctcccacaggagtgcctacctttagttttgtgcgcgaccggagttactcggccttatccttggcctgatgcttcacgatgatatccaccaagcgctgtgccagcgccgggtagttctcatcaaagtgatgcccgcccggcagtttcaccgcctcgccaaccgccgtcttgtcggtgcagccactctcgtcgacttcttctgcaccgtagatgcacaccactttgtcagccggcagcttggccatttccgggccggtggcggcttctttgccggcgttgcccagccagccttccacttcgatctcaaagctgccggtacgcgcgaaggccagcaggatgatcgcgtccacacgctgttgttcgttttccggcatgcggttgtagatcgctggcagtacgtcggcgccgaacgagtagccggtcagcacgaagcgcttggtgccccatttctgccggtagtgctgcatcaactcggtgaggtctttggcgctctgttccggggtcttgtgctgccagtagtagcgcagggtgtcgatgcccaccaccgggtagccgatcttggccatttcaccggccacgtcgcggtccaggtcgcgccagccgccgtcaccggagaggaacagggtgacggtgtccttggcttggccagccggtacttccaccacaggaatcgccaggccgccgttgtccgaacccaccagttgcttgcgcagttcgttgttcagtacttgcgggtaatgaatgtcgtagtcactgatgctggtggtggcgcgcggggtgtcgcgcacgaaactggcggcatcatcgtcagggttgtcgttccatgccaccagccaattgccgtgggcggcggttttcggcagtgggtccttgcagccttcctgtgtcatggcgaagccgacggagatggcgttggccttgtcgtcggtctgtgccgccaaccagcgccaggccaggcttgcgccagggccgatgccgctgaccagcgtcgccgggcctttaagctggcccagggcgctttgcagcgcttgttcctgcaacttgcagtcgtctttgggcaggatcacttgaacgatttgtgcagagccgccctggctcagggcaatcagctggctgtcggtcaaggttgcatcggccaatacggccacagccacacgggcttttgccgaaccggcaggggtgacacgggtcatcaccgaaccgtcggcctggggcagttgttccagggtcggttgcggggcagggcggttccagtaccaaaagccacccgccgcgatcagcgcgagcagcactacaaaggccaatacataccgccaggagcgtcgaatcatcagcgtttcaccaatccagtcaagccgcccgcaatcagggcggcggtatcggccagtgccaccagcggatcaagtcctgcgggcacggccatataacggggttcccagtcaggctggaacttatctttgaagcggcgcaaaccttggaagttatacagctgctcgccacggcggaacaccatcgagcccaggcgttgggtcaacggcgcgccacggcgtggttgcaggcccgacaacggcaccatgccgaggctgaagcgggcgtagtcgtggttcttataatgttgaatcaggccaaccatcatgaattccatggtcagcttcggcgcgtccgggtgcgcacgcatcaggtcgagactggccaggtcgtggttgtaagtctcgagcaggttggcgaaggccaccgggcgcccttcgaagcgaatgatcgcgatgcgaaagtgcttgaggtagtcgtcgctgaaacggcccagggaaaagcccttttcccgtacgttcttgccggtcagccaggcatcggagatgaccttgagttcatccatcggcgcctggcccgggtcgaagatctccagggacaagccgtctcgggtgccacggttccaggtgtagcgcaaatccttcatctctttgcccttggcttccaggtcaaagcgtttcaggtcgacgcgggcttcttcgcccagcttgatcgcggtgaggccgatgtccatgtagtacggcaggttctcggcgcggacctgatagaaaaccgggcgtgcgtggtggatgtcacacaggtcacggaactgccagatcatctcggcgcgtggttgagtcgggccgatcgggtcatacaaggccaccaggctgcgcccgcgacgagcgtacatcaggaaggcttcgtcgttagggtggaacagcaatgctttgtcgccggtcagcgccaggccgccgtcgggctgggacgaggccatcaggatcttggtggcgcgttccagttcgtcaggcgtcggcagatggatcaccgggcgcgcggtgcgcagcagccaggtcagcgacacgatcaccaacagcacagccgcgcccagcagcgagcgcaggccgcgtggggcgttggcgtccagggtgaactgccaccacagttgatggctgtatggcacgtcttgataggcaaacagcaacagccagatggaggcgcccagcacgcagacgctggccaccaggtacagcggcgagaacggcagttcggtcaggcggctggcgcggtagaacgaacgccggaagatcgccagcagcaccgccgtcatgatcatcaggctggcttcttcccagtcgaagcctttgagcagcgagagcagggcaccggtcagcagcagcaccatggtcagcatccaggcggccgacaaccgccgacgcaaaccctgggcgagcaacaggcacaacacgccgatcaagctggcaccaaagtgcgaggcgtcaatcaggcgatggggaatcaggaagccgatgttttccaggcgtgagtcgatttccggcgttgcgccggaaaacagcaggaccacgccggataaaaaaaccagtacggccagcaccggtgcggccaggcctgaggctacccgcaggctttgctgggtctggaacaggcgctgggcttcgttgaccagcaggaacacgcaggcgatcagcagcggcagcaccacatagatcatgcggtacagcagcagggcggcggccaatggcgcggcgccgagcttgtcggcgaaggcggcgagcagaatcgcctcgaatacacccacgccacccggcacatggctgagcacaccggcggccagggccagcaggtacaccagcaggaacgggccgaacggcggtgcttccggcagcaacatataaaggacggtggcggcagcggcgacgtccagcgcggtgatgatcagttgcaggaacgtcaggcgccggccgggcaggcgcagggtacggcgcccggccttgaccagcaggttgtccgggtagggctgctccggcaggcgacggcgataaatgccgatgcacagcgcggccgacagcagcagcaccgcgccggcaatgccaccgagcaaaccctgcgacagatgcaggtacgtcgatgccgccggcaagttgctcaatgtggccagtgcggccagtggcggcaacgcagtgcccagggccaggctggcgaacacggtcatgtgggcgacttctgcagcgccgatgccatggcgtgcatagagacggtaacgcaccgacccgcccgagagcatcgacagaccaatcgcgttgccgatggcgaaggctgtgaagccgcccatcgccagggtcttggccggcagtttcactccggcatagcgtgcgccggagaattcataaccgagcagaatgatgaaaccggcgaccgccgccgcaaacgcgccgagcagggcaggcttgggcacttccaggatcgagtcgtggagggcgtacaggtccagttccagcaacaggtgtcggcaggcgatcagggcgattgcgaacagcaacagagtaacggccaacccaatgggctgacggtatttactcaacagatccagccagcgcaaacgggtgggtgggatcggttgtgtcgctgtgacggtgtcttgtggttcagacgagttggcgcgcatcaatcacctcgtggattgtgcgcgacaggatggaggtatccagccaagttaccaatccctatggacaaaataattacaaatattaacgcgtatcgccgggtgcggcgactgcggccattggtcgtagaggatagcgcttgagcattgagcatagcttgcaaagacatggactcaacaaaccgcgcagggtttcatgaaagatgccatgccattgtttcagaagaactttttcaccggatacaaaaaaggccactctttcgagtagccttttttgatgtttggttgcgggagccggatttgaaccgacgaccttcgggttatgagcccgacgagctaccagactgctccatcccgcgtctgtgggcggcattctacagcccagcggcggggtgtcaaccgttaatgggctgatgggtcaaattagtgtgaattagtcgctcaggcaacctaagttctcgattggaaacggttttgtagtgagcgggcttgtcccgcgacgggctgcggagcagcccgtagtgaagttcatgcagtcttagttagaagaaacgcgcacgcacaaaaaaggccactctttcgagtagccttttttgatgtttggttgcgggagccggatttgaaccgacgaccttcgggttatgagcccgacgagctaccagactgctccatcccgcgtctgtgtgtcggcattctacagaggaacgcagatgtgtcaacctgtgaattgaagaaaagcgcttgtggttcaatcgtttagctctccaaggtggggtttggaacggctcggggccagtctggccgtgggtttcggctctatcggaaggctgatttcgattgagaaaataaattcatctgtgaaatttcctaccgctcaagcggaagaatcaaactactggtgctatatacaggggtgagtgcgatactggccacccgttggattacaccctctgtttatatgacgcagcgcaaaatcatccacgtcgactgtgattgcttctacgccgccatcgagatgcgcgacgacccgagcctggcacaaaagcctctggccgttggcggttcggcggacaggcgaggggtgatcgccacctgcaactatgaggcgcgggcgtacggggtgcgttcggccatgtcgtcacgccacgccttgaagctgtgcccggacctgaccatcgtcaagccgcgcatggatgcttataaggaagcgtcgaaggaaatccagacgatctttcgtgactacaccgacttgatcgaaccgctgtcgctggatgaagcctacctggatgtttccgacagcccgcatttcggcggcagcgccacgcgtattgcccaggacattcgccgtcgggtttccaaccagttgcacatcaccgtgtccgcaggcgttgcgccgaacaagtttctggccaagatcgccagcgactggaaaaaacccaacggcctgtttgtgattaccccggatcagatcgaagactttgtctcccaattgccagtgaaaaagctgcacggcgtcggcaaggtcaccgccgacaagctggcgcgcctgggcattgaagactgcctgcagttgcgtgactggaacaagctggcgctggtgcgtgaattcggcagttttggcgagcgcctgtggagcctggcgcgtgggatcgatgaccgtgtggtgcagaacgacagccgccggcaatccatcagtgtggaaaacacctacgatgtggacctgccggatctctcaagttgcctggcaaagctgcccgagctgatggaaaccctggccgggcgcatggcgcgcatcgacagcagctatcgcgcgggcaagccgttcgtcaaagtgaagtttcatgactttacccacaccaccttggagcaggccggggcagggcgggacctggaaagttatcaacagctgttgacccaggcgttcaatcggggcggcaagccggtgcggttgctggggattggggtgcggttgttggatttgagcagtggtaatgagcagcttcagtttccctggtagaaaccggaaaaaactgtgggagctggcttgcctgcgatagcagagggtcagttattgatgctttaactgatacaccgctatcgccggcaagccagctcccacagttggattttcacccagcctggaatctcagcgagcgcctgggtctgcgacgagccgccccgcatccttggtcagtgcctgcagaaattcctgctgcaactctggatcattgcgggtcagttcgatcaggctctgctccagttcactggcttcttcctccaggcccagctccgacaggcgcttgacccggtgcacccactggttgacttcatcgtcttccaggtcgtcgtaaatcaggccatgggcttccagcaacttgccgcgcagggtgttgctgatcgccagggtcgagtccgaatgcacgtcgtcctggccatcttccacgctgatcttcaaggtgctgacgcggttcaagtcctgctcggcgaatgggctgtccaacaggttcaggcgcaggacgccattgcggtcggtggtcagctcatgggtttgcttgccggcggtgacctgtaccgggcgttcgctccacggcaggctcgaatactccgtgcgtttgtcgcgctggacttcatcgatacccgccaggttctgttgcgcacggccgtgggattgcacgttcatgaacgggttgatgccgtccacgccgtagctcagccagtcgcgggtcatgctggtgggcaggttgccgagggcgaagatattcgccacgttggcgcccgcgcccgccactaaagcgaccgcgcccaggggcatttcgtagactttgcgccagggttggtaaggtgtgtagcgatcgtaacggcgggtgacttcgtattcggtgacctcaaaggtcttctgctcgtgaatgcgaacccggcgttgcggcagttcgagcactttgggttcacctacatcgatctgcaggctgtggtcgagcaatttgcgctcgacccgctcctcgtgctcactgcgttgcgacatctggttggcgcagccgctgaccagcagggcgccgcacaaggcggcgccccccagggctctggtgtttcgcttgaacatgacttctcttgatctggttttcagcgacgaatacgcgcctgaaggaaagacagcacgtcagccaccggcaacggttgggcttcggcttcggtccggcttttgtattccagattgccatcagccaggccgcggtcactgaccacgatccggtgcgggatgccaatcagttccatgtcggcgaacttgatgcccgggctggttttcttgtcccggtcatccagcagcacttcaaaaccggcggccgtcagttcggcatacagtttgtcggtggcttcgcgaacttgctcggtttcataacgcagcggcaccaacgccacctggaacggcgccagggcgtcactccagatgatgcctttctcgtcgttgttctgctcgatggcagcggcaaccacgcgggatacgccaatgccgtagcaacccatttccagggtgatcggcttgccgttctcgcccagcacttcgcacttcatcgccttgctgtacttgttgcccagctggaagatgtgcccgacctcgatgccgcgcttgatttccagggtgcccttgccgtccgggcttgggtcaccggccaccacgttacgcaggtcggccacggtcggcaccggcaggtcacgttcccagttcacgccgaagtagtgcttgtcgtcgatgttcgcgccgataccgaagtcgctcatcagctcaaccgaacggtcgatgatgatcggcagcggcaggttcagcgggccgagcgaaccggcaccggcgccaatcgcgtcgcgcagttcggcatcggtggccatgaccaacgggctggccacgccaggttgctgggcggccttgatttcgttgagctcatggtcgccacggatgaccagggcgatcagcttgccttcttcctcggcgcgcacgatcagggtcttgatggtcttttcaatcggcagattgaatttttccaccagggccgcgatggtcttggtctctggcgtgtccaccaggcgcagttcttcagtcggtgccgggcgggaggtctcgcgtggcacagcttcggctttctcgatgttcgccgcgtagtcggaaccgttgctgaagacgatatcgtcttcgccggactcggccagcacgtggaattcgtgggaaccggcgccgccgatggaaccgttgtccgcttcaaccgggcggaatttcaggcccaggcgcgtgaacacgttgcagtacgcctggtgcatgcggtcgtaggtgacctgcagggaggcctggtcggcgtggaacgaataggcgtccttcatgatgaattcgcggccgcgcatcaaaccgaagcgtgggcggatttcgtcacggaatttggtctggatctgatacaggttcagcggcagctgtttgtagctgctcagctcgttgcgcatcaggtcggtgatcacttcttcgtgggtcgggccggcgcagaaatcgcggccatgacggtccttgaagcgcagcaattcagggccgtactcttcccagcgcccggattcctgccacaactcagccggttgggtgctcggcatcaacacttccagagagccggcggcgttcatttcttcgcgaacgatggcttcgaccttgcgcatcaccttcaagcccatgggcagccaggtgtacaggccggaggccagcttgcggatcatgccggcgcgcagcatcaactgatggctgatcacaaccgcgtcggaaggcgtttctttctgtgtggcgagcaaatattgactggtacgcatggtaggccgttgtcggttgcttggacttgaaatgacttgggattgtacgggcggttgctgccggagtacaggcatgaggtcgcgggggtgtttttgttggcgcagggcttttgtgggagctggcttgcctgcgatgggatcaccgtggtgtatcagatacaccacgtcgtctgcatcgcaggcaagccagcgcccacattgattgaggcgtgtcagtcttcctggggcgggctcaaccgaatccgccgattttcctgaaaccaatgcaaggcaatcaggaacaacgtcggcactcccagcaggcaggtgatcaggaagaagttgtgatagccgaacttctccaccatcacgcctgaatagccgccaatcaggcgcggcagcaacagcatgatcgagctgagcaacgcatattgagtcgccgagaacttcaggttggtcaggctcgacaagtaggcgacaaacgctgacgtggccaggcccgagctgaagttatccagggaaatggtgaagatcagcatctgcaggtcggggcccatgtcggcgagcatcacgaacagcaggttggtggcggccgaggcgacgccgccgataaacaggatcggcaggatcccgaagcgcacgatcagcagcccgcccataccggcgccgagcagggtcatgatcaggccgaagatcttgctcaccccggcgatctggtccttggtaaagccctggtcgatgtagaacacgttggccatcacgcccatcacggtgtcggacatgcggtaagtggcaatcagcccgagcagcagcaacgcctgccagcgatagcgcaggataaagtcgttgaccggcgtcagcaccggcgccaggccgcgacggcccatggccgacaggcacagggtggtgaggatgatgtacagaatggcgcgcaggaacgcgcggtcttccatcaacagctcccacaggctcacgccatggaacagcacgctggcaaaatcggtgttgtacagctgggtgaacatggccgggaccgacaccagcagcacgatcagcacaaagaccgagaccaactggtgcacgaagctgtaacggccggcctgcaattgggtgcgcagtggcacgttgggttcgcgcatgaacaaggtggtgagcaacgcggggatcatcagcacgccgaacagcacgtaggtgccggtccaggccgagtgtttatagttgaacccggtcgagccgaagccttcggcaaagaacagtgcgccggccgtggccagcagggccgcgatgcgatagccggacatatagctggcagccagggctgcctggcggctgtcgtcggcgatttccaggcgataggcgtctaccgcaatgtcttgggtcgccgacgcgaaggcaacgatgacggcaatggcgatcagccaggacaggtgtttttgcgggtcgcaaaagcccatgccgatcaacccgaggatcaccagcgtttgggccagcaccagccaggaacgacgacgtccgagtttacccagcagtggcaggcgccattggtcgagcagcggcgaccagacccatttaaaggcgtaggccaaaccgatcaggctcgcataaccgatggtctcgcgggccacaccggcctcgcgcaaccacactgaaagcgtcgagaacaccaacatgtaaggcaagccggcggcgaagccgagcaacaacagtactaacgtcgaggggctggcataggcagcgagcgcggcgcgccaggttttacggggcatgggctggagtctgcctcagatttgcggaaacaaagcgcgcactctaaccgctgtgctctaccgggcgccagccatgacgctgaatatcaacgcgattgttcaggatactgacgccttcactgcgtaaacgcgcgcgttgttcgtcgcctgaggcactgcccaccggcagacttatccgaccaccggcacccagcactctgtgccagggcaagcgagtgtcctgtggcagttggctcagcgtgcgcccgacccagcgggccgcgcggcccaacccggccagatgggccagttcgccgtaactcaccacgcagccctcgggcacttgcgccaaggtcaggtacagcgcggtgcggcgcatttcggcggggctttgagggatgtcgtcgggtggattctctgtgggcatcgtcagggtctttgtaagaaacgtctgtaatcatgcaggtgagaattgaactcaatataaatacttgagtcagtcctagctatctaacacgataacgcccctttttcgccaactccgagccccaaatacgcttatgttgtccagaaccctgctgtgcctcgctgttttcagcgcctccacgcccttgctcgccgacaccgtctggttgaagaacggtgaccgcctgacgggcaagatcaagctcttcgacggtggcaaactgctgattcagaccaactacgcaggggcaatcccggtggactggaaacaggtgaaaaccctggaaagcgaccaggaattgctggtcaagcaggacgcctacaccggcgagaaggccaagtccttgaaggcagcggaggatggcaaggtggtcttggccaatggcgaagcccccaaaaccgtggagctggcgagcatccagcaaatcatcaagcccaagcctgtgattgaagacctggtgtggaaaggcaacgtcgacctggcgctcgactacaagcgtgccgacaaagacaccaacgactacgacgtcgacttcaagaccaccgcccgtcacggccagtggcgtcataccggccagggcgaatacaaccgcgagttccaggacgacgtcaccaccaccgacaactgggcgttggaatatgacttggaccgcttcctcaccgagcattggttctggcagggccgcctgacctacaagcgcgacaaggttgaagacttgtcacgccagcgcaccgtcggtacaggcccgggttaccagttctgggacgacgaactgggggcgttctccctcggttcgctggttaaccgcaccgattatgagtattcggacgatcgcaagaccaacttctattccctggccatgaagtggaactacaaccgctacctggtgggtaaaaccgttgagttcttcactaacggcgaggtgggcaagccgctctccgggccggccaagtactcgctggattcggaaatgggcctgcgttacaaagtcaccgagtgggcgtccctgaacctcaaggccgaacgcgacatcattgatggcgattcggaaagcagcttgagcaagacccgttacaccgcaggctttggcgtggcctggtaaacgctgcacagagcactctggcaacctgcgcggttattgattaccttgtgttgagattcattcccatagacgccataggctatgggcggctgattacccgaggagtcatacgttgagcgcgcacgttgccaagaacgcccgagagctgttgctcaaggaataccgtggggctctctccacattgtccaaagccatgcccgggtttccctttggctcggtcgtgccgtattgcctcgacgagcagggccgaccgctgatcctgatcagccgtatcgcccagcacacccataacctgcagaaagaccccaagtgctcgctcctggtaggcgagcgcgaggccgatgatgtacaggccgtcggccgcctgacgtacctggccgaagccgagaaactcgacgacgccgacgccattgaagcggccgccgagcgttattaccgctacttccccgattccgccaactaccacaaggcccacgatttcgacttctgggtgctcaagcctgtgcgtcatcgttatatcggcgggtttggcgccattcattgggtcgaccaattgaccctggccaatcccttcgcgggcaaggccgagcgcagcatgatcgagcacatgaacagcgatcacaccaaggccatcgcgcattacgtcgcgttgaccggcttgccgaccgttgaaccggcgcaattggccggcatcgacagcgaaggcatgcacttgcgcattggtcagtcgttgcactggctgcccttcgcagcgtcttgcaacactccgacacaagtacgcgaagccctggtttcattggctcacgccgcggtctggccgaaaaaagagcctgccagcgcttgaattcacgaaatggcgacgtcatctaaggtggactggcaaggcattcttgcgttgaggaaccatttgatgcgcccttttttattgctctttctgctatttccggtgttggagctgttcgtattcgttcaagtcagcggtgcgatcgggtttttcccggccctgttgctgatcattctcggctcgatgctcggcgttctggtgctgcgcgtcgccggcctggccacggcgttgcgtgcccgtgaaagcttgaaccgcggcgaactgccggcccagaccatgcttgaaggcctgatgatggctttggctggcggcctgttgatcctgccgggtttcatcagcgacgtggtcggcctggttatgctgctgccggtcacccgcaagctgctggccggcaagatgcgccagcgcgccgaagaggctgcgattcgccagcgcgcgttcgccgacgacctgcaaccccgtggtggcccggctccgcgccagccgctggggcgtgaaggtgatgtgatcgaaggcgagttcgaacaccgcgacagtaaataaccgctttatgagcacggcaccttcgggtgccgtgttgcatttggttgccagcagacacaaaaaaattccgctgcgaccccttgtaataagcttatgcgcccttatgtaacggtcaccgcaaggtttctggtggcgacaccagacagacttccgcgtcttgcttggcgaggcgcgaccggcacagccggaatacaacccgccggtaccgataccggccgatgaaaaacacaattaggagagatcgacaatgagcaagcttcgtcctctgcacgaccgcgtcgttatccgtcgcagcgaagaagaaaagaaaaccgctggcggtatcgttctgccaggttcggctgctgaaaaagccaaccacggtgtgatcgtcgctgcaggcccaggcaagactctggaaaacggtgaagtgcgtgcgctggccgttaaagtcggtgacaaggttgttttcggcccttactccggcagcaacactgtgaaaattgacggcgaagacctgctggtcatggctgagaacgagattctcgctgtactggaagcttgattttcccgctcatttttctgctactccaaagaatttaaggaatatcgatcatggctgctaaagaagttaaattcggcgattccgcccgcaaaaaaatgctcaccggtgtcaacgtcctggctgacgcagtaaaagcgaccctgggccctaaaggccgtaacgtgatcatcgagaagagcttcggcgctccgaccatcaccaaggacggcgtttcggtagcaaaagaaatcgaactggaagaccgtttcgagaacatgggcgcgcagctggtcaaagacgttgcctcccgtgccaacgatgacgcaggcgacggcaccaccaccgccaccgttctggctcaggctatcgtcaacgaaggctacaaagccgtcgctgccggcatgaacccgatggacctcaagcgcggcatcgacaaggcgaccatcgccgttgttgctgagctgaaaaacctgtccaagccatgcgccgacaccaaggctatcgctcaggtaggcaccatctccgccaactccgacagctccatcggcgacatcattgccgaagccatggaaaaagtcggtaaagaaggcgtgatcaccgttgaagaaggcactggcctggaaaacgaactgtcggttgtagaaggcatgcagttcgaccgtggctacctgtccccgtacttcgtcaacaagccagagaccatggttgccgagctggacagcccgctgatcctgctggtcgacaaaaaaatctccaacatccgtgaaatgctgccagtactggaagccgttgccaaagccggccgcccactgctgatcgtttccgaagacgttgaaggcgaagccctggcgacgctggttgtgaacaacatgcgtggcatcgttaaagtcgcagccgtcaaggcgccaggcttcggcgaccgtcgcaaggccatgctgcaggacatcgctgttctgaccggcggtaccgttatctccgaagagatcggcctgagcctggaaagcgccaccctggaaaacctgggcagcgccaagcgcgtgaccatctccaaagaaaacaccatcatcgttgacggtgctggcgtagagcaggacatccaggcgcgcatcactcagatccgtgcccaggttgccgaaacttcgtccgactacgaccgtgaaaaactgcaagagcgtctggccaagctgtccggcggcgttgcagtgatcaaggttggcgcgggttccgaagttgaaatgaaagagaagaaagcccgcgttgaagacgccctgcacgcaacccgtgcagccgttgaagaaggcgtggtacctggcggtggcgttgcgctgatccgtgctctggaagcgctggttgacctcaaaggcgacaacgctgaccagaacgtcggtatcgctgtactgcgtcgtgccgtcgaagcaccgctgcgccagatcgctgccaactccggcgacgagccaagcgttgtggtcaacgaagtcaagaacggcaaaggtaactacggttacaacgctgcgactggcgtctacggcgacatgatcgaaatgggcatcctggaccctaccaaggtgactcgttcggcactgcaagcagcagcttccatcggcggtctgatcctgaccaccgaagcggcaattgctgatgcaccgaagaaagaaggctcggctggcggcggtatgccagacatgggcggcatgggtggcatgggcggcatgatgtaagccagcctcacccggctactgaaaaaccccgcctgcagcgatgcaggcggggttttttatgggctttattcaatgcatcaaccgatggagcggcgccgcaacagctttttgaaggtcatgccccgggccagcatcagttcggcatgcggcacaagtgccaggggttgcggtgcagcagcttcgttgagtgggtgagtgacaggcaggtgcgcgagtttttcagcgcgggtggctctgggccgcctccggtgttcagctacaacgaccctgcctgtcacgcttgggtagcacacggctttgcgtgtgtagtcggcgacgtattggtctatgcgttgcgctggcgagtgtgtgaccgccagtggcaaggccgacgctgtgccggtgacgatgcacaacgacagcagcagcgtaaacaaatgcttcttggggggacgcatgtacgggctctccaacctgggattcaggtggcagagagtaggggcaatggcagcgtctcgctgtcacaggctgtaacacgctaactatagtgggcgcagcggcaacaccagggtcaggcgtgcaccgcccagcgggctgcgggccaccgtcaattcaccgtggtgccactgggtcgcacgtttggccagcgccaggccgaggccgaaaccgccgggtgcgtcgccgcccatggcaagccgcacaaagggctcgaagaccttttcacggttttccgcgaggatgccgggcccatcgtcatccacatgcagcaccaagtgatgttgcccctgatacgccgcgctgacacacacttgctcgcgggcataggtgatggcattgctcaacaggttacgtacgatcaggtgcaacaaggcgcggtcgccgaccagttccagcccggccggctcggtttccaggctcaaccgtcgatggtgcccgtcgagcagggcgaactcttgatgcaaccagtcacgcaggttgatcggttcgtgctgcaagtcggtcggcgcgcccgcaaggcgagcaaacgccaaactggcgcgaaccaaggcttcgagctcttcgacatcgatgagcaaacgttcttgaaggcgcgttcgggtgggcgggtcttcgcttttgcccagcagcgataaagcaaagcgcatgcgcgccaggggcgtacgcagttcgtgtgacaccgcctgggagacttcgcggtggcgttcactcatggcgctgatgtcccgtgcatgctgttgcagcgtcagcagcaacggtgtccattccttgcccatggcgggcaacatcacgttcgggctgcgcgccagtgtcgccaggcaggtattgagtgtgtgcaggtcggcgtggcgccgccggtgcaggcgtaaaccaatcccgagcagtagcagcaccggcaggcctgcgacgcaggcggtgatccagaacaccgggaatttcagcaggtccttgacctcggcgctgccccacatggggccgaatcggatcacggtttcgtcgtcgagcgggaagtagctgatgtcttcgtcgctgttcagtgccggttgcctatgttccagcatgaccatggcttccggcggcagctccacatcgtccagcgcgatcaggttcaccgggtactgaaagtgcgcccgcagggtatccatccgcgcttcgcgctggtcggcgggcacgcctttgagctgttcggccaccaggtagcccggcccggccatcaggcgcaagaagctgtcgtcacccacaaatactgaggcgttggtgcacagccagagcaggtacagcgtcaagccggtccagcccgcgccggccgtcgccaccatccagggccgcaatttagagaacacgcgcggcctcctgcgggatttcgacgaacagatagccttgggccgtgatggtctggatggtcaccgggcattccaggctcatcagctttttgcgcaagcgcgatacgcgcatatcgatggagcggttgagcccgtcgtattccaggccgcgcaggctttgcaggagtttttcccgcgtcagcaagacgccgcaatggcgggcaaaaatcgccagcaattcgaactccgcaaccgagaactgcaagggcgcgtcattcagccaggcgaaatggctgttgaggtccaagcgaaacgcgccccactggtaatacgcgcgaggcgcttgcgggtggcggcgcagcaacgagcgaatcctggccagcaacaactgtgggtcgacaggcttgaccacgtaatcgtctgccccgacgttgaacccggtgagctgttcggcgttttcgtccagtgccgtcatcatcaggatcagcccagggtattggtcgcgaatctgtcggcacagggtgaagccgtcgatacccggcagcatcacgtccaggatcaacagcgccggctgctcgtcgcgaatgcgctgggcggcgcggtcgccccggtgctcaatggccacggtgaaaccttcggcgcgcagaaactcggcggtcagcgcggccagtgggcggtcatcttcaatcagcagcagggtgtcggacatgaacgggcgtcgtcgccagggaatgggcgcaagtgttacgcccttgccctgtggcaggcaagggcttgagtggggctgtcagcgggtgctgatggtcgcagcctcatccttcggcgctttccagctcagcagttgctgtttgaagccatagctggcggcctggtagtaggtgattgcgcgcaggatcaatgggtcatcactgcccacgcgcaactcctggctctcggccaaggcttggtcatggcgacgcaggcccaggcgggggctgaggattgccaggtccttgccgtcaaacaaccccaggtgctggtagttgccgaccaccacgcgcggcggcagcgggttgtcctgcaacaggttgcggccaaaaaaggtcgactcgtagctcaggttgatcaggcccagcaaggtcggcgccaggtcgatctggctggccagttgcgcggtttcgcgggcgtcgatcagcttgggtgcatagataaacagcgggatctggtagttggtgatgggcaagtcttccttgcccgcgctgccggcggtgtggtcggcgacgaacacgaaaatcgtgttatcgaaccacggcttctggcgtgccgcctcaaggaactcgccgatggcgtggtcggtgtatttcaccgcaccgtcacggccattgccggatttgatatcgatgcgcccgtccgggtaggtgtaggggcgatggttggaggtggtcatcagttgcagcaaaaagggcttttgcttggcgtaatcggcgtcggccagtttcagggtttgccggtagaggtcttcgtcagccatgccccaggcgtttttgaacgagatatcggtttccggcacgctgctctggtcgaccacccgataaccgttgccgctgaaaaacgcgttcatgttgtcgaaataaccgcgcccgccgtaaacaaacacgctgtcgtagccgatggcgctgagttgctggccgaggctggcgaagccgctttcacggccgatgcgcttgacgattgaacgccctggcgtgggtggaatcgccagggtaatcgcttccaggccacggtccgtgcgggtgccggtggcatagaagttattgaagtacaggctttgtttgcgcagggcatccaggttcggcgtgaggttacgcccgtcgccattgctgcccatgtatttggcgctgaaactttcgatggtcaccagcacgatattgggtttgcgcaacgtgccggggttgttgattgcgcggcggatgtccaacgggtctttgccaataaagcgcgcgttgggttcgctgagttcggcccgcaactgcttggcgaccatctcggtgggcaggctttggtagaactgtgggtaatccagctcgttgttgcgaaaggccgcaaagaattgatacgggccgttgctcgccagctcgttcttgtaggcattgccatcttgggcgcgcgggctgtcctggctgatcagttgcaggctgaggccggcgacaatcaacaggcccagggcgttaagcaggcgacctcgcagcggcggcaagggtgcgttcatggcggcattgaacggcttgcgcagaaccacactcaacacaaccgcgagcattgccagcaggctgagcagcttgccgatcgggtaagactccagcaggttgttcaacacctcgtcggagtacaccaggtaatcgacggcgataaagttgaagcgcacgccgaactcatcccagaacagccactcggcgaccgacgtaaacagcatggcgaacaggctgacggtcagcactgcctgcaggaaccagcggtgaccacggcggcgccacagcgcaggcgggcagagcagcaggtacaagcccagcggcaaggcggcataggccaggaagccgaggtcgtataacaggcccacgccaaacaccggcagcaggttgccgccgacttcatccagatgggtaataagcagcatgctgcgcgtcagcaggaaaacaaccaaccaggcgccggtgacgagcagcaaaaagcgcataggcgccgttttgagaaaccccatgtctacattccttatatcaatgggcggtgatcttcagcctgacactgtagtcagtttgtgaagctatagtgaaaaacttgttggttcgtgtaattggttgaaaacctttatcgacaggccctcaaggtctatccctgagccacacttggccttaagctgcgcgagccaacacggccgttaccgcgtacggagacactgcccatgcgaattttattggttgaagacaaccgcgatattctggccaacctggccgattacctggggctgaagggctacaccgtagactgtgcgcaggacggtttgtcaggcctgcacctggctgccaccgagcattacgacttgatcgtgctcgacatcatgctgccgggcatcgatggctacaccttgtgcaaacgcctgcgtgaagacgcgcgccgtgacacgccggtgatcatgctcaccgcccgtgaccagttggacgaccggctgcagggcttcaagtccggcgccgatgattacctgctcaagccgtttgccttgtcggaattggccgcccgcatcgaagccgtattgcgccgcgcccaaggtggcggccgccgtgccctgcaggttggcgacttgagctatgacctcgacaccctggaagtgacccgcgaagggcgcctgctcaaactcaaccccgtgggcctgaaattgctcgcggtgttgatgcaaaagagcccgcatgttttgcgccgtgaaattctcgaagaagccctgtggggcgatgactgcccggacagcgacagcctgcgcagccatgttcaccaattgcgccaagtgatcgataaaccgttcgccaagccgctgctgcaaacggtgcacggtgtgggttatcgcctggccgagggtcgtgatggagtttaagcaaagccttgcccaacggatcatcatcgcctttgcgttgatgagtgcattggtggcgggggcgttcgccatgggcatcgtcgcgaccgtgcacttggtggaagaaaaactcatctcggcaggcctgggcggcgacttgcaacgcttgctgctgatggacagcgtcgaggactggagccaccggcccgagcccgaccagctgttctatttcagcggtgggcgcggggatttcgagctgcccaaggatttacgccatctggaaccgggctttcacgaggtgttccgcgagtcgctgtcgtatcacgcgatggtcgaagtggtggatggccggcgctatgtgctgctgcaagaccaaagcgattttgaagagcgcgagcgtgttctgttcgccgtggtgctggtgggcttcgtgctcagcctggcactggcggtgtttctcggttgggtgttggcgcgcaaagtgatggcgccggtggtgcggctggcccgccaggtgcgacatcgcgaccaactgctgggcctggcgccgccgctggcgccggattacgcggccgatgaagtcggcgaactggccgtggccttcgatgccaccttgggccgcttgcgccaggcgttatcgcgcgagcagctgtttaccagtgatgtcagccatgaattgcgcacgccattgatggtgctggccagctcctgcgagctgctgttggaaaacccggccatcgaccagcgcgggcgtaatcaagtggaacgcatcgcccgtgcctgcgaagaaatgcgtgaactggtgcagaccttcctgatgctggcgcgtgccgaacatgatgaagcggcgatgtcaccgcaggtgacgctggcgcaggtcgctgacgatttgctcggcatctggcgcgagcaaatcgagcgcaaggggctggaattgatttaccagcccggcaacccttcggatgcgcgctacaacaccaccttcctgcatgcggtcatgggcaacctgttgcgcaatgccctgcattacaccgaacacggctttatccgcctgaccctagaacccagcggttttgtggtggaagacaccggcgtagggattcccgaagacaagcgtgaggcgatgttcgagccgtttgtgcgtggcagcgagaagcgtggcgaaggccttggcctgggtttatcgctggtgcagcgcatctgcgagaaccagggctggacggtcagcctcagcccgatggacccccacggctgccgttttcacgtccagttgagtcaggtcaagccctgacgcatgtccctgccgttatcctgccagacatcgccgtaattcggcgaagatggccccatgatattgcttgtgtctgtaaagtcttgaaatgtatgagattggacaggacaagtttttcacaacgggttgaccagttgatcacagggcggtgcttaaggttgtaggcatcagctactggagatccgttgatgtctaccccgatcaagctcgatttttccgaaaagtacgacgatcagcacgcgcagaattatttgctcaagcatcaggacaatctggctcgccggttgtcccacaaacgcgacgagcaattggcgcgcggtgcgctggccatggctggcgaacctggcctggtgttggacctgccctgcggggccgggcgtttttggccgttgctggcggagaagcccaaccgagtgattatcggggccgacaattcggcgtcgatgttgaaggtggcgaccgtcgctcagccggcggacgtagtgaaacgggtacgacccttgcagacatctgcctttgatatcgatttgcctgacaattcggtcgacagcatcttctgcatgcgcttgatgcaccacattggtgacccggcgcaccgtatgacgatactgcgggaatttcagcgggttacccgcgacagcgtgattatttcgctgtgggtggacggcaatttcaaggcctggaaacgcaagcgcgccgaagtgaaacgtcgtagtaaaggtgagcaggaaggttaccaaaaccggttcgtgttaccggctgctactgttgaggcagagttcgagcaggccggtttccgtgttcaggaatccctggacttcataccgctctacgccatgtggcgtgtgtatgtattgcgtaagaggtaacaggatggcagttgagtgcgtagtaggcagtcatgtagctcccgaggaacggtttgattatttttggcgcctgaagggcgagtgggtcgaggaacccaatcgtcgacgcggcggtgaaagtggtgtgcaacgcgtgatcagccccaatggtcgtttgctctacagcaagcgccagaccgggcatatctaccgcagtttgctccacccgttcgggcgcccgactgtgttgcgtgaacgtgatgccctcaagggcctgcgttcactggatgtacgagtgcctgaattggtgttctgcgaggcgcgccgcgaccccgagcaccagtggaaagcgctgctggtgaccgcgtcgctcgacgggttcgacgagatcgaaaactggtacgccgccggtggccgcgagcagtatggcgaggtggtgcatgagcgtgtgctcaaggaagtggcgggcaccctggcgcgtatgcacaagggccgctggcaacatggttgcctgtacatcaagcacatctttttacgggtgacgggtgagggcgactcggccaatgtggaagtggcgttgctggattttgagaaatgccgccagcgtttgaccgcttatcgggccgcctcccatgacatgcagcaactgcggcgccattcgtcgtggagtgatacagactggaaaaaactcagctacttttacgagacggcgtttggcagcgctatcaagggtttaaccagatgaagctagaaatagcacgaggtttgttcctggtcggtgcgttgggcattgcagccctcgcattggctgcgtgggaacaacctcgcacacaagtgctcagtgcggtgcaaggtagcgggcaatgcctgttgccgcgcgtcgccaagacgagtgtggcggtcaagcctgatcatgagttgttgctgttcatgttcgggatgtctcagggcatgaggccgcagagttgaatagagcgttgaaatgtttcaaccccccaaaaaagggccttgcgatgcgaggccctttttttgtgcttgacctgaacgctaataagtaacgttgagtcgtaacgcccaatgttcagtatcgggcgcggcgttcaaggcatctgagatggggcaacgttgacttgaccggatggcgggccaacagggatgacataaggcacatccggtttccaattacctttatctttgtcaaagtacacatagactccgtgattcggtttgatttccagaggcgtcaaaagagaactattgtccgtgttaataaaggtagatttatccgctctgtttaataccatcacagcgctgccatactcattcgactttttgggtaaagttagtttttctgtaaaccccatagatgaattatctaaccgatacgccaatgggccatcttttggcacctccgacataacgcccatagcgcgaccattgctcgcgtcgtccttgggtgaagggaaactttcggtagttgcggcaaatacctgagctgacatcagtaaacaggccgcgaggatgagttgtttcatactgtaattccttttaagtatccaatctaaactactgcgaacagtagccagcagtgactgccccgacaccataacgaggaaagaaatagcggtgtactgtgagaaatgacagtttttaattcgatatgggaataagcgttatttcagaataaagctgaacatgaatcgctcttcgcccgcggagttcgctgaaagcatctacaaccgcatgaaggctcgttcccgcgcgggagaacgagcgtgctgatgtcaaaccaagtgcaagtggttatcccaaaaccccgacggcaactccaacggtttagccaccaacggttgctggcggcagtcataaaagcggcagcgcccctggcctgacgtcaccacaaacccgtctgctaccgcgccaaccccggcgcagtcgggcaatggcccatccaggcgcagctcgccgctgtccatgtcccagataaaaaagcgattgccccgtggcgcagtcaacgccaccagccgtaactcactgtgtaccgcaacgctggcggtgtaatgccccatggcctgcaactgctcatcggccaccggaaacgccacaaacggctgccctggccgcttgattgccagcaactcggagcgctcctgagacgcgcccataaactgctgccccgtgaggatggtgccgtcgccggcaatccccatatggcgcacgctgttcatttgctgcccgagggtttccttgctgatcaggctgccgtcgcggcgcatcagcaccaggctcggctccatggcgttgaggttcatctctacccggctttcagcctcggtgcgaatgccgccgttggcgaccaccaaggtctcaccgtcaggcatccacgacacctggtgcgggccgataccgtgggtggaaatttccccagtgtgcaccagccgctcaccttcgaacttatacacacccagcaacccacggcccgggtcggatgtgtcgttctcggtggcatacagacagtcgccgcttttgtggatgaccgcatggccataaaaatggcgattggcattcgaggtaatggtctgcagcagcgcgccatcacgcaggttgatcaggtagctctctgtgcccggacgtcgggcgacgaacagcgcaatcggcagcgtcgggtggttgatgatgtcgtggcagcgctggccaacctgggtggcaaacacttgcttgccgtccaggtgataacccacggcgtagtgtttgccctccacatcatcgcgcgccgacagcagcaacgggctctttgagcccttttgcttgaacagcgtccagccacccagcgtgattgcactgagcagcacgctacccaccgccaaagcctgtcgcctgagcatcatcagtcaccgtcgttggcgttaaagcccagttggatgcccagcgccttggccaactcgccttcgtgcaagcggtggacgacgttgaggctgtcgtaaatgtcgttgagttgctggcggccggcgtcgtcggccagcagttcattcagcgtgcgctggttgctggcgaacagtttcagtgaagcggcataggcagcgtcgatcttgtcggccaatggtttttggcccgacggcaacaagccgcgcaggcctttgttgtcgacgccggcccatacggtctgggcggcggccaggctggcctgcaggctttgcagggacgactggctgcgccacgcatcggcctggaacggctgcgggatgcccttggtctggcggcccatcggcgtgccgagctttttcttcagcgtatccagcgcggtcacttgcacgcgcagcagatcggcgatggcttcgtgggaatcagcgtaacgctggttcggaaacttggtcatttgcgcgagcatgccgtcggtgctgttccagctcgccaggatctcttcagccagggctttctggcgttcgccgatggccaccagcagcgggcagtagcgggctttctgagcttcgtcggcgacgtcggtcttggcgtcatagaggatgtattcgtaggccgacaggccctgaactaccacgctggatttggccaatgcggcgccgtcgatctgcggctgggcggtgaccagttgttcgacctggcggccgaccaggtttttcttgtccggccagaactgcacttgccacgagcggttgccctcggccagtgggccgatcagcagcggttgcagttcggcccaggctttttgcgcgtggaggaagtcggcgcgggcggtgtccaggctttccttgccctggcagtaggccagcgcgctgacggccaactggcggtcggcttcaacccagcggctgtaggtcggcaggatcacttgcttggcgatggccgccgaggtcaccgcttgcgggtcctgcggcgagcaggcgccgagggctaaggcggccaggctggtgaacaacaacttgggacgaaacatgtcgagctcccttcggtaattggggcaaatcttatagagaattcaggaacgccagcaacgcggcacgctgctcggcattaaaggacaacacatgctgctgcgccgcctgtgcttcaccgccatgccagagcacggcttcgagcaggttgcgggcgcggccatcatgcaaaaactgggtgtggccactgacggtctgcgtcaggccaatgccccacaacggcggcgtgcgccagtcgcggccaccggccttgaattcgctgcggtggtcggcaaggccttcgcccatgtcgtgcaacagcaggtcgctgtaagggcgaatcacttggttggccagttcgggttcggcagcgttggcggccgtagtgaacgtcggtttgtgacagccctggcaaccggcctggtagaacaggtttttaccggccagcacctgcggcgtgtcgacgccacggcgcaccggcacggccaggttgcgggtgtagaacagcaccaggcgcaggatgttatcgctgacttccggctcgccatcggggccgttaccgttaggcgcctgtttgcaggcgacttgggcgtcggtgcagtcatcaaagggtctcagggacgtggtgaggcccatatcaccagaaaacgcgtgaacattttgttgattgaggttgggttgcccggctttccagccgaagcggccgagcacggttttgtgctgggcgtcgtcccagacccaattggcgcggccgacgagggcttctttgtcggcggttttcgggtcggtgttgcgcagcacatcggcgtcgctgatggcttcgagcaggcccaggccaatcatcggcggggcgatgcgcgccgagaagagtgtatccggatgcattgggccgtagccgagctgggtgatttgcaggtccggcttgcgcaactcgaccaccgtgccgtccttgaacgtcacgttgaccggcgtgtagtcgacccgcaccttgccttccggcgccacgcccggcaccgccatgtcttgcaattgcccgccgtagaccggctcgggcactacgccgagctgttcgatgattttggcgtagggctcagcacttggaatcgacagtcgcaccagcatcgacactgcattcggcgcgtccggcagcggcgggtggccacggccatccttgatatggcagttctggcaggcgttggtgttgaacagcgggccgaggccgtcgcgcgcggtggtggtggacggcgcaatcacccacgggctgcgaaagaagctgttgccgacactgaagtccaggcggcgggtgggagccaggttggccgagggcagggaaaacgcgttctggtcgcgcttgtttaccgtcgtcgcgccgccggctcgcgcttcgccgggctctgccttggtgaagcgtggggcgtcgtcgcaggccgtcaggctcaaggccatcaatgctgcgcacaggcgaaatagcgaacggaacatcgaaattcctgaacggagggtgaaaatcaggtcgcaaagtctaacagggcagggcggattgaataagagcaattatcgtttggtcgaatccgagtcattcccgctagaatggccgcacatttttctctggaggtggccaatgcaggctctcgacgctttgctcaaccgtgtttccgtgccgcgtttgctggaaccggcaccgacccaggagcagcgcgacgtgctgttcgccgccgccatgcgcgcgccggaccacggccagttgcgcccttggcgtttcctcaccgtggaaggcgccgcccgtgaacacatgggcacgctgttggccgaagcggcgcgcctgcaggacgccgacgccccgcaagccgccatcgacaaagcccagaacggcccgctgcgcgcaccgttggtggtggtggtgattgcccgcctgcaagaacatttcaaggtgccgaaatccgagcaactgctggcggccgcgtgtgcggcccacggtattctgctggcggcgtatgcacaggggattggcgcggtgtggcgtacgggggagttgtcttactcggcccacgtggcgaaaggcctggggctgacggtggatgaggaagtgattggcttcctttatttgggtacgccgcagaacccgccgcgtgttgcgcagaaagaagatgtggcggcgtttgttacagcctggactggtctgtaagaaagcgcagatctgctttatgtgggagcgggcttgctcgcgaatgcggaggatcagtcaatacatccagtgactgtcacaccgcattcgcgagcaagcccgctcccacattgggtccccattgtttcgaagtccgaggtttacaccttgaactgatccatcagcttcatctgctggctggcgagggcgttcaactggctgctgatggccgccgactcggtggcctggccggtgagggtttcggtcacggtgcggatcgccgacacattgcgattgacctcttcagccacggcgctttgctgctcggcggcgctggcgatttgcaggttcatgtcgctgatcaccgtcaccgcatcgctgatcttgcccagcgcttgcacggcttgatggatctgcccggcgttgctctgggcctggtgttggctggaatgcatggtcgccaccacgccgcgggtgccgctctggatacgttcgatcaccaggcgaatttcttccaccgaatcctgggtgcgtttggccaggttgcgcacttcatcggccaccaccgcaaaaccacgcccgctttccccggcgcgcgctgcttcgatggcggcgttgagcgccaacaggttggtctgctcggcaatgctgcggatcacttccagcaccgagccaatctgctcgctgttcaccgccagggcttcaacttcgcctacggctttgctgacttcttcggcgagggtggtgatgtcgcgggtgctctgttcaatgatcgccatgccgtcacgtgccgactggtccgcaccgcgcgccgcgctggcggcattggaggcgctgttggcgacgtcgtgggcagtggcgctcatctcattggacgcggtggccacctggtcgatttcgcggaactgcacctgcatgccttcgctggtctggcgtgcgatggccgaagactgatcagccgtgccacgcgcctcggtgatgctttgcttgatctgcgcgatggtcggttgcagcttgtcgagaaaacggttgaaccagttggccagctcgcccagttcgtctttcttcgagtaggtcaggcgctgggtcaggtcgccttcgccgctggcgatattcttcagcatcgccgccacggtattgatcgggcgggtcacgccggtggcggtcagccagatcagcaataagcccagcagggcagcggcggcaccgaccagcaaggccttgagcgtgccggcagcctgggctttgtcgagtacgccttgcagtttcaaggtgtcggccagcatcacgtttttcggcagtttgaccacgatgccccaggacttggcgtcggcaatcggcttgaccgggtacacggcgcgaatcgtgtcgtcttgctcgcggatcgtgcgcgtgtcgttggccaacagttgcacgatctccttgccctcggcgccgagggtgtcgatcaggtttttaccgacgcgcgccggctcaccgctgtaggccgcgatcaacccggtgctggacagaatctccaggtgcgccgccccgtcgaacagttctttttgtgccgcgtccgttaccgcctgcaaggtattgagggccaggtcgataccgaccacgccaatgaccttgccgtcgacgatcaacggcagcgagatcgtggtcatcagcacctgcttgccggccacttcatcggaatacgggtccagcaggcaaacgttgcgcgtgtcccgtgggcaggtgtaccaaatgttgtagggcgtaccgctgaggttgggcgtggtcttggtcaggtcttcctcgaccatcaccgtgttcaggccttcaccggcggcgcggctccagtagctggagaagcgccctttttcgttggagacgcgggctttgtcgtcgacaaactcgctgtccttgccatccaggccattgggttcgaacgacagccagatgcccagcaccttgctgttgcgctcgaacgcggtcttgaggctctggttgagttcttcacgcagtgcgccgggttcaagcgagcgtttgctggcgagggcgcgcaggtctttgacctgatcggccagcgccttgaccaccaccaggttttcgccaaaggttttttgtaactgcaccgcttgttcgcctgctttggcttgcaaaaggttttgcacgttttgagtcagcattcgcgagcttgaatcgctgatcagatgatcattctgatcggtttcgtaaaggttgatgctgataatcagcgcaatcacccccaccaggcaaaggcccgacagcagcactatttttaagcggatagagagggtgtcgaacataggttcactcgcgattggagttgttgacctgcaagcagggcgagccaagtccattcggcgctatgtccggaacatcggcgtaaagggatgtttcatgaggggcaggcgatgagcggtaggtaaaagactacacgccgcgttatacgggcgttgcgagccgttccgggcgtgaccagatccacaggttgcccaggctcattccggcaatcgccaggtagatcggccagccgtgatcgagcatcaccagcatcaagccggcgcacagcagcatgctcacggtggcgctgactttggcacggcgcgcgatgattttgccgttgcgccaattgaacaggatcgggccgaacagtcggtggttttccagccaggcactcaggcgcggcgagcttttggtcgcggcccaggcggcgagcaggatgaattcggtggtgggcaaacccggtatcacaatcgccaccaacccaatgcccaggctgacgtaggccagcaggccgaagaggagctgggcgatttttgaggtggattgggttttgccgggcatgggtcgggtgatcacataaaattagtttgcaatgagatccaaatgtgggagcgggcttgctcgcgaaggcggtgtgtcagtcgacatttgcatgactgacccaccgccttcgcg

SEQ ID NO: 63 - DNA, 63331 bp, Pseudomonas poae FL10F
ggcccatcgcggcggcccccgctccaaagccggagtgagggcacaccgagcctaggcgaggtgccgagtggtggggcgaagactttttggttacttttgtgtctttacaaaagtgacccgctgtaagagcggaaccctaagcggccgttaccgcaggaatggatatgtactcggtctgatcaagcccgctcccacatttggatctgtgcacatccggcaggtaagatgcaggcctttggcgcagccccttcgctgcgccctgccaagaataagccctgcccatgcccttcgaactcagcgttgacctgaccaccctcgccattcttgccgtcgttgcgtttatagccggcttcatcgacgccatcgccggcggcggcggcctgctcaccacgccggccctgctcaccgccggcatgccgccgcacctggtactgggcaccaacaaactcagctccaccttcggctccgccaccgcgagtttcaccttctaccgacgcaagctgttccacccgcgccaatgggtgcacgccatcgtcggcaccctggtcggcgccctcgctggcgcagtggtcgcccactatctgcccgccgaaaccctgaacaaaatgctcccggtgatcgtgtttggctgcggcgtgtacctgctgttcggcggcacgcccaaggcgccgctggatgccgacgcaccgatcaagaagaaatggcaagccacccaaggcttcggcctgggcttctacgatggcgtggccggccccggcaccggcgcgttctggaccgtgagcacgatgctgctgcaccccattgacctggtcaaagccagcggcgtagcgcgcagcatgaacttcgtcagcaacgcggcggcgctgtcggtgtttatcttcaacggctcggtggattggattgtcggcctggcgatgggcgtctcggtgatgtgtggcgcgttctttggcgcgcgcagcgcaatcagcggcggcgccaaattcattcgcccggtgtttatcaccgtggtcctcggactgaccgtgcgcctagcctggcagcactggttcagcgtggcctaaacggcgcgccaggtagaggtcgatcaggtaacgcgcaatcgaacgtgacgccggcaacggcggcaggtcgtggatgttgaaccactgcgcgtcttcgatctcatcggcctggggcacaatgtcgccaccggcgtactcggcatggaagcccaacatcatcgaatgcgggaacggccagcactggctgcccatgtactggatattcttgacctccacctgcacttcttcttgcacttcgcggatcaggcagtcttcagccgactcacccggctcggcaaacccggccagggtgctgtagacgcccgtgacgaaacgcggcgagcgtgccagcagaatctcgtcgccgcgcgtcaccagcacaatcatgctcggcgagatgcgcgggtagctgcgcaggtcgcaggcctggcagaacatcgcacgctcgcgcggcacctggaccatggcctggccgcaactgccacaaaagcgatgctcgcgcgcccaagtgccgatttgcgcggcgtagcccagcactttgtacagcgtgtggtcgccttgcagcatgaagccgcgcaggccctgccaactgcagccgggcacttcagtggcggcgttgagttccagcaggtacaccggctcgccgtcgaggtggccgatgccgtgttcggcgaacactgaaaggtcctggcgcttgagccattcacgcgggaacagcgggccgttggtgtcatgcaaaaagccttcgcggctgcgggcaacggcccagccgccgggggcgtcgttgtccagcagcgttgtggtaatccagcctggggtcatgtcggtcaatccacgaattcgggtttctgcttactcatatgggccgcgatggccacgcgcaagtcgttggattgcaacatagccgagttccaggtggcaacgtattccaaaccatcattgaccgagtggtcacgcatgtagctgatcatggccttggtgccggtcacggcaatcggcgacttggcggcgatctgctgggcgatttccatcaccccggccagcaggctttcgtaatccgcgtacacgcgattcactagcccgatactgcgcgcttcctcggcaccaaattggcggccggtgtaggccaactcacgcagcataccgtcgccgacgatgcgcggcaggcgctgcaaggtgccgacgtcagcggccatgccgatgtcgatttccttgatcgaaaattgcgcgtcttcagcggcgtagcgcatgtcgcaggcgctgatcaggtcgatggcgccgccgatgcagtaaccgtggatcgccgccagcacgggcttgcggcagttgtcgacggcattgaacgaggcttgcagctcgaggatcttgcggcgcagcaggcgtgcgttacggcccacgtccttgccgaattcattggccaccgaggcgagcatcatcaggtcgatgccggaagaaaaatgcttgccggcgccgctgagcaccacggcgcgcacagcgtcggtgtcttcgacccattggaagatgtcgatgatttcggtccagaacgccgcgttcatcgcgttgatcttttccgggcggttgatctgcacatgggcaatgttgccggtgagttcgacgacgaaagcgtggtattcggacatggcagtgatccctgactggcgagtgataaggcccgaactataacaagggagcgcgacggcgcatcggccaaaaacgggactggcaacgtaatggaatgttgtgggcgtgcagttcatgcacccgcgttacatttcatcccggaagcgcgcgttatcggctatacaatcagggcccttgcctggagccgtgtatgccgtccacgtttcgttcatcgttgattctggccctggtggtcgtgctgactggtattggcgccggcctgggcggcatgcttctggcgttgctgctgcacggcatccagcacctggcttatggctacagcctcgacagcctggtcagccatgaaacctttttatggggcgtgacggccgccgcgccggagcgccggtttatcgtcctggtgatgtgtggcctggtcgccggcgtgggttggtggacgatttatcgctatggccgcccactggtgagcatcaagcaggcagtgtcggaaaagatgccgagcatgccgcccaaaaccaccctcgcccacgccctgttgcagatcatcaccgtggccctcggctcgccgctgggacgcgaagtggcgccgcgtgaagtcggcgcggtggtagcaagctggttatcccagcgcgcacgactggaaccccggatgcatcgattaatcgtggcctgcggcgcgggtgccggtctcgcggcggtgtacaacgtgccgctgggcggcgcggtgtttgtgctggaagtgctggtagcggcattcagctggccggcggcggtgattgcgctggcaacctcggcgatcggtgcggcggtggcgtggatcggcctgggcgcagagtcgcaatacatagtgccgcactttgtgctgagcccggcgctgatcgcctgggcggtggtgtgcggcccggtgtttggcctggccgcctacggttttacccgctttaccggcgccgccagggcgaatgccgcacgtggctggcgcctgccggtgttggcattgcttaacttcacgatcatcggcgggctggcgatgctgctgccgcaaatcctcggcaatggcaaaggcccggcgcaattgggcttcgacaatgagctgacgatcaccctggccgccattctgctggtggtcaaggtgctgatcaccgccagcagcctgcgcgccggggccgaaggcggcctgctgacgccagggctggcgaatggtgccttattggcgatcatcctcggcggtgcctggagcctggcgtggcccggtgtgccattgggcgcctttgcaatcatcggcgcggcggcattcctcgcggcgagcatgagcatgccactgaccgcgattgtgctggtggcggaatttacccgcatcgatcacgactttctggtgccgatcatcctcgcggtggtgggttcgatgtgcgtgagcaagctgtgcgcgcgctgggaaaacgctggaaaaaagcccgcctaagcgccatcctttgcgctttaagccgccccactcgcggcgctcgacgctcaaaggaaatgccatgcacgcccaacctctcaacgccgccgatttcgaattcatcgaagacaccttgctcaaatacggcgacgatcattcggtgctgaacctggccgaactcgacggctacttcaccgcgctggtttcaagcccggcacaagtggacgtcgcgcagtggttcccggccatttggggtgggcagaatccagactgggaaagcgtggatgaggccaagcgtttcttggaactgtgcgtgcgccatatgaataccctcgccgcgcaactggcgaccgatacccaggcattcaaagctcgttttgatgacaccgagcatcagggccacaccgtgacgctggctgaggaatggtgctttggctacatccgtggcgccgcgattggcaattggcctgaactgcccgccgagcaggccgcactgctggagaaaatctcctggtgtgccgagcaggacaacttcgagttgccggcggacctggatgtagccgcccatcaacagcgggtcagcgcaatcgaaccggctgcgcgggcgctacatgattactggttgagcaaacgctgatcactgtccgcaaacggattacgcggcaaaccacgccgcacaacgatccctgctcgacaagcgtggcgtgtttggctgattattcgggtcccgtcgcgccactgcgcaccacctcgccttgatcaggagccttgtaccttgagttcgcagaaaaccgtgaccgttacaccgcccaatttcgccctcaacggcaaggtcgcgccccccggctccaaatccatcaccaaccgcgccctgttgctggcggccctggccaagggcaccagccgcttgagcggcgcgctgaaaagcgatgacacccgccacatgtcggtggccctgcgccagatgggcgtgagcatcgatgagccggacgacaccaccttcgtcgtcaccagctccggcaagctgcaattgcccgcgcagccgctgttcctcggcaacgccggcaccgcgatgcgctttctcacggccgccgtggcgacggtgcaaggcaccgtggtgctgaccggcgacgactacatgcaaaaacgcccgattggcccgctgctggccacccttggccaaaatggcctccgcgtcgacagcccgactggctgcccaccggtgaccgtgcacggcgtcggcaaggtgcaggccaagcgctttgaaatcgatggcggtttgtccagccagtacgtgtcggccttgctgatgcttgcggcctgcggcgaagccccgattgacgtggcgttgaccggcaaggacatcggcgcgcggggttatgtggacctgaccctggactgcatgcgggcctttggcgcgcaggtcgacgtcgtcgacgacaccacctggcgcgtggccccgaccggctacaccgcccacgactacctgattgaacccgatgcttccgctgcgacctatttgtgggccgccgaagtattgactggtgggcgcatcgacattggcatggcggcacaggatttcacccagccggacgccaaggcccaagccgtgatcgcccagttcccgaacatgcaggccactgtcgtcggctcgcaaatgcaggacgcgatcccgaccctggcggtactcgcggcgttcaacaacaccccggtacgcttcaccgaattggccaacctgcgcgtaaaggaatgcgaccgtgtgcaggcgctgcacgacggcctgaatgaaatccgtccgggtttggccagcattgaaggtgacgacctgctggtggccagcgatccagccttggccggtacatcgtgcaacgcgctgatcgacacccacgccgaccaccgcatcgccatgtgctttgccctggccgggttgaaggtcgcgggtatccgcattcaagaccccgattgcgtggccaagacctaccctgagtactggaaggccctgggcagtcttggggtcgcactgagctactaaagcagcatcgccattggggagggcttgcctatgaacattcgccaaccctgcccacccggcgcctgtgtctgcgaacgcgaacagctgctgcaggcgcccggcgccgacctgcgcattctcaacctgacacgccaggaagagaaaaagctgatcgagcgcctcgaagacctcaagagcctgcaagacctggagcgcatgcagcagctgatgtaccagcaattgggcatccgcgtgcatgtcgcgccgggctacaccgaggtcaagagcatgcgcggcatacagattgtcatcgacgacctgcccggcctgtgccgcaagacccggcaatcgattccggcagccattcggcgcggcatggaaaaacgcccggaaattgcctaccgcttgctcgatgcccacgatttgtttcgcgaaggctgaaatccgagcgccttgtcatgccagtcgtgcaggccgctctatcagaacgagatctgctgatcgttttccggcagcatattggcgaccggacgcaggttcaccatttcgctttgcgacttggagtttacgtcagcctgaatacgcttttcatcgtttctcttagcgtcgcaggcttgttcatcgccagtgttcttgctgttcatctgagacatatcaacgttgctgagtgcagacccagcgcttaatccgccaatgttcatagagggaactccaaataaagtagaaggaacgctgaaccaactgcgttgatcagcagacagtctgtggtgccaatgcttgattgagttccgggcttttcgcacaggctcggtcctgctgtcgtcaaatgcgcctgggcgccagcgctttcaggctccagctgccactcggatgtcaatcgcgggcgcagttaaataattgttcacgcgggaggaataaagcggcgcgacgggtgtttacctgagtacggcttgtgaatacagcacaacgccagtaccccaattcgaaaacacccaggagctcgtcatgctgaaaaaattctccctcgctgctgccgtcctgattgcctgtgcgtcgtccatggcgtttgccgccccggccaaagtggccgacagcgccaaaggcaaagtgctggtggacagcaaagggatgaccctttacaccttcgccaaagacagcgccggtaaatcggtgtgcaacggccaatgcctggccaactggccggcgttcaccgcccaggcggcggcaaaagatgccgacggctacaccgtgattacccgtgacgacggcagcaaacaatgggcctacaaaggccaggcgctgtacacctgggtcaaggacagcaaaccgggcgacatcaccggtgacggcgttggcggcaactggaacctggccaagccctaagcacttgtagcaaacaggcttgctgcggtcagtgagcttttgtggccagtaagcatttatggcaatcaggcttgtcgtggcaagcaggcctgtcgtggcgagcgggcttgccccgcgttgggctgcgaagcagccccaataagaccaccgcaatcttcctgtaaaaaacgcggtgactggattagggctgctgcgcaacccaacgcggggcaagcccgctcgccacagccacagccttcaccatcatgcgcttagcggtgtcccccgacccgaaggcctttatgcgttcgcatctttcgggtaccgctctcgtggatattgggactgtcgttggaggtaagccataaacaaaaatgctccgtatctttcgataaggagcattttctgttggcaccgcgtaaatggctggatttctcacagtttgctgttttctctaatcgcgcggataaacgactagcgtagagtaaatatttacgcactaccggattcttcgagccaaaaggtactgcgttgcggaataaatttactcatcatcatatttttagtcgccttcaatttcatcattaacattcatgacttttccatgccatatctgttctccccaatccgcctcgtctgatgggtctccgtcatcctcaccccggatttctgaagccccatagccacgcgacgtacgcactctcacaaaactgacggactcgcctcttttcaaagatctgtagccatctttaataatatccgtgtaatggaataacagggtgtcgcctcctccttcaggtaaaatttctcccgtttgcgtagctttatcgtaactctcaaaggttcccgtttgtctgtttgacatgttgttctcctgcaaacgctaaacgaacgataagtcgagatgacctgttccaagccgcgtgggttgcgcactcaatttaatcgcctgcagagaccggcagtaactgtcagatctgacagttcgatggacgtttttgaaattgctattttgattttatgacgattggaaataaccgaaggcttgcttcacgtcagccgcagatatctcagcgtcaggtaggaagataaaaagatcgtagcccttgattcgagctcagaacaccgtagctgtggcgagggagcttgctcccgttgggtcgcgtagcggccccaaaagatgggcctgcttcgcagtccagcgggagcaagctccctcgccacaggttgggcttttaggcgaagtactcattcacaaacagttgaaccttgcgcaccaactgatcgaggtgccgatcgcgttgtttctcggcatccaccatcgcgcgcttgccgtgtttttgcagcaggtacgtgtgaatctgtcgcacttccagcgagctataaatcgccgccacgtccagcacgcccatcaagccgtcagtgccgtagtcgcgggtgttcatccgtacctgcgtgccgcgcgcgccgcgtacttgaaaacccatgcccacaaaagccgggaccttttccaccgcacaggccaactcggcgtggggatagcgcgccagcacgtcctcaatcatcgcgcgggccagaccctggcggcgcctgccggcctgcaccgcgatgaacgcgatgccgcaggcttgcgggtcatctttgaccggcaggtacaggcaaaagcccaccagctgttccgcgtccatcgccaccaccagttcaacggcaatgcctttcgagccgttcagtgcctccaggtacaggtgcacctcaaagccaatggcgtactggtagatgttgtagagcaagttactcggcggcagcgccacgctgctgatgtcggtgaggttgtccaccaccatctgcaggatctgcgcgttgatcggctcggggcacggtgtggtgtagcgggtaaggctgaacatgcaaattcctggggtttcgcgtcaagtcagcggcgattgtacctgttgcagccggcttatggccgctgcgcaccacgccacggggcaagccgtggctaatggcctgcacgtgaccttcgccgtcgcactggccttgatcatcgccgccagcacctttgcctggcgccgtcatagcgccgtgaacggcctgcagaacacccgttgaggcaaaaaaacaaaaaaggcgttgcgccagaccgggttacatcgcgcatcatgggcactttcaagctcaagggtaatgtccatgcgcgtgctgtcattgatgatgggtcttacgacgctggccgccagtctggcgttctgcgccagcgcgatggcgaatgaagaaagtcagttggtgcaacagatcaatcagtaccgcagccaggtgcagcgctgcggtaaccagggttcccaggaactgccacccttggccagcgatacgcggctggtgctgccggcgaccaatgtcggcgacttgcagcaggcgctggcgcgggccgcctacccgatggtcaacgtgcaggccatcagcctgtcgggccccaaggatgcgcaggccgccatgaaggccgtgcgcgaaagcttctgccgcgtggtgctcgacccgcaatttgtcgacatcggcgtgagcaacagcggccaggactggcgcatcgtgctggcacgcccgctgctgtccagcggcctgggcgattggcagaccgaaggcaagcaattgctcaacctggtcaacgccgcccgcgcgcaaccgcgccaatgtggcacccaagcgttcacggcaaccacgccgctgtcatggaacgatgacttggccggtgccgccaacagccacacgcgcaacatggccaacggcaactttttcgaccacctcgaccacgacggtcgcacgcccggcgaccgcgccgagctggccgggtatatcgcgaaaaacatcggcgagaacatcgcggcgggcctcgacaccccgcgtaaagtcgtggacggctggctcgccagcccaggccattgcgccaacttgatgaacccgcaatttcgcgagttgggcgcggcctatgccatggacccaaagagtgacgccgggatttattggacgggggttttcggttcgcaataacggcccggcggcgcgtttaacgccgccgcctttatctattcatttggagcgagcatcaaagtgccatctcatggataatcgcgctgaactggcagcgtccatgcaggtctgtagctggatgtgctgatgatttcaggcattccagaggccgcggcaaataaggtgttcacccgatgatgaattggctgcaaagcagcagcgacatggctgagagggttcgcgagcacgattgggccagtacgccactcggcccgctggagcagtggcccgatgtcctcaagaccaccgtggccctgtgctttgcctcaagcttcccccacgccattgtttgggggccacacctgatcacgctctacaacgatgcatttgtccctattcttggcgataaaccgtattcattggggcggcccttcagcgaaacctggagtgaggtctgggatgaagtcagtccgatagctgacgcagcctttcaagggcatgcgacctacgtcgaaaactttccgttggtgattgagcgcggtaacggccccgaacaggcctacttcacgttttgctacagccctttgcgcgaccctcaaggcacggtcgtcggcatgctcaataccgtcactgagaccaccgccaccgtgttcctcgcgcgccgcctggccgtactggatgccatcggcagtgccgtgaccaacgccactgacgccgaagccatcatgaccaccaccacgcgtctgttagccgagcacctgtcggtgtccaattgcgcctatgccgatatggacgccgatgaagacggcttcaccattcgcggcaactgggccgcgcccggctcgccaagtatcgtcgggcgttacagcctggcgtcgttcggcgcccgcgcggtcaaacagttgcgcgccggtgaagcgctggtgattcgcgacaaccgcgacgaattcccgcccgaggaatcggccagctatcaggcgctgggcgccacggcgaccgtatgtttcccgctgatcaaggacgggcgcctgaccgcgctgatggccgtgcaccacaaatccgcgcgcctgtggtcgccgtacgacctggcattggtgggtgaagtcaccgagcgctcctgggcgcatatcgagcgcgtgcgcgccgacgctgccgtacgcgaaggccttgccgccatcaccgagctgaacgcgacgctggaacagcgggtagaacaacgcacccacgccttgacccaggccgaggctgcgctgcaccagtcgcaaaagctcgaagcgattggccagttgaccggtggcgtggcccatgacttcaacaacctgctgacgattattcgctcctcggtggacttcttgcgccagccaggtttgtccgaagagcggcgccaacgctacatgagcgccgtgtcggacaccgtcgagcgcgccagcaagctcaccagccaactgctcgcgttcgcccgtcgccaaccgctgaacccggaagtcttcgatgtgtgcctgcgggtgaaaaacatcggcgagatgctcgaaagcgtcaccggcgcacgcatccatgtgcagattgagctgccgcaccagccttgctacgtgcgcgtcgaccccagccagtttgaaaccgcattgatcaacatcgcgctcaacgcccgggatgccatggacgggtgcggcaccctcacgctgcgcgtgagcacgctgacggcgctgccgcgcattcgtggcgaggccgaagcccgccagccgtttgtggcgattgcactggccgataccggcagcggcattgacgacggcaccgtggagcgcatcttcgagccgttctttaccaccaaggccgtgggcaaaggcactggcctgggcttgtcgcaggtgttcgggtttgccaagcagtcgggcggcaacgtcgacgtggccagccatcttggccagggcagcgtgtttaccctgtatttgcccgaagctgaagctgcggccgtgccgtccaacctggtgcaggacgcgcgcagcctggctcacgacacctcgctgtgccatatcctgattgtcgaagacaacctggaagttggccgtttcgccaaccaaatcttgcaggacctgggctaccagaccacctgggccaccaatgcagagcaggcactgacgctggctggccctgcggttacgggcttcgacgcgattttctcggatgtggtgatgccgggcatgaccggcgtggccatggccaagctgctgcgtgaacgtcggccggatctgccggtggtgttgacgtcgggctacagcgaagagctggccgacagtggttacgacgggtttgagttcctgcccaagccctactccgccgagcaggtggcgcaggtgttggccaaatcgatgcgcaaggactgaggccttagtccgccaccgccacttgattgcggcccatggccttggcgcgatacagcgccttgtcggcagtattcatcaggctgtgcaggtcctggtcgaggctgcgggtggtggccacgccgaggctggcggtcaagccctgcacgggcgctgaggccaggcccgaaatcgccttgaccagttgctcggcgatgtcccgcgcggtctccagcgaggtattgggcaataacaccgcaaactcctcgcccccgagccggccatacacatcggcctggcgaaacgacgcactgatcaccccgccaatctggcgcaacacctggtcgccggcctggtggccgtaggtgtcgttgatgtccttgaagtgatccatgtccatcatcaatgcgcacagcggctgctgattatgacggcattgctcatacaacagctgggcatgttcgaagaatgcgcggcgattcatcagcccagtgagttcatcggtctgtgcggcgcgggtagaaatatggtgggcacgttccatttgccgggtcaggcgaaaggccttttccaaggcatcggaaaatttgcgtgtggcgctgaccacgaaggtcgaaaacaccaacaccgccaccgccacgcccacttgcatcggcgatggctggaacagcaaccacagcgtgcacggcaagagcaccagcgccatggagcccatggtcatgtagcgataagcggaataacaggacaccgcgctgaccgacataccgacagtaaacagcatgaccagcacttgcgatacacgatcgtcggggggcatgaccgccagggcaccaatgccccagacacccgcagagagcatcagcgtgactcagtaacggcgctcccatcggtcgggcgtgcgctcgttgtcagggcagcgaaaccactcggtgaacatcctgacgcgcagcagcgaggtaaccgccagcaccaccagccagaccagcatgacattgtggtcgaaacggtcccagcacagccagcagagcatgacggcgcccaggtaactgccgaaaatggcggcgaacgattggcgaaacagctggtgcaaacggtccgttcgcacctgctcctcgataaagcaatcctgttcctgtccacgcccaaggccgttcatgaaatacgcctgcttcgactgccacgacaaaggcgccattgtggcaccctgccagtagcgcggacaacagaatccgccatgctagagcccttaaagcgtttccgggcgcagaatcaacacgcccaacggcggcaggttcaacgacagcgacaccggttgcccatgacgcggctcatcctgggtaaacacttccccgccattgccgaagttggaaccggcatacatgtcggcgtcactgttgatcacctcgctccaacgcccggcaaacggcacgccgaccgcatacgcttcacgcggcaccggggtgaagttggcgaccaccaggaccggcttgccgtctttgctccaacgtagccaagcgtagacgctgttgatcgcatcgtcgccgatcaaccactggaaaccttgcggggcgtcgtcctgttcgtgcagcgccggctcctcgcggtacaggcggttgaggtcgccaaccagtttctgcacgccccgatgctcggggtattgcagcaagtaccagtccaactgctggtcgtggttccattcgcgccattggccgaattcgcagcccatgaacagcagtttcttgccggggtgcatccacatgaaactcaggtaagcgcgcaggttggcgaacttctgccagcggtcgccgggcatcttgtcgatcagcgagtgcttgccgtgcaccacttcatcgtgggaaatcggcaggataaaccgctcggaccaggcatacaccaggccgaaactcaactcgttgtgatgatgggcgcggtacaccgggtcttgctggatgtaatgcagcgagtcgtgcatccagcccatgttccacttgtaattgaagcccaggccaccttgctgggtgctttggctgacgccgggccaggcggtcgactcttcggcgatcaccagcgcgcccggcgcttccagtgccaccacgtcgttcaagtggcgcaggaagtcgatggcctccaggttctcgcggccgccgtggcggttgggcacccactcaccggctttacgcgaatagtcgcggtacagcatcgaggccacggcatccacacgcaaaccgtcgatgtggaagtgtttaagccagtgcaacgccgaggccagcataaagccgtgcacttcggtgcgacccaggttgtagatcagcgtgtcccaatcctggtgaaaaccttcgagcgggttggcgtattcgtacagcgccgtgccgtcgaactgggccaggccgtgggtgtcggtgggaaaatgcgccggcacccagtcgaggatcacgccaatattggcctggtgcagggcgttgatgaaaaagccgaaatcttccggcgaaccaaaacgcgcagtcggggcaaattgcgacaacgcctgatagccccaggaaccgccgaacgggtgttccatgatcggcatcagttcgatgtgggtgaagcccaattcctgcacatacggaatcaggcgctcagccagttcgcgccagccgtactggcgggccacttcaccggcttcgtccaattcgcactgccaggaaccgacatgcagctcatagatcgacagcggcgccgtgggtttctgcttgtcggcgcgcgactgcatccactcgtggtcttgccaatccacctgcaacggcggcgcgactttcgaggcggtgtcgggtggcaactgggtggccagggccatcgggtcggccttaagtggcagaatgccgtgggcaccgagaatttcgtacttgtaggctgcgcccggttgcaggcgcggaatgaagatctcccacacgccggacgggtgacgcaggcgcatcgggtgacggcggccgtcccagatattgaaatcgcccaccaccgacacacgccgcgcattcggcgcccacacggcgaagcgcacgccttgcacgccgtcgacgctggttacctgggcgccgaggcagctgctcaggtcacggtgattgccttcggcaaacaggtacaggtccatttcaccgagcagcaactggctgaaactgtatgggtcttcggtgatttgctcgccgccggcccactggatcttcagcaggtattcctggcgagtggcgaaatgcccgacaaacagacccggcacttgagttgcgtcgaggctgccgatctgttcgccgctgtcacgggccaagaccttcacactcaaggcttcaggcaggaacgcgcgaataaattgcccgccctgctcgtcatcatggggcccgagaatcgagaacgggtcgtggtgttcggctctgaccagtgcttcgacgtccttggacgccggcatggcggtcaacttcggttgcagcggttctttatttgtaaagctcatgacgtctccccaccgcgtgcagttttcgatataggtgttagcccactgagcaggccgtgcaaaccttgcaacggcaccggcaaccaggtcgggcgattttccgcttcgtaagccacttcgtacgcggccttctccaaactgaacaacgtcagcgcggcgctctggcctttggcatcctgccagtcatgcgccagtgtagtcgtagcctgatgataagcctggataaatgcctcacgcgcttcactcaagtaacggtcggtcacgcgcttgcgggcgatgtccgcttccggcgagtgatccacgccttgcacattcagggccatggcggcggcgtaatcaaacgaacgcagtacaccactcacatctttatacgggctgtgcttgccgcgccgttcatgcagcggccgcgccggttcgccttcaaagtcgatcaagtaggcatcgcctttcaccaccagtacctggcccaggtgcaagtcaccgtggacgcgaatccgcaggccgcccgccgtggctttcgccagggcctggacgtgagcgccgatggcttttttctgcgccagcaactcactgaccagcgcctgatcggcagggttcaattggctttgatgaagtttgagcaactgcagggcgcggtcgatctgcgcgccgacatccttggcccaggcctgggtgtccttgacggtagtcgcttcgggcttgaagtctttattggcggtttttgccgccagcaccacgtgcatttcacccaggcgctggccgagcaggccggcaaaatcctgcaactcgccgagtgcgttgtagtgctgttcctgttcagagatggcttcggccagctcgtcgcgaatcgcgcgttccaggctgttctgcgtccaggcccaggcatcgccctgattgctcaaatagccttgggcaatcatcaacaggttgtcttcgccctgggcatcgcgacgaatcatcgaacccagcaagggcgaaatgttcgggtaaccggcggcggtcaggtaggcgctcatttccagctccgggtgcacaccgctgctgaccttacggatcagcttgagcaccaggctttcgcccaccaccaccgaactgttggactgctcggccgacaggtagcgcacctgcgactcagcgttcaagtgcaaactggccagatgcggcgtagcctcaaagcgcaaatcgccttcaggagtgttcagtaccgtgccggcttgcaagccttggatcaccgcgcgaataaagtgctcaaggctgaaggcatcggtcaccaacccgacttgacgcgtgcggcgtacacgggccagggccagttgctgcggcaaggcgctggtgaactggtcttcggcgaggaagccaaacggcagctgataacgactgacttggccgccgctgctgacctcaatttcgctgagcagcaccgggtgctgtgggtcgccgaaacgcacgccgtaggcaatgcgcacgctgtcgatggccacgtccttgccggcgaaccaacgccgcttgggcagccaggccggcagtgaagtctgctccagggtggtgcggcacggctcttcgagcaactcttccatgcgttttttcaataccagcgtggtgaagtccgggatgctttgcgccggttgcacatgccagctcggcatctggttttccgccgccagcacgaaccagtagaaaccgtacggcgccagggtcagcaggaaattcagctggccaatcggcgggaaggcattaccgccgagcatttccaccggcaccatgccggcgaaggccgacaggtccagctcggccgcctgggcactgcgcgacacgttggccacgcacaggatgatttccgtgcgcccgtcttcgccggtgaattcacgggtgtaggccaagatgcggcggttgctcggcgaaagcatcttcaagctgccacggccaaaggcctttgactgcttacgcactgcgagcatgcgccgcgtccagttgagcagcgaatgcgggtcctgggcctgggtttcaacgttgaccgactggtagccgtaaagcgggtccatgatcggcggcagcaccaggctggccgggtcggcgcgcgagaagccgccattacggtcgatggaccactgcatcggcgtgcgcacgccgtcgcggtcgcccaggtaaatgttatcgcccatgccgatttcgtcgccgtagtacaaggtcggcgtgccgggcatcgacagcagcaggctgttgagcaactcgacgcggcggcggtcacgctccaccagcggcgccaggcgtcgacgaatgcccaggttgatgcgggcacgacggtcagcggcgtagtaattccacaggtagtcgcgctctttgtcggtgaccatttccagggtcagttcatcgtggttgcgcaggaagatcgcccattggcaattggcgggaatctccggggtctggcgcagaatatcggtgatggggaagcgatcttcctgggccaacgccatgtacatacgtggcatcagtgggaagtgaaaggccatatggcattcatcaccgtcgtcgcccttcttgtccccaaaatagagttgcgtgtcttccggccactggttggcttcggccagcagcatgcggtccgggtaatgggcgtcaatttcggcgcggatctgcttgaggacgtcgtgggtttccggcaggttttcgttattggtgccgtcgcgctcaatcaggtagggaatggcgtccaggcgcaggccatcgatgcccatgtcgagccaatagcgcatcaccgaaagcaccgctttcatgacttgcgggttgtcgaaattcaggtccggctggtgggagtagaagcggtgccagaagtactggccggcgaccgggtcccaggtccagttggacttttcggtgtcgaggaagatgatgcgcgtaccgtcgtatttctggtcgtcgtcggaccagacgtagaaatcccgcgccgccgaacccggcttggccttgcgtgcacgctggaaccaggggtgctggtcggaggtgtggttgatcaccagttcggtgatcacccgcagcccgcgcttgtgcgcctcggcgataaagcgcttggcgtcggccatggtcccatagtcgctgtgcacgccacggtattcggcgatgtcatagccgtcgtcacggcgtggcgaggggtagaacggcaacagccagatggtgttcacgcccaggtcggcgatgtagtcgagcttggcgatcaggccgggaaagtcaccgatgccgtcgttgttggagtcgaaataggatttgacgtgaacctggtagatcaccgcgtccttgtaccagagcgggtctttgataaaggtggcagccttgggtttcttcgccattggaaactcctgaaaattctgaaaaaaccgcctgaaggaatacggtcattgtgggagctggcttgcctgcgatagcggtctaccagtggcatgtgcatcgcctgacacagtgctatcgcaggcaagccagctcccacacggggtcctcatcggtctgaagatcgggccgggctcaggatgtcgtgattcgccagattccgaatggggtgtgcggctccagccgcatccactgggtcttgccgtaccaggtccagcgatggccgctcatcaagtcttcgccctgggtctgggcatcatcgggcaagcccatttcccacagcggcaactcgaagttcgcttcctgggcattgaacggatcgaggttgaccgccaccaggatgaaattgctaccgtcttcactgcgtttgccgaagtacagaatgttgtcattccaggcgttgtagagcttcaggcccaagtgcgtttgcagcgccgggttctgtcggcgaatgcggttgagctgggcgatttcggcaatgatgttgcccggcgccgtgaagtcgcgcgggcgaatctcgtacttctccgagtccagatactcttccttgcccggcaccggcgcggcttcgcacaattcgaagcctgaatacatgccccataagcccgagcccatggtggccaacgcggcgcggatcaagaagcctgggcgccccgactcatgcaggaagcccgggttgatatccggcgtattgacgaagaagttcggccggtagcactcgcgccacggcgactcgttcaactgcgcaaagtattcgctcagctcggccttggtgttgcgccaggtgaaataggtgtaactctgcgagtaaccgaccttgcccaggcgcgccatcatcgccggggtggtgaatgcttcggcgaggaagatcacctcggggtgcctggagcgcacgtcgctgatcagccattgccagaacggcagcggcttggtgtgcgggttgtcgacgcgaaaggtcttcacgccctcttccacccagcccaccacgatgtcgcgcagctcggtccacaggcttgggatcgagtcggcggcatagaaatcgacgttgacgatgtcctggtatttcttcggcgggttttcggcgtatttgatcgtgccgtccgggcgccagttgaaccagccgggatgctctttgagccacgggtggtcctgggagcactggatcgcaaagtccagggcgatttccaggccatgatcggcggcggccttgaccaggcggcggaagtcatcgcggctgcccagttgcgggtggatggcctcgtggccgccctcctcgctgccaattgcgtacgggctgccaggatcatccgggcctgccgtcagggaattgttcttgcctttgcggtggctgcggccaatcgggtggattggcgggaaatacagcacgtcaaagcccatgtcatggatcatcgacagccgtgagtgcacatcgttgaacgtgccatggcgcgcaggatcgtcggtgatcgagcggggaaacagctcataccagctggcgaactgcgcagcctcacgttccacatcaatcgggtagacggggctgacgctcaagtaggcgcggtgatcggcctgggtcatcaaatgcgcactgtcttcgtgcaggaactgtgcgacctgttcggtttccagcagcccggagagttcgtggtgcagcagcatcaagcggtcacgcagttcattgtcactgcgctcggctgcctgcagcaccaggctgcggccttcctgcagctcaaggctgaccggcacgccggcttcgtgctttttacgcaattcgtagcagaagctggcaaacgtgtcgatccaggcttcgatgtaatattcatgggggccttgctgagcgaccgtaaacgcgccttcccaaccgttattgccgacgtcggccatcaccacgctgtgccagctttcgtcttgcagcgggcgccagcggatcagcacggccagcttgtcgtggccgtcggcaaacaccttgctggtgacagtcacccgttggccaaccacggccttgacggcgaattcgccgccatcgatcaccggtgcagtactttcgatagcgatcctgggcaatagcaacgcctgggacagcggtaatgtggagtcgtctggagccagtgtttcagcagtcatcgagcatcttccccttacgccctgtggacgctctttgcttgatccgaattctgaggcggcagcgctctccctgagcagggccgtaataggtccgagcctgccgtgagtgcaaaagttcaggtggatataccgccattgggcggggaatcaaatctccccggcggttgtccaccggtagagcaaagcacaaaggaggccacaccgatgaatatcccgattccggctgaaacacctgacccgaacatcgacgacccgacattaccgcctgcgcagccatcgccgattcctgaacaggaaccgcctgaaaatgagccgccgcccgtgcaggaacccccaacgagcgagccgccggtcatcctctgacgtattcgcttcaggttcggcgtccgcttgctcgatccgcgtgagggtggcacttgcaccaagacgtgcaggcggacgttaatagtcgaaatttcccacttacttaaaagggaaagccctaactccaaccgacccgatacttcccatactgactttgagctgacctcaacgccaagtccgaggccccagcgttcagccgatccgtctatgaggaatcatcatgtcgaccatccataccccatcgcaagctcgctcagacgcaccgccaatccacgctaattcccccgtcaggcccccggcacccgaaatcgtgtctgccaaaggcgtggacgacctgctccagtccggccctaacagcgcccgggagccaatgcgccccgatgagcccaaaatgacgcctgaaaaccgggccaaaatcgaagcagagctcgacgacctcagtgcccagctaacccctaaaacgctcgaccacatgatgcgccaccctaaatccgagcagtcaaaagcccacttcgaaaagatcgaccgcgtgttgaccgcagacaacatcaaaggcgtgttgagcggcccgaacgcggagtcttgcataaagacccttggcaagatcgagacccagttaaaacaagagtcgatcaacactgcgttcgatcctattgcgaacgagcaggtcgaggcctaccgcagacatgtgaactcgatactgttcgatctgaaggccagtttgctgagagccccggaaggcggtcgctttgaaatggtcctcgacttttcccgaagagagcagccccgcctgaacagcattcatgactttatgaatgacctgcacgccaagggtagccacctctgcgacattgccaccgaggtgcacaaagcgatcggggcgctgcaattttcacatcctgatggtttgaggccagagagataccgcgaacctgaccacgcacagcattccaaaacctacagcttcagtaataccgcggcatctacccttgaacacccctgcgaaatcaggaatttcgtctctgaccgagacaaaatcgacgtcaccggtattagtaggcaactcaataaacccctgcactgggtcaaccagttatcaggcgccagtggcgaaatgcagttgaaatactcacgtgaaaataatgccactgtgctggtgatttccggcaacaaaggggagcccgcgctggtcgccaagatattcggccaagtgaaagaaaaggacctactggtctgaccggtggtcatcagaggcctcgaatgctctgacaatcctgggcatcacgctaaataccgccaaggccaacaacgtactgagcaccgctgtcgattcacggcccattccggcagcgaccccaatcgctgcggtcatccacaggccggcggcggtggtcagacctttgacatgctggccctcttcatcttctttgcctttgaggatagtgccggcgccgagaaagccgatgcccgcaatcacgccctgcaccacgcgactcatggcatcggcctgattgccggacatctgtggcaccagcacaaagagggctgcgcccaacgccaccagcatatgggtgcgtacacccgccgccttgcctttgtgctcgcgctcaaacccgagaataccgcccaggatcgcggcgatcagcaagcgcacggtgatctgggtgagttgcttggcatcgcctatgtcagcgaattcagcttgcaaggtttgccacacttcatgccaccaggcgtccatggaaagcagtcctttgtaagagttggtaaaaggttgacagcggcgaccgccagtcagttgcctggaaccgttgacatggccctgaaccctaacgttcaccagctcagggaaaggaaatcaccatgccagtccgtatcgaaaaccagacgtgctatttcaaggtcgacgaaaacggccaggagcgcagcctgcccgccgtggatgtgacaatcagcaccgacagcctcaaagccatgtcttttgtcacagtggataacgacaggatctacatcaccgaagccgaggccgacgccttgaccgtggccggcgcagaggacgggcgcaaacacttgaaggctaccgacagtgattcggtgatctgattgatctgtatcagcatgcgattgaaaccgctgcattccacacgccacggggtgcagcagatcgtcgcaggcgtgtttgagcaacccatctgatctgctttttatcgccatagctgagtctgttacgcaaacagtgcggcgttcatagttcattcgcctgatggaggctgatgagcgaacgaccatgagcgaaagaatcccaaccgtggaaacctttgagcccatacacccaaagaaggtgaaggccaaatccagcgacaacctgatccatacccgcagtttcaccggcctgttccgcaccttgcgcgtgagcggtgcaggcctgctgtttctggcgtttttcggcaccgtgtggctgaactggggtgggcgccaagcggtgctgtgggacctggctgaaagcaagttccatattttcggtgcgacgttctggcctcaggacttcatcctgttgtcagcgctgctgatcatctgcgccttcggcctgtttgcagttaccgtcttcgcaggccgagtgtggtgcggctacacctgcccgcaaagctcgtttacctggctgttcatgtggtgtgaaaaggtcaccgaaggcgaacgcaaccagcgcatcaaactgcaagcggcgccctggagcctcaacaagctggcgcgacgtgcagccaaacatacgttgtggctgggcatcagcgtgcttaccgggctgacgtttgtcggctatttcacacccgttcgccccttggtcatggagctgctgacctggcaaatgggcggcgtgagcctgttctgggtactgtttttcaccgctgccacctacctcaacgccgggtggctgcgtgaagcggtgtgcatgcacatgtgcccctatgcacggttccagagcgtgatgttcgacaaggacaccctgaccatttcctacgacgccgcgcgtggagaaaaccgtgggccacgcaaacgcgacgccaagcctgccgacgtcggcctaggtgactgcatcgactgccagctctgcgtgcaagtgtgccccaccggcatcgatatccgtgacggcctgcagatggaatgcatcggctgcgcagcctgcattgatgcctgcgactcgatcatggataaaatgggctatgcccgtggcctggtcagctataccagcgaacatcaactgcagggtggtagcacccaactgctcaggccacggctgatcggctacagtgccgtgctgctggtgatgatcgcggccctggtggtggccctggtggggcggccgatggtgtcgctggacgtgaccaaggaccggggcatgttccgcgaaaacagccagggcttgatcgaaaacatctacagcctcaaggtcatcaacaaaacgcagcagcgtcaggactaccgcctggagctggtcgatgctgagggtttccagttgcaaggcaagaccgagatcagcctggcgccgggggaaatcagcgatgtaccggtgtcggtggcgttgctggccgacaagccggcaagcagctcgcagaccttgcggttcaaggtcaccgatgtggatgaaccgtgggtctacagtgctgccgacagccgctttgtggcgccgatgaaccgctgagccgccgcgcgataaaggtgggagctggcttgcctgcgatagcgtccggtcagccaaggataaagctggctgtggcatcgctatcgcagcataggtatctacacaactttgtagctgccaaccgtacccacgatgcgtagcgagccgctcttgctcttgatctggcttttgatcttgatcttaggcgtcccgttaaaccacgctggccggaattcgacatggatttggggggtaaaccggcagggatgccggtttagccgccccgcgccatggatggcgcgtggcggcggccccccaaatccatgtcggattatgggcacaccgagcccaagcgaggtgccgagtggtgggacgaggactttttggttactttttgctgggccggcattccggtccctcaaaaagtgacccgctgtaagagcggaaccctaagtggccgttaccgcaggaatggatatgtactcggtctgatccagcactctggtcggctgtcaggccgccatcgggggcaagccccctcccacatttggaacgcggtgcatcagttagatagctgtaagctgccagacagcaagttagcgccgcactcaaagttgtgtagatacctatggctatcgcaggcaagccagctcctacatttaatcctgcgtacatttttagaatgctaattaggccctcatgaaacgctacgaaaaattcgccgatgacatcgcagaactgatccgctccggcgtgctggggcccggccagcgcgtgccgtcggtgcgctatgcgagccagacccacggcgtcagcccgtccacggtatttcaggcttactacttgctggagcgccgcggcctgatccgcgcacggccgcgttccggctacttcgtcaacacccacgcgccgagcccattctccgagccggtggtgagcgagcaggtgcatgagtccactgaagtggacgtgagtgagctggtgttttcggtgctcgattccatcaaggaccccaacaccgtgcccttcggctcggccttccccagcccgatgctgttcccgttgccacgcctggcccgctccctggccagtgccagccgcgagatggacccgcgcctggtggtcaccgacatgtcacccggcaacccgcaattgcgccggcagattgccctgcgctacatggtcggtgggctgatgctgcccatggaagaattgctgatcaccaacggcgccctggaagcgctgaacctgtgcctgcaggcggtgaccgagcccggcgacctggtcgcgattgaagcaccggcgttttatgcctgcctgcaagtgctggagcgcctgaagctcaaggccgtggaaatccctgtgcacccgcgcgacggtatcgacctcaacgccttggcacacagccttgagcgctacccgatcaaggcctgctgggccatgaccagcttccagaaccccatgggtgccacggtgccggaggcgaagaaacaggcgctggtagaactgctgcgcagccatcaagtcccgctgatcgaagacgatgtgtatgcggagctgtattacgggcaacaggcgccgaagccggccaaggccttcgacaccgaaggcctggtcatgcactgcggctcctttgccaagagcctggccccgggttaccgcgtcggctgggtggcggccggtcgctatgcgcagaaagtcgagcgtttgaagctgatgacttcactgtgcccctcgatgccggcccaggcggccattgccgactacctgcaacatggcggttatgaccggcacctgcgcaaattacgttacgcgctggaagaacagcaaagcgccatgctcgcggccatcgcgcgttacttcccggcgcagacacgggtcagccagccagccggagggtactttctgtggctggaactgccggagaagaccgattcgttgaagctgttccagatggccctggcccagggcatcagtattgcgccggggccgattttctcggcgacccagcgctttcgcaactgcattcgcttgaactatggcagcccttggacagaggcgtcggagaaggcgatggagacgctggggcggatcgttcgctctttttgagttggaaccaaacccaagcctggaccacataggaaggtgcacttttcccacactggaatgtgcgttttcttagtcaacatttaggttttttatgacccgcttatcgccctcaggttttaatcccttgcctgtcccacccaactacatgcgtgcagcggagcaaaatcaagtgcgcgaaatgaccggccccatgggccggccgcccggcgaccaccgctcggcagaacggattatcgagcaaagctcggtcatgaaacgcttcctggaaggccgcgattattaccaggtgggtgaagacctcaaaaagcaggttggtgactggacggatgccaaccccgatctgcaagccagggccgatgcggcctacgacctcgacaaggtgctgcgctttatcgataacgtggacgaccgaaccctgaacgccagccaaagccgcaatggctatatcgacgggttttccgcagacggctttggcaaccgggacaactcggaagcctcgctgctccagcagttttcctggcacggctatgaaacgctgcgctatctgccaacctgatcaggcgacacgttaacgaccgccgcccaaatccaggaatgtacccgtggcgtacgaagccttgtccgacagcaaccagataatcgcttccgccacttcatccgggcgcccgccacgggccatgggaatagccgattccagtttgctgacgcggtccgggtcgccgctgagggcgtggaagtcggtaaagatgtagccagggcgcacggcgttgacgcgaatgccctcacccgccacctctttcgacaggccaagggtgaaggtgtccaacgcgcccttggaggcggcgtagtcgacgtattcgcccggcgaacccaggcgcgcggccaccgacgacacgttgacgatactgccgccctgcccgccatgtttgggcgacatgcgcagcaccgcgtgcttggcgcacaggatcggccccaacacattggtcttcaggagtttcaagatgcggaattcggacatctcatcaacccgcgatttttgcccgacggtgccggcgttattgaccagcgcggtgacacgccccagctcagcgtctacacggttgaacagcgcaatcacctcatcctcgatgctgacgtccgcgcgcaccgcgatcgcctgggcccccaggccacgaacctgctccagcacacggtgggcagctgcttcgtcagactgatagttgatgcagatgcggtaaccctcgcgggcggccagcaatgccgtctcggcgccgatgccacggctgcccccggtgatgatgacgactttgtccatgcgtgcggtctcctgattcaaccatctgtttaaggttggatccaagaatacccgtcacccacggcttttgtcaggcgctgctgcagcttcggcccgcaggatgtcggccatgaagccgtcggccggcaagggatgccccagcaagtagccttgcagggcgttgcagcccaagcgcgtcagaaaactctgttgcatatcggtctctacgccttcggcgacaatgcgcaggccaagggcctggccgagggcaacgatggccgagacgatggcagcgtcgtcactgtcgtgttccaggtcgcggacaaaaccgcggtctatcttcagttcgttggccggcaggcgcttgaggtacatcaggctggaatagccggtgccgaaatcgtcgatggacaggtcgacgcccatgtccgacagctgctgcaataccgtcatgctcgcgtcggcatcgctcatggcggtagtttcagtgatttccagggtcaggctattggccggcaactgatggcggtcgagcgctgcggcgacactgttgaccagcccggcatggcagaactgcaatgccgacaggttcaccgcgatgcgccagtcttcataaccctgggcgtaccacaggcgcatctggcgacaggcttcattcagcacccactcgccgatggcgatgatcaacccggacttctccgccaactcgataaaggcggccggcaacaataagccctgctgcggatgctcccagcgcaacagcgcctcggcccccaccgggagaccgctgagcgcgtcgaacttgggctggtaatacagccgcagttgattgtgctcaagggcattgcgcaggtcctgcaacaactgcagttgtttgcgcgcattggtgttcatcgacacatcaaagaagctgtagccgttcttgcccatgcccttggcgtggtacatggcggcgtcggcattcatcaacagttcctgagggttgccgccattgccggggtacagcgcgatgccgaggctggcggaaatcttcagctcatgctcggccaccgtgaacgcccggttgatcaggccaacctggcgctcggcgaggcccaaggcatcgtccggctgggtcaattgcacaagcaacacaaattcatcaccgccgatgcgtgccagagtgtcctgactgcgcagatcctcgcgcagacgcaagcccacttcgcgcagtaattggtcacccatgtgatgaccaaaggcatcgttgaccggtttaaagccgtccaggtcgataaacatcagggcaaagcagccgccctgctccttcacggcctggatggcttgctgaatgcggtcggcgagcaaggtgcgattgggcaggccggtgagcatgtcgtgcagggccaggtgggtcagttcctgattggccagggtcagggagtcggcgagcacggcggtgcgcgcttcgaggcgcgcgtcgagcagcgaggtcagcagcgcgatgatcaacaccgccaggctggtgaccagcaccagattgtccaggcccttgccgctgagccccgtcagcgcggcgccgcagaaactgttgtcatcaaactgcgcggcggccatgccggtgtagtgcatgcccacaatcgcaatgcccatcaccacggctgcgccaccacgcgccaggcgcacgtaaggtgtgttgcgacgcaggttgaaggcgatccacagcgcagcgccggaggccccgacagcgatcagcaacgaagcaccaaacagggttgggtcgtagtcgataccgggggtcatgcgcatggcggccatgccggtgtagtgcatgctgctgatgcctgcccccatgatcagcgcgccaaacgccagctgccatgccggcagacggggttggctgaccagccataaggcgaagccgctggacaacacggcaatcagtagcgacagcgcggtgatgcccaggtcaaacccgagggcaaatggcaggcgcaaggccaacatgccaataaagtgcatcgaccagacaccgacgcccatcgccaatgcaccgcccgcgatccacccatagacggcgcggcctttggcggtcgcgatgcggccggccaggtccagcgcggtgtaagacgccaggatcgcgacaaagagggaaatcaccaccagggagggggaatagctaccgatcagcatggggtttctcagaactgacgggcgtggaacgcccgtgccagatggcaaagcgggcgattgtagcgagaataattattgggcagttgattaattatcacagggccattagtggcgttttgacgccaatctgctgactaggaaatgttgggagtgagactgttgccttaggctgtactcaatcaaatgtgggagctggcttgcctgcgatggcatcaccgcaatgcaccggacgaaccgaggtgtctgcatcgcaggcaagccagctcccacagttggatctcagtacatcaggacgatgtgctgttgccctgctgttgcttcaaccactcaggtcgataggcactcggtcatttcttctgcgtcagagcagtctgcccatcccaaccaccccccaacgctgcaatcaactgcacactcgccaccaaccgtgtctgcagtaaggtcagcaccgtgcgctcgttactcagcgccgtcgcctgcaccgtcaccacatccagataaccaatcagccccgccttgtactggttttcggtcaaccgcagcgactcccgcgccgcctccaaggcttcattgctcaccaccgcctcgtcttccagtaccttcaactgcaccatgtagttttccacttcacggaaaccatccagcaccgtctgacgatacttcgccaccgtctcatcgtaggacgccaccgtccgatcaacctccgccgaccgctgcccgccgtcgaacaaggtcatcgccatcttcggccccaccgaccagaagcgattcggcaagctgatccaatcggcatacgtgctgctggaatacccgcccgccaaactcaaggtcaaatccgggtaataagccgccttggccacaccgatattcgcgttcgcggcaatcaccgaacgctcagccgaggcgatgtccggacgacgttccagcaattgcgacggcaggctcacaggaatctgtggcaacgccgggatgtccttgctcaccgccaagttgaaattggccggtgcctcaccgatcaacaccgcaatcgcgttctccagctgggcgcgctgccagatcagatcgatcaggctcgcctgggtggtcttgagctgggtttgcgcctgggcaatcgcatctttgccggacacgcccgcgcggtactggttttcggtcattttcagcgagcgctgataggtgtccagcgtggcctgcaacaaccgggtctgttcatccatgacccgcagttgcagatagtcctgcaccagttccgattgctggctcaaacgcatcgccgccaggtccgccgagctggcctcggccgtggcttcattggcttccaggccacggcgcaatttgccccacacatccgcctcccaactcacgcccaattgcgcgttgagggtgtcgcggataccgctgctggaactgctgaggctcgcgctactgctgccagtgccttggctggcgcgggttttcccggcgctcaggtccacggtggggaaaaatgcaccgcgcgcgctgcgcacctgggcctgggcctggcgaaaacgtgcttcggcctgggccacggtctggttggaagtgttcagacgcgtgaccaggtcattcaactggcgatcgccgtacagctcccaccaggcgccacgcgccagcgaatcgctgggtgtcgcctgagtccagccctgggcctccttgaattgcacgggttcgatcacgtccggccgtttgtaatcggggccgatggcgcaagcgctgagcaaagccccacacagcaccaggctggcgacacgggagccacggggcatgctcatggccaatttggcaagcgttgaatcggtcatagtgcagtgtccaaggcagcatcggtacgcacaccgcgccaagcgttgaagcggtggcgcgcgcggtcaagatagaggtaaaccaccggggtggtgtaaagagtcaggatctggctgaacaccagcccgccgatgatggtcaggcccaggggctggcgcatttctgcgccgtcgcccgagccaagcagcaacggcaaggcgccgagaatggcggcgagcgtggtcatcaggatcggccgcagccgcaacaggcaggcgctgcgaatcgattccagcgggctcatgccgtcgtggcgctccagctgcagcgccaggtcgatcatcaggatcgcgttctttttcaccaccccgatcagcaggaacagccccagcaacgagatcaggctgaactcgccgcccagcaggtagatcgagagcaacgcgccgacaccggccgacggcaaggtcgaaagaatggtcagcgggtgaatgtagctttcatacaaaatgcccagcaccaggtacaccgccaccagcgcgccgaggatcatgaacggctggcctttctgggttgccgcaaacgcatcggcggtgccggccattttggcgatcacatcctcaggcaagcccaccttggcaatcgcccgttcgatggcggccgtgccctgctccaccgtcaccccgggcgacatgtcgaaggcaatgttttccgaggcgaattggccttcgtggctgacgcgatcgtcagccaggctgttttcgtaatgggcaatggtcgacaacggcacccgcgcaccggtggaggtaatcacctgcatctggttcagggtaatcgggtcctgggcgtatttcgggttgacctccatcaccacctggtattggttgaggctgtcatagatggtcgaaatctgccgttggctgtaggcgttgttcagcactgccgtgaccatgctcatgtcgatgcccaggcgcttggcctggtcgcggtcaaccaccagcgttacctgcgccgcaccacggccttcgcgggcgtcgatggcggtcagctccggcagttcgcgcaaggcggcgaccactttcggataccacaggcgcaacgccgccaggtcgccgctttgcagaatgtacgaatactgcgcactggtctggtcgcggctgccgccaaattgcaggtcctggtcggccatcaggaacagacgcccgcccggcaccagcggcacttccttgcggatgcgctcgatcaccgcctgggccgagatcttacgctcggcgatgggtttgaggcgcaccagcatcactgcgttgttggtgccgttgttgccgccaataaagccggccacgctgagcaccgccgggtccttgagcaccgccttgcggaaggtctccatctttggctgcatcacgttgaatgacagcccgtcgtcaccgcgcacaaacccgatcaattggccggtgtcctgctgcggcatgaaggttttcggcaccaccacgtacagcgcaatgttcacgcccacggtgagcaacaggctcagcagggtcaggcgccgatggcgcagcacccagtccaggctggtcgcgtagaccgcgaccatgcgctcgttgattctgtggctccagcgctgcaaaccggtcatgtggcctttgacgtgcggcttgagccagcgcgcgcaaagcatcggggtcaaggtcagcgacacgatcagcgagacgatgatcgccgccgacaaggtgatggaaaactcgcggaacaggttggtaacgataccgcccataaacaggatggacaggaacaccgccaccagcgacacgttcatcgacaacaaggtaaagccgacttcctgcgctcccaggtaagcggccttcatcggcggcacgccgtcgtcgatgtgtcgggaaatgttctccagcaccacgatggcatcgtccaccaccaggccggtggccaggatcaacgccatcagcgagaagttgttcaacgagaagccgaacaggtacatcaccgcaaaggtgcccaccagcgacaccggcaccgccagggtcgggatcagggacgcgcggaagttgcccaggaacaggtacaccaccagcaccaccagggccacggcaatcagcaaggtcatctcggcttcatgcaaggtggcggtgatcaccggcgaacggtccatggccaggttgagcttgacgctggacggcaacaccgcctgcaacgccggcaactgtgccttgatctgccggaccgtctcgatgatgttggcgccggactggcggttgatcaccagcagcaccgccgaatcattgttgaaaaagccgctgttgtagcggtcttccacgccgtcgctgatcttcgccacgtcgcccaggcgcaaagcggcgccgttctggtaacgaatcagcagcggttcgtaatccttggccttttccagttggtcattggcctggatctgccagttacgctcactgtcttcaagagagcctttgggccggcgctggttggcgttggcgatggtgttacgcacgtcgtcgagggccacgccgtactggtcgagggccttgggctccagctcgatgcgtaccgccggcagggagctgccgccgatctgtacttcacccacgcccggcacctgcgacaggctctgcgaaaggatggtcgaggccaagtcgtacaactcgcccttttgcagcacgtcggaggtcagcgacagcaccatgatcggtgcctgggacgggttgatcttcttgtaggtcggcatgctgcgcatgccgctgggcagcaggttgcgcgaggcgttgatggccgcctgcacttcgcgggccgcgccgttgatatcccggtcggagtcaaacgccaggatcacccgcgtcgagccctggctcgatgagctgctcatggtggtgatgccggaaattgcgccgaacgaacgctccagcggcgtggccacggtggacgccatcacttcggggctggcgccgggcaagctggccgacaccacgatcaccgggaagtcgatctgtggcagtggcgacaccggcagcaaattgaagctgacgccaccgagcaacatgatcgccaggctcagcagcatggtcgctaccggccggcgaatgaacggtccggacaggttcatgactcaaccggctccaggctttgtggctctttgcgccagcgacggcccaaacggtcgaagtacaggtagatcaccggtgtcgtgaacagggtcagtacctggctcaccagcaacccgccgaccatcaccaggcccaacggctggcgcaactcggcgccggagccggtggccaacatcagcggcaccgcaccgaacaaggctgccagggtggtcatcaggatgggccggaaacgcaacagcgcggcttgatagatcgccgtctgcgggtcgaggccctggttgcgttcggcgtcgagggcgaagtcgatcatcatgatcgcgttcttcttcacgataccgatcagcaggatgatgccgataattgcgatcatgcccaggtcattgccgctgagcagtaacgccagcaaagcgcccaccgccgccgacggcaaggtcgagaggatggtgatcgggtggatataactctcgtagagcacgccgagcacgatgtacatggtcaccaccgccgccaggatcagcagcaaggtgctcgacagcgacgcctcaaatgcctgcgccgcgccctggaactgggtctgcacgccaaccggcatgccgatgtccttctgggtctggttgatcagctccacgcctttgcccagcgcgacgccgggggccaggttgaacgacatcatcaccgccgggaactggccgatgtgcgcaatcgccaactgcgcctggcgctgctccacatgggccaggctcgacaggcgcacctggccgccgtcggtggttttcacatgaatctggttcagcgccgccggcccgagggtttcaccggactgggcctgcagcaccacgcggtactggctggcctgggtgtagatggtggaaatctgccgctggccgaaagcgtcgtacagcgcatcggtgatggtcgacacactcacgcccaggcgcgaagccgcatcgcggtcgatcaccaggaacacttgcaggcctttgtcctgcaggtcgctggcgacgtcggtgagttccggcaactggctgagggcgtgtaccagtttgtcgctccacagcgccagcaactcggcgtcgggcgatgacatgctgaactggtactgggtgcgactcacgcggtcttcgatggtcaggtcctgcaccggctgcatgaacaggcgaatacccaccagcttgtcgatttgtggctgcagccgcgtgatcacctgggccgcgctcaagtcgcgctggccgtgggccttgaggttgatcaacaaacgcccgctgttgagggtggcgttatcgccatccacgccaatataggacgacaggctttccaccgccgggtcagccaggatgaccttggccaactcctgttgacgctggctcatggccgcaaacgaaatcgactgcggtgcctcggaaataccctggatcacgccggtgtcctgcaccgggaaaaagcccttgggcaccaccagatacagcaccacggtcaggcccagggtcgcgatagccaccagcaaggtcagcggctggtgcttgagcacccattgcaacatgcttgcgtaacgcgcgatcaaccagtcgatccaggcgccgctggccttgtagaaccggctctggtcttcttccttgggttcgcgcttgagcaaccgcgcgcacatcattggcgtcagggtcagcgagaccaccagggaaatcagaatcgccaccgccagggtgatggcgaactcgcggaacagccgcccgaccacgtccgccatgaacagcagcgggatcaataccgcgatcagcgacaaggtcagggaaatcagggtaaagccgatctgcttggcgcccttgagcgcagcattgagcggcgtctcgccctcctcgatgtaacgcgaaatgttctccagcatcacgatggcatcgtccaccacaaacccggtggcgatggtcagggccatcagcgtcaggttgttgatggagaaacccgccaggtacatcacgccaaaggtgccgatcagcgacagcggtacggcaatcgacggaatgatggtcgcgctgacacggcgcaggaacaggaacgtcaccatcaccaccaaggcgatagcgatgagcaattcgtgttgcacatcggtgaccgacgcgcggatggtctgggtacggtcggtgagcaccgtcacatccagaccggccggcaggttatcggtgatgcttggcagcaacgccttgatgcggtcgaccacctcaatcacgttggcgcccggctggcgctggatattcagcagcacggcctggttttcattggcccaggcggcgagccgctcgttttcggcgccgtcgacaatctgtgccacgtctttaaggcgcaacggtgcgccattgttataggccaggattaattcggcgtattgctggggcgagaccagctggtcgttggcgtcgagcatcgacacccgcgtcgggccgtcgaagttacccttgggctggttgacgttggacgccgcgatcaaggtgcgcacgtccgacaggttcaagccattggcggccagggcctcggggttgaccttgatgcgcacggcctggcgctggccaccggcgatgctgaccatgccgacgccactgatctgcgcgattttttgcgccatgcgcgtgtccaccaagtcattcaacttgggcagcaacatggtcttggaggtaatcgccagggtcagcaccggggtgtccgccgggttgaccttgttgtacaccggcggtgccggcaaatccttgggcagcaggttggtcgcggcgttgatcgcggcctgcacctgctgctcggcgacatccatattgatgtcgaggttgaacctcagcgtgagcaccgacgcgccgcccgagctggtggacgccatctgggtcaggccgggcatttgcccgaactgacgctcaagcggcgccgtcaccgcgctggtcatcacatccgggctggcgccggggtacagggtcatcacccggatggtcgggtaatccacctggggcaaggccgataccggcagcaagcgataggaaatgataccggccaagacaatggccagcatgctcagcgtggtggcaaccgggcgaaggataaacagccgcgacaggttcatgaaccgaccttttgcgccttgccggcgttagcgccggtctccccttttgcggcgggcttgccttgcaggtgttcggtcggcgtggtcggcacttcgctgctgtcgttgaccacttcgatgtcgctgccgtccttcaagcggtcggtgccttccagtaccacgcggtcgccggcgaccaggccttccttgatcacggtgttgtcgccatcggtatcgccgactaccagcggttggaccttgaccttcttgtcgccatcgagtttgtagacgaaggtgccgttgttgccgaactggattgcagcggacggcgccagcaccacgttgtgcaaggtgtcggcgagcaggtgcacgttgacgaactggttggggaacagcgcctggtccttgttatcgaaacggcccttgaatttgagggtgccggtggtcacgtcgatctggttgtccaggctctgcagcacaccgaccgcctgttgtttcgcgtcgccacggtcccaggcttccaccggcagcttgttgcctgcgtggtaacgggtgagcacggtgtcgagcgtattttccggcagggtgaagaccacgctgatcggctgggtctgggtgatcaccgccaggaaagtggtgtcgttggcagccaccaggttgccgacgtcgacctgacgcaggccgacacggccgctgatcggcgcacggatcttggtgaattcgaggttgagcttggcgtcgtccaccgcaccctggttggtcttgaccgtgccctgatattgcaggaccaacgcttcggcggtgtccagggtctgcttggcgatactgtcctgggcatacaggtcgcggtaacgctgcacatccacctgggcgtttttcaactgcgcctggttctgcatcagcgtgccctgggcctggagcaaggcgttctggtagctgcgcgggtcgatttccgccagcaggtcgccggccttgaccatctgcccttcttcaaaggcgatcttcaccagctcaccgccgacccggctgcgtacattgatggtgttaagcgcggttacggtgcccaacgccttgtagtacaccgggaactcgcccgtgaccgccggcgccacacgcaccggaatcgggccggtagagccaccgaagcccgggcgcatcatccccgttttaccggcgtgcccggccggtttcttctcggcggcatccttatggctgccaggccagaatttccagcacaggccggcgataaccagcagcacgagcaggccgaacagccagcggcgggagttgcggggggaggattgcatggagtgatcaaccattgggcgcgagagcttctactttgggaggctgaaagataagcactggggcgcattaagaaaagcgcctttaccggctatttaccttggacttacaacttttaacttctgagcttagtccgtccgctatttcgctaaaccgctgacgccaaatgaaaacggcctggactaggccaggccgcaatcatctatcaagcgtgttactgcgaaaagacagtaatgcgctgaaacagttacttcaaaacagccagggctgcttcgtagttcggctcttgaccgatttcgctgaccagttcgctgtgcagcacattgttgttttcgtccagcactaccacggcacgggcggtcaggccctgcagcgggccttcagcgatagacacaccgtagtcaacggcgaagtcggcgttgcggaaatccgacaggctcagcacgttgtccagaccttcggtgccgcagaaacgcttctgggcaaacggcaggtcggaggagatgcacagcacgacggtgttgttgacgtcgttggcctgggcgttgaacttgcgtaccgaggtcgcgcaggttggggtgtcaacgcttgggaaaatattcaacactttgcgcttgccggcgaaggtttccagagttgcttcggacagatcaacggtggtcagggcgaactctggggcggtggaaccggttttcggcaattcgccttcaacctggacagggttaccacgaagggtgacttgagccatgaacggaatccttatgctgggtttgattaaaacgaattcgagaggcagaagttaaccacaaactgcgatcagcacctatgggcaattggaaatcgagcgggcaaacccgagcacccagggtgcccggggagaaggctgcagcctgatcaaacggtcactgtatgtgttgcaatggcgcggtcatccggcccacccatatcaaaaatgaactctgaagtgaaggtgatctggaccgcgcctgccggcagcgcgacagagccttcggtacgccagacatgccatgagccgtcttgcttgcgatcatccggggagttcaccttccactccgcgcccgacttactcttggctttgaagttgatattggcgttattgcgcgagccattgtcggtgaacatgtattcctctgtcataaccgtcagcgtattagccacccggcgccagcgaattctcaggttacctgttaggccactggcgcctcttgacaacgtgtagttatgccattcggtatcgactgctgcgtcagtggcgttgtttttgtcggtagtcattggatgtatctccttggaaacgactgaattgaactcccgattccattcctgtccgggaagccccatcgaacctagcaccggacctggcgctcgataactgtgaaatctgacagtgcgctagctgaattcggcataaacatctgcgccctaatgacggtgttcaaggcgcacggtgcaaaaataaggtttaatcgcgggctttttgccctgcccggcctacaaggatctatcactcatgaatcagcccgccactaaagtcctggtcattggttatgtctggccggaaccccgttcctcggccgccggcgggcacatgatgcagattcttgagacgtttctgacacaaggttgggacgttaccttcgcaagccctgcgaccgttggcgaacacaaggccgacttgccggccctgggcatccatgagtgcgccatcgaactcaataacagcagcttcgatgattttatccgcgagctggccccggatatcgtgctgttcgaccgtttcatgatggaggaacagttcggctggcgcgtcgaaaaacactgccccgacgccctgcgtgtgctggagacctgcgacctgcaaagcctgcgcgacgcgcgccagcagcgcctcagggaccatctcaaggcacaccctcacagcgacgacttcagcgcactgttcgccccggcgctggtggaagaattccagttgatggccgacacggacgtggccaagcgcgagatcgcggcgattttacgctgcgacatcaacttgatgatctccgacgtcgaagcccggctgctcaccgaacagttcaaggtgccggccgccctgctccactggtgcccgctgatgctgacgccaccggccgaggccttcgcgccctttgaagagcgtgcgcactttctcagcatcggcaatttccgccacgcgcccaactgggatgcggtgctatggatgaagaacagcctctggccgttgatccgccagcaattgcccggcgcccaactgcacatctacggttcctacacgccgcccaaggccactgccctgcacaaccccgcccaggggtttcacatcatgaactgggccgaagacgcgttgcaggtgatgagcgccgcgcgtatctgcctggcgccgctgcgttttggtgccggcatcaagggcaagctggcggatgcgatgctctgcggcacgccgaatatcaccaccccgattggcgccgaaggcatgggcgatgagcagccgtggccgggcgcaatcgagcacagcgcaaaggcgctggccgctgctgcggtggcgttatatcaggacccgatgcgctgggcccaggctcaggaagatggccgccagttgcttgcccgtcgctacgaccacgcgatccacggcccggcgctgattgaatgcctggagcagtgccgccgtaacctcgccgcccatcgccgggacaacttcatcggcagcatgctgcgacatcatgcacacaagagtacgcagtacatgtcgcagtggatcgaggcgaaaaaccgcagcgtataaacaccgacgctggcgaggtcgcgcgcaagggggcattatcccaggcagcaaccacaataaagcgacggcagcatgacccgagcaacgcgaatcaccgacccttcctacgagctgatggacgatcacaacggtctgtccatcatttatcgccaacacggcttcccctgcccgttggtgcgctggcacttccacaaggaatacgagctgcacctcatcgtcgccagcgcaggcaaggtgtttatcggcgactacatcggcaacttctacccgcaaagcctgttcctcaccggccccaacctgccccacaactggatcagccaggtagaggaagatgaagtggtgcccaagcgcgacatgctggtgaattttaccgacgagttgcttgagggcggcagccagattttcaccgaactcaagaccctggcgccgctgctggagcgcgcgcaatacggcatcgaatttcgctgcaaaaaaaccatcgcccaagccatgactttgatgcaacgcatcgaagacgcccaaggcatggcgcgcctggggcacttctttattctgctggaagtgttgagcgcgtgtgaggactaccagctgttgtccggcgtgaccacgccgcaattggccgatgaacacagcattgatcgcaccaaccgcgcagtggactacatatttgcccattacgctcgcgagctgtcgctggaagaggtcgctgaatacctgggcatgaagcccacctatttttcccgtgtgttcaaacaggctaccggccgcacgtttatcgagtttgtgaaccgcctgcgtatcagcaagtcctgcgagttgctggccgatggcaacaaggcggtgaccgacgtgtgcttcgagtccgggttcaacaatatctccaatttcaaccggcgctttcagcagctcaagggcatgacgccgtcccactaccggcgcctggcggtgcagcggctgaccgagcagaatctggcttaagcctgacagcggggacacacctcgaacataaatccccggccaaaacggcccccttcccacgcacccacaggaaccctcttgctgtccctgccactcagcgaaggcatcgccctatttcaatcgacgggtgctgcccctcattaacgctagagcaaaaggacaccccatgatcaatggcctgccacaacccattattgcacccaccccgcaacctgccgagccgacgccgccgctcaatcagcgggaacacaccccgaacccgccaagcacgcccaatccgcccatacaggatcaggcaaaaccctctgaccaaccacccgccgcgccgggcgcgctcaatagcttgttgcgcctgcgcctgcgcctggataagcagaacccgccaagcacaacactgatgcacacgttcgccgatgcggtggttaaacacgctgaccatgaacaggccaatagtgtcgccagaagtttgatggacctgcggcaagcggttgactccggtacaccaacacgctgggataaaattgcgaacgttatgcctgaatcgaccttcggccggttgtgggccaagttcgctaaagccgtggaatcggaaccgttcaagtcctatgccgaaaaaaacaacatcaatctgaacgacatggtcgttcaccccaatggaaccattaccaattttagcggcaaacaacccaggacctgggatgcgaacgcaagcgccgaatcaaaagccgctacggcagccgttatcgccgccgccaaagacctcgtggggccttaccaggacgcgctcaaccctcccgttgggataggctacttagcctacgaatcagatgtgacatcgattgctaccatcgcccagttctacggcttgcctgtggacaccaccaacagcgactccatgacggccgccatcggacaactgttacgcgaacagacgttcccgagtttgagcagtaacgacccacgcgatacgcccatcaagcagctccaacaggcagccgtgcaacgcattgagcagcttgaggaggaaccgctcaacgcgcttcttgccacgttcgaacctaaaggtggcgtccctagattcaatacccccgatgaggcgttgcaagcgctgtgcgcacaagcactggcaaaattgcttccaggtatggggaagcacgagtcaccactcatgctcgacaacattcctgagggctcttcattcagtcggattcacaaaaaaaccaaggcaacgctggaagaggtcatggacttttacaaagaaagcatgcccgcccaacatcaggcgccagaacaccaatgggagaaaaagaatctcgactccttattgaacaaaatcagacagttgaacagtggcctaggcttcccatcagcattcgaccatcaagtttctcttttcggtcagaggtacaaggcaccaccgtcgccacttgaaaagctggtgcacgcggttaaagagtccaagtcaaagccacagtaagccagtcacattagattggaacgaatgggcaggccttgcctgacccaaaggggaaacagtcactgcggttgagcggcagtgcttttcccctgattgtgggtgaacgcgtgcctcatcgcgctgcatcgtaccgaacccactgccagtcccacctcacaccctgcaataccagaaggtgaacttctgccctcttaaaaccaatcatcctacggttaaacgataagtttccaagacgcgtattcgcaaagtacgcactaaaaactacagcctataagtcagctgtcgtaccgcccaggaagatactctcatgaacatcgaacccttacgctccagcctgctcccctcttatacacccgccactcaaacccagtccgaaccatccgctattgagcatgcacggcccaagcgcgccagtgcggtggtggatctggaaacaaaaaaagccgccaccacactgatccgagcaggcgacgccgccctctcctctttgcatagcgctgcaatgatggatgaagtcatgattaaacccacttccaagtctctgccggtgcagagctcggttatctccgatttccctccggtctcaacgttcggtagagcctgggctcagcttacccatgcgattcaaagcgaaccttttgcaagtttcgcaagcaaacacaaaatcgacacttcaacacttaaaataaacacgcagtcaggctgggttattgattgcattgcgaacaacaaacgtgcctctttcaacaaatatgatgaaggctatgagcaggccacggctgccgttaccgccgccgctcgagcgtttaactcgccgcctaaatcatcggttctgtataccggcgcaaaccgtgccgagaccgatgtaatcggcaacttctacggcgcgcgccaggacggcacacaggcgaacgcgctccgcttgatcaccgagcagcaacaccacctcaccttcgactcgctgcgtgagcctgactccaaggcacccgagttcaaccctgcgacttattcgcgcatccgagagcaacaacgcgaagcgatagacgattttgccggggaaatcgcattaaagcccgagctgcgctccccttcgcaacgcacgcccaaaccgtcggttgaggatgcagatcgggaaatggccagaatgtacagcggtgccttgttgagccggcggcccgagatggcgtcctacggcaaaggcgcgcgcaccggcttttcattctcggaaatacctgaatactcaaccctggggcaacacctgcgtaacgcgcaggtgccgcctggcaaagacgcgcagatcagcctcgccgagataagtgagttttacgccgagccggcccccagcgaccttacgctggtgggcacccttacacatgcgtcaaggctcactcgcgacggctttcgcgccttgaacaaagacaacccgccaaccgatgaaaacttgcgcgcggtccaggcaaagcaacgcgctgccatccagaggctcgaaaacccaggcgccactgaggtgcctgccgcaccgacgcaaacgcccaccgccgccgtcaaccccgtggctgcgatagcacgccgtcagtttgccggcgagcccaacctgtactcggtggtcgcgcgattgctcggcgagcggataaaacaggcggccccgtcactggacgtcgacgtcaaccagctcgccattgaaacacccgacccggacaaccccgggaacgttaagcgaacacaattgatggcgcttgctttggactacctggccggcggtgaggccccaaacttcaccagcaccgacagagcgtttgacactcgcccggatttatttgcccacaccggcaacgatcccaaggtgccgctcctcctcgatttgtcagccctgagcactgccataggggcactgccgggccttctgaactcagcctacgaggctgattcgcacaagtattggaacgaactggccttcagctctccgaccaacgccgacagcgtcttccccgacagccgtcgtacattgatcagtcatattctgcgcaacaacctgcaactggccagcatgaagcagcccggcctggatgaggaacaacgtaaaaccgtggacatggtcgtgaggcatcccgaaggctcgacgcggcccgcgccacttgaccgcaattcatcgggtgccaccgtctataccttgggcggttctacgccgaacgtggtgattcatcgctacctgtcgcaatcaaaccgcgacattctcttgctggtggagcccagtggcaaaatcactccctatgactcctgggatgacgtcgaaaaggcagggcatatccgggtggaactcaccggcaatatgttcgacacccaggccaacaccctgattaaacagcatcgaggcgacagcctgttcaacccgccaccaacgtttggcccagagaacccgacgcaagccaacaccccgctgcccgactggatgaataatgccgacgaagcgcaacgctttgtgctgcacgagctcaaccagggcctggcaagctttatacaacgtaacaaaggccgtgcgtataacagcggcatcccagacatcggcacatttgcgcaagagcaatttgaccggttgcccgaaagccaaaagctgacgcggcaccacgccaaggatctgagtgtgactttccaaatgagttacggggtgtcggctgacgggtcgacggcttttggcagtaaccattacaagaacgaaagcctgacggacgtgctgattaataacctgtcgggcttaccgagtggcacgctggaagtctccaagcgggtcaaggatgaaaacggcagagaagtcaccttcagggtgcccgcactcgagaaacacggggcactccaacaggtgattactgacctcgacattggtaaaatctaccccgctttactcaaggaaaagctactcgacaaccctgaagaaatggcggaacgccgatcactgtttgtccagcaagtccccatcgagatacagctcaaggcgctggaacttggtatcaagggcgaagccggtttcgacaatacgggggtccggtatgtccaggagatattcaagccgggcacaggccccaggatggtcgacgggaacgaaatcgtcatccgaccgctggcctttgataacaagggtgaaggtacaatcgatgtagtcgatagtgcctacctgatcgaacgcaaggacggccaaggcccgactgttctatatcgcccgctcaatggcaatgccccgctcctgcaacatccaaatcgccaggccctgctggaagccatacagacgccaggcgagctgcaaagctatatcatcccctggtttgctgaagcaaaagcgcgcgagacctacagcggtaaaggcactacacaccctaacttcgtggccttcgggttgaattttgggtccattccctacaacaagaccatccccttggccatggatacccgactggagcaaacgctgcgggaagggaagttgctggagcacctgtaccaggccaatgcgcaaaatttgatcagcctggccgagcaacaatcgacatccgacgcagaaagccgctgggcgactctcaagaccggggggttcctgttactcaatgcggtactgccggcactgcgcggccccggcgccgtactcggctatgtgctacaggcagggggcgttatcaatgacctggaggttctgagcgatgagcgctcgcagggcaaagaggcggcgctggccgatctgttggtcaacctggcgtccttattggcccatttcaagattcggtcacagcccgagccatccactgcccagtcagccaggcctgtaatcggccgcggcccgttggtgactgacgttcccggccgcagcctgttggtggatgacgtggcagcacccactccaccctcgaataaccgcatagtcctgggggggccagcgaagatcaaacccattgccggcgacattcaagtctttgaggactcctacaacggcaagccacgcctcaacatcatgggccacgctgagaaacccctgggtggacaacctgcaaaaatctttggagaagatggcaagcgttacggggcagaagatattgaccaggagttgttggcgcgaggcatagacattcgagactataaagacgtgcggctattaacctgcttctccgccagcgggggtgaacagtcccttgcggcgaaactgagtgcacgcacgaacgtgcgtgtaaaaggttttgagcaggaaatcattgcagactactacggcattgacgatgaagatccattcaaaatctacgaaaacgcctcggcagagtacaagaaacactatccaaacctcagtgtccgtgacattcaccgcctggccgaaacagaactgaaccacaggcttgctgggcgtgatatccaatttaatgtccgcaaagatgacggcagagaggttgaggtaaatctcggcagtgacgaaaagcctgtgatctataaaaccagggtcgactatcaaccgcgcacctttggtaaaccgaaaatcaagcctgtgccggtaaagccaattgaagtagagatgggttactcgcataccgttgaagacgcgcgcaccgtactgtcgactcgcagcttgacggattgctccgcactcgtggtgctgactgatctgaaagacggggtgtatcaaaaccgcacgttgatgcacctgaaaggtagcaatctggagttcgcgttagaacgccaagacgcttacgaagcactgcagacgctgaatgagtcgttggccaatggcggaaaggtgatattcgtagccggggtccattcagactctacggcagggttgggttatatactggggcaagagcaccagggggaaaaaccgctgctggatatcctcgaaaagccgggtgttgaagccactatcgccagctctgtgggggttgagatcaacccggatggcaccttcaagttgattgaaggcacaggtaagggcgtgttcgacaagaccatgaccctggaagtactcgaccgcgcccgttgatcccgcccctctgccacccgcagtagccgtctggagcgactactgcggggtttcaatagtgcaaaaaagtatcagtcccagtgcgcccaaggatttgtcataaccccatttgaaggctgtaatcaacgcacactcttcctgactgctcgtaggaagacacaacaacaataactgtccttctgtagccccctgggcgcggaaatggagtgcgcgatgaagttcacagcaaaagctctgcttgcctgtacgtgtatgaccctcagcgccgtcagccttggcgcgcaaaccctgaccattgccaccgtcaacaacagcgacatgatccgcatgcagaagctctcgaaaaccttcgagaccgagcatccggagatcaagctgaactgggtggtgctcgaagaaaacgtgctgcgccaacgcctgaccaccgacatcgccacccagggcggacagttcgacgtgctgaccatcggcatgtacgaagctgcactgtggggcgccaagggctggctggaaccgatgaaggatctgccggcgtcctacgaccttgatgacgtgttcccttcagtacgtgacggtttgtccgtcaaaggctcgctgtacgccctgccgttctatgccgaaagctcgatcacctattaccgcaccgacctgttcaaggacgccgggctgagcatgcccgagcacccgacctggacccagatcggcgaattcgcggcaaaactcaccgacaagaccaaagagcaatacggcctgtgcctgcgcggcaaagccggttggggtgagaacatggcgctgatcaccaccctggccaacggctacggggcgcgctggttcgatgagaaatggcagccggaattcaacggccccgagtggaaggacgcactgaacttctacgtcgacaacatgaagaaatccggcccgccgggcgcctccagcaacggcttcaacgaaaacctggcgctgttcaacagcggcaagtgcgcaatctgggtcgatgccagcgtggccggctcgtttgtcaccgacaaaacccaaagcaaggtcgccgaccatgtcggcttcaccttcgccccgcacgagaaaaccgacaagggcacctcgtggctgtactcctggagcctggcgatcccgaccagctccaaagccaaggacgccgccaaggtcttcaccagttgggcaacctccaaggaatacagccagctcgtggccaagaccgacggcattgccaacgtaccgccaggtacgcgcaagtcgacctacagcgatgagtacatgaaggccgcgccgttcgccaaggtgacgctggaatcgctgaaagtcgccgacccgaccaaaccgacgctcaagccggtgccgtatatcggtatccagttggtgaccattcctgaattccaggcgattggtacccaggtcggcaagttcttctcgggcgcgctgaccggtcagcaaacggtggatcaagccttgaccgccgcgcagaccaccaccgagcgtgaaatgaagcgggcgggttatcccaaataagcctgactcacccttgtaaatgtgggaacccgttccatgaggtagcagcttttaggtgggagctggcttgcctgcgatccagacacctcggtttgtcagttaaaccgagtgaatgccatcgcaggcaagccagctcccacaaaagccagccacattgatcgcgctccgacgctggccctgcctgtaatcgactggttttgatcaccatgaatacaccacccaaaagccgcctggccaaccccggctggttcctcgtcagcccctcggtggccctgttgctgctgtggatgatcgtgccgctgggcatgaccctgtacttttcgctgattcgctacaacctgctctaccccggcgaaaaccaattcgtgggcctggagaacttcacctacttcatcaccgactcgggtttcctgcccggcgccaccaataccttgctgctggtcggcagcgtgctgttgatcagcgtggtgttcggcgtgctgatcagcgcgttgcttgaggccagtgagttttttggtcgcggcgtggtgcgggtgttgttgatttcgccgttcttcatcatgcccaccgtcggtgcgctgatctggaagaacctgattttccacccggtctcggggattctcgccgccgtgtggaagctgttcggcgccgagccggtggactggttggcgcactacccattgctgtcgatcatcatcattgtgtcgtggcaatggctgccgttcgcgatcctgctgctgatgaccgccatgcagtccctcgaccaggaacaaaaggaagccgcgcgcctggacggtgccggcgccatcgcgatcttctggcacctcaccctgccccacctggcgcgcccgattgccgtggtggtgatgatcgaaacgatcttcctgctctcggtgtttgccgaaatcttcaccaccaccaacggtggccccggctacgcctcgaccaacctcgcctacctgatctacaaccaggcgctggtgcagttcgacgtgggcatggcctcggccggcggcttgattgccgtggtcatcgccaatatcgcggcgatcatcctggtgcggatgatcggcaaaaacctgactgacaagccttgagggccgcgccatgacgcttcaacaatcccgccgcctgcaaagtctgttgctcggcaccttggcctgggccatcgcgatcctgattttcttcccgatcttctggatggtgctgaccagtttcaagaccgaaatcgacgcgttcgccacgccgccgcagttcatcttcacgccaacgctggagaactacctgcacatcaacgagcgcagcaactacttcgcctacgcctggaactcggtggtgatctcgttcagtgctaccgcgctgtgcctgctgatctcggtgccggccgcctactcgatggcgttctacgaaacccagcgcaccaaaggcaccttgctgtggatgctctccaccaagatgctgccgccggtgggcgttttgatgccgatctacctgctggccaagagcttcggcctgctggacacgcgtattgcgctgatcatcatctacaccctgatcaacctgccgattgtggtgtggatggtgtacacctacttcaaggacattcccaaggacatcctcgaagccgcgcgcctggatggcgccacgctgtggcaggaaatggtccgcgtgctgctgccgattgccaagggcggcctggcttccacggtattgctgtcgctgatcctgtgctggaacgaggccttctggtcgttgaacctgacgtcctcgaatgccgcgccgctgaccgcgctgatcgcctcctactccagccccgaaggtttgttctgggccaaattgtccgccgtttcgaccctggcctgtgcgccgatcctgatttttggctggatcagccagaaacagctggtgcgcggtttgtccttcggcgccgtgaaataacggtctttcaataaaaaattcaaagcggaggcccatcccatggccaacctgaaaatcaagaatctgcaaaaaggcttcgaaggcttctcgatcatcaaaggcatcgacctggaagtgaatgacaaggaattcgtggtcttcgtcggcccgtcgggctgcggtaaatccaccctgctacgcctgatcgcgggccttgaagaagtcaccgaaggcaccatcgaactggatggccgcgacatcaccgaagtcaccccggccaagcgcgacctggcgatggtgttccagacctacgcgctgtacccgcacatgagtgtgcgcaagaacatgtcgtttgccctggacctggccggtgtcgacaagaagctggtggaaagcaaagtcagcgaagctgcgcgcattctcgagctcggcccgctgctggagcgcaagcccaagcagctgtccggtggccagcgccagcgtgtggctattggccgtgcgattgtgcgtaacccgaaaatcttcctgttcgacgaaccactgtccaacctcgacgccgccctgcgtgtgcagatgcgcctggagctggcgcgcctgcataaagagctgcaagccaccatgatctacgtgacccacgaccaggttgaagccatgaccctggccgacaaggtggtggtgttgaacagcggccgcatcgagcaggttggctcgccgctggagctgtaccaccagccggccaacctgtttgtggcaggttttctcggcacgccgaagatgggtttcctcaagggcaaagtcacccgcgtcgaaggccaaggctgtgacgtgcaactggacgccggcacgctgatcagcctgccgttgagcggcgccagtttgagcgtgggcagcgcggtgaccctgggcattcgcccagagcatctggaaatcgccgcgcctgggcaaaccacgctgaccgtcaccgccgacgtcggcgagcgcctcggcagcgacaccttctgccacgtcatcaccgccaacggcgagccgctgaccatgcggattcgcggcgacatggccagccagtacggtgaaaccctgcagctgcacctggacccggcgcactgccatctgttcgacaccgacggtgtagccgtggcccgcccactgcgcgccgccgcctgatttcgcgagacttgtgatgaaactgaataaacagaacctcacccaactggcgccgcacgtgaacatcccggcctacgcgattgccagcaccacgcagggtatcgcgcacatcggcgtcggcggtttccaccgcgcgcaccaggcgtattacaccgatgccttgatgaacactggcgagggcctggactggagcatctgcggcgttggcctgcgcagcgaagaccgcaaggcccgcgacgacctggccggccaggattacctgttcaccctgtatgagctgggcgacaccgacgacaccgaagtgcgcgtaatcggctcgatcagcgacatgctgctggccgaagacagcgcccaggcgttgatcgacaagctggccagcccgcagattcgcatcgtctcgctgaccatcaccgaaggcggctactgcatcgacgacagcaacggcgaattcatggcccacctgccgcagatccagcatgacctggcgcacccgaaaacgccgaaaaccgtgttcgggtttatctgcgcggcgttgacccaacgccgggcggcgggtgtgccggcgtttaccgtgatgtcctgcgataacctgccgcacaacggcgccgtcacgcgcaaggcgctgctggccttcgccgccctgcacaacgccgaactgcatgattggatcaaggccaacgtgagcttcccgaatgccatggtcgaccgcatcacgccaatgaccagcaccgcccaccgcctgcaattgcatgatgaccacggtatcgacgatgcctggccggtggtgtgcgaaccgttcgtgcagtgggtgctggaagacaagttcgtcaacggccgcccggcctgggaaaaagtcggcgtgcaattcaccgacgacgtcacgccctacgaagagatgaagatcggcctgctcaatggcagccacctggccctgacctacctgggttttctcaagggctaccggtttgtgcacgagaccatgaacgacccggtgtttgtcgcctacatgcgcgcctacatggacctggacgttacaccgaacctggcgccggtgccgggcatcgacctgaccgagtacaagcagaccctggtggatcgcttctctaaccaggcgattgccgatcagttggaacgcgtgtgttcggacggctcgtcgaagtttcccaagttcaccgtgccaacgatcaatcgcttgattgccgatgggcgtgagaccgaacgcgctgcgctggtggtggcggcgtgggcgttgtatttgaaaggtgtggatgagaatggggtgagctacacgatcccggatccgcgtgcgcagttttgccaggatctggtgagtgatgatgggttgatcagccagcggttgttgggtgtggaggagatttttggcaaggctattcccaactcgcctgagtttgtggcagcgtttgagcggtgtttcgagagcctgcaagatgtgggtgtaagcaaaacgctggagcggctgctcgccaatctcaactgacggaaccgaatcaaactgtgggagcgggcttgctcgcgaatgcggagtttcagtcgacatattcttcactgatccaccgcattcgcgagcaagcccgctcccacaccgaccgcatttccactccaacaataatgctgagcactccaacatgacccagcaaaacctctacctcggcatcgactgcggcacccaaggcaccaaagccatcgtcctcgacgccaccagcggcaaggtgctgggcctgggcgcggcggcgcatacgctgatcagcggcgccaatggccgacgcgaacagcacacccaggaatggctggacgcctttaccgaagccacgcaccgcgccttgcaacaggccggggtcgacggccaggacatcctcggcatcggcgtttccggccagcaacacggcctggtgttactcgatgaccacggccaggtgctgcgcccggccaaactgtggtgcgacaccgaaaccgcgccggaaaacgagcgactgctggagcacctgggtggcgaaagcggctcgctggaacgcctcggcgtggcgattgccccaggctacaccgtgtccaaactgctatggacccgcgagcagcaccccgacgtgttcgcacgcatcgcgcacattctgctgccccacgactacctcaatttctggctgaccggccgcgccgtggcggaatacggcgatgcgtcgggcactggctacttcaacgtgcgtaaccgtgaatgggacgtggcgctgttgcagcacatcgaccccagcggccgtctggaagccgcactgcccgagctgatcgaagcgaatcaagccgtgggcacgatcctgccggccatcgccgaacgcctgggcatcaaccccaacgcccgtgtctccagcggcggcggcgacaacatgatgggcgccatcggcaccggcaatatcgcccccggcgtgatcaccatgagcctgggttcctccggcactgtgtatgcgtttgccgagcaaccgaatgtgagcccgcaagcctcggtggcgaccttctgttcgtccagcggcggctggctgccgttgatctgcacgatgaacctgaccaacgccaccggggtcattcgcgaactcttcgacctcgacctggccacgttcaacgccttggtcgccgaggcgccggtgggtgccgacggtgtgagcatgctgccgttcctgaatggcgagcgtgtgcccgccctgccccacgccaccggcagtgtgcatggcctgaccatgaccaacctgacccgcgccaatctgtgccgcgcggtggtcgagggcaccacgttcggcctgcgttatggcctggacctgttgcgccagaccggcctgcaaagccaaaccatccgcctgatcggcggcggttcgaaaagcccggtgtggcggcagatggtcgccgatatcatgaacaccgaagtggtctgcaccgaacaaagcgaagctgccgccttgggcgcggcgattcaggcggcgtggagccagtccggcgaacccttggccagcctgtgcgacaaatgcgtcagcgtcgacccggccagccgcacgctgccggtggcggccagcgtcagtgcctatcaacaggtttacgcgcgctatcaacaactcgtggcaaccctttaagagcgaacgattatgtatctggtgtgtggcgaagcgttgtttgattttttcagcgaggaagatgccagcgggcaggcttccagggtcaattacaaggcaattgccggtggctcgccgttcaatgtggcggtgggcttgcgccgcctgggcatcgagtcggcgctgttcggcggggtgtccaacgacttcctcggccagcgcttgctgcaagtgctcaaggacgaaggcgtcagtgagcagttcctggtggaattcccggcgccgaccacgctggcgatggttgccgtgggcgccgatggctcaccgcaatacagctttcgtggcgaaggctgcgccgaccgccaactgcgggccgcgcatttgcccgcgctgggccatgatgttcgcgggctgcacgtgggctcgttttcgctggtggtgcagcccattggcgacaccctgctgagcctggtcaagcgcgaaagcggcaagcgcctgatcagcctcgaccccaacgtgcggctcaatccgcagccggatattcaactgtggcgtgaccgcgtcgccgagttggtcacccatgccgacctaatcaaagtcagcgatgaagacttgcacctgctctaccccgaccgctcgccggaaagcgtactgcaaggctggttgcagcaccgctgtcagctggtgttcctcacccgtggcggtgacggcgccacggtgttcagccgccagcacggcagttggtcgcaacctgccgtgaaggtggtgatggccgacacggtcggcgccggcgataccttccaggccgcgttgatcgcctggttgaccgagcagcagctggattcggtcgaaggcctgcaacagctcacccgtgagcagatcgacgccatgctcggcttcgccattcgcgctgcggccctgacctgcagcaagaccggccccgacctgccctttcggcaacagttgggctgaacacgcgttcatgaaggttttgtcagttagggcaaaattaatccaaggttaatcccgcaagtcgactgtgaaggtgaccgcacactacgcctcccgaggctcgtgcggccgccggcacatcgtgttgatgcgcccgcgaacgacttgcggagaaccctcatgaaactgcgtacattattcttcagcggcacattggccctcgccgcggtctcaggcctggcacacgccgacacgcaacagccagtcaccaagccagtgccgtaccaatatggcatgccgttaaatatcgataaggtcatcgccatgcacgagaccgacaccgatgtgtgcaaggtgatcaacgctgatatcaagtttgtcgacaaagccggcaaaatcgaggatgtgggttatcggaaaatgtccgaagcctgtgatttccagaattgaaccgttggattagcaacagaaccgtatgcaacagaaccataatgggcctggcgtttaccaggcccgcagttcttcggtgacgcaacctcacaggacgccttagtaaacgccgcgtgcgcttactcgttgcaacgcaggcgattggttgtgcttgaggtcttcgcgcaatcccgcgatcaggttgcaaatggcccgactgctgtcgagcttttcagcgtttatacctttaacttccaaatccactcggtcacggtcgcggtcgtcatacaccttgatcgtcaacgaatcgtcttcggctttggtgcattcgcaccgtttgggcaggaaacttccttcaatgatactgcgaagctctaattccgaaagcatggccaacctctccttttatgagactgccaacagattattgtgtgtcccgcaggcgtctgcctgccacgtctaaccgaccctggaagacgcttacattccccagcctactcggcaaaaacgaatctcgttgtaacctttcctcataagcagcttgggaagttatataacttttgcgatgacatgtttacgccgtttaaatcatcgtcgaacagctgagattaaacgtttaactcgggaccttgaattaaacgacgccctgtgcggcgactctttcagcaacatgtcgcaaactatcaaagttgatattggcgcccgaattaattgccaccaaggtttgatcacgcacgccgtgttgggcgacatacgtacgaatgcccgccaccgccagcgcccctgagggctcggtgatcgagcgcgtgtcgtcgtagatcaacttgatggcgctgcacagttcaccgttgctgacggtgatgacttcatcgacccagtcgcggcagatttcaaacccataagcgccgatctgcgccacggcggtgccatccgcgaacccatcgacactgggcagcaccacccgctcgcccgcgcgcagggcggccagcaggcagctggaaccttcgggttcgacaccgacgatacgtacatccggccgcaggtatttgacgtacgccgcgatcccggcgatcaaaccgcccccgcccaccggtacaaaaatcgcgtccaacgggccctgttgctgacgcaggatctccatcgccacagtgccttggccggcgatcacgtccgggtcatcaaagggcgacacaaaggtgcaacccgaggtttcggccaactgcaacgcgtgggccagggcaaatggaaagctctcgccgtgcaacaccgcctcggcgccccgcgagcgtacgcccagcaccttcaattcaggcgtgctgcacggcatgacgatccgcgccttaatccccagctcccgcgccgccagggccacgccctgcgcatggttgcccgccgaggccgtgaccacgccgcaggctttttgctctgccgtaagctgcaccagcttgttgtaggcgccgcgaatcttgaaagaaaacgtgggttgcaggtcttcgcgcttgaacagcacctggttgcccagcaacgccgacaacgccggcgcagcctgcaagggcgtacgcaccgccaggtcatagaccggggcggcgaggatctttttcacgtagtgctcaagcagccccggggcggcggtgtgggacgcggtgcaggtgctcatgggtgtctcctggctgtttcgcaaagggcgctggagacggaaaaacaaaacccgcctctagggcgggtttgggtacagcagccgtgcgctatcccgccatatgaggaatggcggtaataatgcttggctggctgcgaaaggcttgaaatgtcatgacacgaaactaaccggcgtttaccgggcaagtcaatggctcgccggccttttgtcggcaggggtttacgatgactatacgaaacatatacgcttcgtatatccattcaccacatgtgaacctcatgggcatcgtcaaaatcaccgaccaattgcacgaacagcttcgcctcgccagcgccgccatggaccgctccatcaacgcccaggccgagttctggatcaagatcggcctgctcgccgaactcaacccgcacctgccttacaacgagctgatcaacaagctgttgctggacaagcccgacctgatccgggggcgcagctgatgatcaagactgccgcacaattggccgtgatgcgtgaagccggacgcctgctggcgcaggtcttcacaatgctcgatggcttcgtcgccgccgggcgctccaccctggaactggacgccaccgtcgaagccttcatccgcaacgaactgaaagcccgcccggccagccttgggcaatacgactaccccttctgcatcaacacctcgataaacgaagtggtgtgccatggcatgcccagcgccaaggacgtgctcaaggacggcgacatcatcaacatcgacatcaccctggaaaaaggcggctttatcgccgactccagcaagatgtacatgatcggcaacgtggcgcccaaagcacagcgcctggtggaaaagaccttcgaagccatgtgggccggtatccgacaggtcaagccgggcgcgcacctgggggatatcggccatgcgatccagagccacgcgcaagccaatggctacagcgtcgtgcgtgagtattgcggccacggcattggccgccagatgcatgaagacccgcaaatcctgcacttcggccgccccggcaccgggctcgaactgcgtgaaggcatggtctttaccattgaaccgatgctcaaccagggcagcgccaaggtgcgcaacctcaaggatggctggacggtggtgaccaaggacaacagtttgtccgcgcagtgggagcacaccgtggcggtcaccgccgacgggtttgaggtgttgaccctgcaaccaaccgcctgaataccacctgactgtgggagctggcttgcctgcgatagcatcaacccggtggacctgacacaccgaggtgcctgcatcgcaggcaagccagctcccacagaaaagcagagcactgtgatgctagcggctggactcggttaaattgtgggagcgggcctgcccgctgcggcggggtagccggccccccatgggtagctggcccccccccctcctcagcaagaccccccccaccatttctggcgcacactcaccagccgatgtgcgtttgcccccgcctgt

SEQ ID NO: 64 - DNA, 61524 bp, Pseudomonas poae FL10F
tgatttttccgtacgggttgtagctgaattcccgcgtggcaccgcctggaagaacgacacgaaccaaccgacccacagcatcccactgatactgggtcagcgccccatgctcatcctcacgcgcaacctgtcgcccaacatcgtcatagcgataccgcttaaccccaccattcggcagttgctcttcaaggagctgcccacgctcattccagaccagccgatgacaaccgttatccggataccaaaccccaaccagttgcccatgtttgttgtaggtgtagtccgtaacattgccgtcaggatctgtctgacgcgtaacgtcgccttggtcattacgctcatacttccaaaccgcttcaccgcgccgcacaacccgtacgaacccgttgtcatgctcgtaggaagtcggctcatcctcccccggaaacaacgccaccaaacgcccagcgtcgtcgtactgatacgccgtcaccgcccccagcgggtcctgctcaaccgtcagtcggcccttgtcgtcgtaggatttgaagtgctcagcaccatcaggatcaacccgctgcaccagccgcgcgcgctggtcatggacatacacttcctgactgccatcagcgttgtgaaccgtaaccttgccgttgtcatcccagacataccgcgtgtccatctgcgaaaagctggcccagtgccgaacacaccgcgcggccttgccggaacgttcccacgcccaaaagaaactcgccccaccggccaattgccgctcaagaatgacgtgctgctcgtcgtatcgataagcctcgatttcgcctacggcattggtcgctgaaaccagtcgtccagcgtcgtcataggcgtaggaaacgacgctctgctcagtcacccagacgtagggctcacggcctttggcgcgatgaacctgatagtccaccgccacaatgcgcccaagctcatagcgcaaaaacaaagaccggcctacagcgttatccagccgctcaatccggcctaaacgatcacgaataacccgcaaccggttgtcatacgcgtcactgattgctgtcagctgaccatcgcaaaagtgataaaagcgcgatgcctgagccagcaccaactcatcgggcaaatcgcccaaatagatagcggcttcggccaagctgttggtaatcgcaggccgggaaacgctaggcaacggaaactcagtaatgcgattctcatgatccgtccaaaccaccgaatcaccgtccaccaccaaccgctgcgccagcgaatggctccagccaaaccccaacccacaatccacttccaccgcgctggtgcgatacaaccgcgtccactcaaacggcaaaattccgtccagcgcgccatcggtgagggtcagtaattcctcgccggtgaccatcgacaccgggcagccattggtggcggttttatccgcaggggccgtcgcatcgccctggggattcttcgcagacacgggcgcatcatccacacgctctttctgcttcagcaccgcgttctgccgtgcccgccagcgcatctgcatcgtgccttgcttcagcccaccgactacgccgcgaaccgccaccgccttgtagcgatccaccgcctgcatgaacttggtcagaatcccgagcaggccacgcacaaagccaatcgcggcatcaagaatccgtgcgccatacttcaccaaccgtaagctcaggtacgccacacccgccgctggcagcgcgatcatcaacaccgcgccaatcaccagatcgatcaacagcgacaccacaaaccccgccgccgtctcggccatttcgccgggtggcaacgcgtccagccacagcatcgtcgtgcgcaccatcaggtacagcgccgcctcgtcactggccagcaacatggctttttccatgacctgcggcgcatcggtggccaactgcgccaacttggcggcctcggtgccgagttgctcggcgtacttcaacggatcttcaagaattgcctgcaccagcttgatgctgtcccacacgtcccggatcgccgcccaactgcctgccagcacaccgctgccaatcgcgctggcggtggattgttgccaagacggtttgaagccgttccattgctcgcgcagccattgctccaggtctgccgtcagcccggcgtaggaggcaaacaacgcgtccacctgctgcgcggaaacgccgccctgtacccgcacctgatagcgcccgccggccacgcaggtatgtgagcctttgccatgttcatccagcatgaccaccgtagaactgccgtcctccaggcgaataacctcaaccgggatttcgccgatcggcacgtcgtacaccgactcgaacttgctctcgattttcagctcgccacccgccgggcagcgcgcaacggtggagaaatccgcatcggacatgctgaaggaaccttgcgaatcccccacccgcaacactcggtccatccccagcaatgacggcatatccgctgcatggctgaccgtatccagcgcccgcgcataccaggcgcccatctgctggcggtactccgccaggctctggtggaagccattgagctcatgttcgataaaggcaatgtgggcagcgttggtcatccgtgacgtctcggcaaaatggcaaggcgtcggagcatgccgcaggaaaaagcgcctggatgaacggctggaaaaatcagaaagggacgactttaagcgggtaaaaaccgctaagaactagcccgaaggcctacacaaaaaagcgacctggctcattgcataaaacctcagcaaataaaaaccactctcatccttgcccgattttccgacatggccgtcatggttaatagaacctctattacgcaggatttcccatgtcgcgccttgctcgtcccttgcatccactggccctgtcagtggcgtttgcctttgccgccgtgccattgctggccgtccagtcctcgttcgccgaagaaagcagcagcgcgtcgcgccgtttctcgattccggccggcgacctcagccaggccctcaacagcctggccgaacaggccggcctggtattggcattcgatgcaagtttgactcgcggcaagcgcagcaacggtttgaacgggcagtacgacaccgatgtggcgctgactcagttgctcgccggcagcggattgcaggcgctgaagatctccgccgaccgctaccgcctggaagccatcccggataacggcggcgccatggagttgcaggccaccactatcagcggcgcctaccacagcgaaagccccaccgggccagtcgccggttatgtggccacccgcagcctgtcgggcaccaagaccgacaccgcgctgatcgaaaccccgcagtcgatctccgtggtcaccaaagaccagatgcgcgcgcagaacgccgaaagcctcaaccagatcctgcgctacagcgccgccgtagtcccggaaacccgaggtgccacggcctcgcgtctcgaccagttgaccatccgcggtttcgccccggccacttacctcgatggcctgcgcatgccgtcgagtcgtgacgcgttgccacaaaaagacgcctttgacctggagcgcgtcgaagtgctgcgcggcccggcgtcggtgctgtacgggcagggcacgccgagcggcgtgatcaacatggtcaccaagcgcccgttggacacgccgtttcatgaagttggcgtcgagtacggcactttcaacaagaagcgcaccaccttcgacctcagcggcccgctggatgatcagggcgtgtatgcctaccgcgtggcggggttgttcgatgatgccgatggccaggtcgaacacaccgaaacccgtcgccagtcgctgtccagcgccttcacctggcgcccggacgaggacacctcgctgaccctgctcgggcatttccagaaggaccccaaaggcgcgtcctacggttctattcccgcttggggttcggtgttgcgcagccccaccgggcgcaagatcgacgtggatttctacgacggcgaaaagaacttcgagaagagcgaccgcgagtactactccctcggctacgccttcgaacatcacttcaacgatgtctggaccgtgcgccagaacgcgcgttacctgcgcgccgaaggcatctaccgcagcatttacaacagcaacctgcaggccgattaccgcacctccaaccgctcgaccatcgccaccgatgtcgacatggacgcctacaccctcgacaaccagctgcaggccaaattcgacaccgggccgctgcagcacacgctgttgatgggcctcgactaccagaacaccagcaccgacaccaaggccggttacggcaagggcccggacctggacatcttcgacccggtgtacggcgcgcctgtggtcacgccggcgttcgccaccgacgccacctcacgcagcgagcagaccggggcgtacctgcaagagcaaatgaagtgggataaatgggtgctgttgctcggtggtcgttatgactgggccagcaccgacagcaccaccaaaaccatcaagaccggcgccaagagcaactcctcgctggacagcaaggcgtttaccggccgtgtcggcctggtctacctgttcgataacggcctggcgccgtatgccagctacgcggagtcgttcaacccgcaatcgggcaccggttatggcggttcagtgttcaagccgaccgaaggcaagcagtatgaaatcggcatcaaataccagccgccgggcagcaacagctttatcaccgcagcgattttcgacctgcgccagagcaacgtgccgaccatggacccggacccaagccatctgtgtggcaatggccggtgcagcgtccaggacggcgagcaacagtcgcgtggctttgaactggaaggcaaggccagcctcaacgataacctcgacatcactgcggcctacgcctacctggataaccgcgcgagcaagtccaacagcaccgtgcagtacgcgccgctcactgataaaggcataggcccggcgattccggttgaaggcaccaccacctacggcgtaccacgccacacggcgtcggcgtgggccgactacaccttccacgacggccagctcaagggctttggcgtcggcgccggtgcgcgctatgtcggttcgtcctggggcgataccgccaacaccctgaaagtgccgggctacaccttggtcgatgcggcggtgcgttacgacatcccgaacatcgccaaccccaaggacaacctgcgcctggcgctgaacgcgactaacctggcgaacaaggaatacgtggcgtcctgctactcctattcgtggtgctggtatggctcgcagcgcacggtgcaggcgagtgcgacttaccagtggtaactcggcaaggacgctgtgtgtggcgagcaagctcgttcgccacaggtgtgttcgcttaagcacataaggcaatttaatggcccctttgtaacaaaatcctcgccagaatcacttttattttcaggtggttaggtgaggaagcaaatgcgcagtgttggaatcatgctgatcgcctgctcattggcgggtggcgcggctgccgtgcaggcacgggaactgcgtgagggtgacaagtacatgtgcagttggggcgccggcacggcggccagggctcaggaactcaagctgtcgggcgtgtcgctgtacgccgcgcggcaaaagatccataccatcaagttcaacaaatcgtggatgcgcatgatggccatgggcatcaccgaacagacttacgacagtcgctcacggctcaagcccgaggcgattcgccagagcttttaccaggattgcctgcgctacaaagtggcgcgtaagtaaacgcgggggaggctcagcgtgagtgcgcccccacgcaaacaccgacctgtgcaaaatctgcgtaagcctgtccaactttgccgtgtcgccgctggccatactggcgccaggcaaaccaagaggcacaggccatgaccgactacgtattcacccctgaacaaattccgtccctggccatccagggcagcgcgtcgcgtttcccgttgcgccgcgtgttctgcgtgggccgcaactacagcgaacatgcccgcgaaatggggcatgacccggaccgcgagccgccgttctttttcatgaagcccgcggatgcggtggtgccggccgagggcgtgatcgcctacccgccgctgaccgccgacctgcaccatgaagtggaattggttgtcgccatcggcaagggcggcgtggacatcaaccctgaagacgcgctttcccacgtctggggttacggcgtgggcatcgacttgactcgccgcgacctgcaagccgaggcgaaaaagctcgcgcgcccgtgggaatggggcaaggcctttgatcagtcggcacccagcaccgcgttgcagcccgtgagtgcggtagggcacccctccaacggcaaaatctggctgaaggtcaacggcgagcagcgccaggtcggtgacttggccgacctgatctggtccgtcagcgaaatcatcagctacgcctcaaaatccgtcgcgctcaaggctggcgacctgatctttaccggcaccccggcaggcgtcggtgcggtgcagccgggggatgtgctcaccgcaggcgtcgacggcgttggcgagctgagcttcaccctgagcaaaggttgaggctaaagtggtgcccaggccaatcgagagactgttatgccaggcacccgcgtcaccacctatggcatggaacaacgcagcgaccgccccgacttctatatccgcgataaacgcgggcgggcggcgctgaccagcccacatcggcatgagtacttccagatccagatcaacctgggcggcgacaccgtgcagcatatcggcggcgcggtgcggccgtttccgcacaaggccctggcgtttatcctgccccatcgcctgcacgtgattccccatcctgaagacggcgagttcatgctgatcaacttcagccaggcgtttttcctgccgcaactgacctgcgacccgctggacctggaagacattcccatcggccaggccccggaactgtcgccgtttcgctttcaggagcagctggatttcattctcgatgatgtggctttcgacgaagtgaaaacctggctgacgcacatgcgtaccctggacgcccagcgcaccttcggcgcccgtgagcggttaaaaggctatctcttccaactgatcggcctggtctgcgagcagtacgccgaacccttgcaggcgtttgccgccaacaatgccacccgacgcgggcgcaaagacgcgttagcgcgggtgcaaggctacattcgcgagcatgtgcacgagccgaccctcaacctgaccgacgccgctgccgccgcctttctgtcacccaactacctcacccacctgctgcgcaaggaaaccggcaaaccgttttcccagttggtgttggaccgccgtatgcaattggcgcgcaccttattgctcaacagtgcgcagatgatcggagtgatcgcccagcgttgcgggtttaccgacgaggcgtacttttcgcgctgcttccgcaaggcccatggtgtggcgccggggcagtttcgtcgccagcaacaggccagcgcggtgtagtcaaggtgggcagatttgtctgggagctgcaggcccggctgtttacaaatccacgacaaaccttatgtttctatatgcatacaattgcatccttcaacaggaggctcgtatgcaaacgcttattcgcctggcgacgccgggcgatatcgacacgctcttcgccattcgcacctcggtggtgcagaaccacctgagccgcgaacagatgagcgacctggggattaccccgcaggtattggcggacagcattcgccaagcgccctgtgtgtggctcgccgaagtggagggccagcccgtggccttttccatggtcgacctgagcaccggcgaggtgtttgcgatgttcgtgttgcccgcctacgagggtctcggcctgggtcgccgcttgatggcggtggctgaagcggcgttgtttgaacggcatgaaaccctgttcctgatcaccgacgggcgcgacgaaatccgcgccaacggcttttatcaacggttgggttggtcaaaggtcgccccggttgagggcgatgacgttcggtaccagaagagcagggcgccttaatgccatgaacccaccagaagccccttcgtcctccagctttcgctacttagcgattgggattctgtgcgtcgccgtgctgctcggcggctatttcgtacggctcaatgcccaggtcgaccgggcgcgggtcgaggcggccgaacgtttggcgctttgcaggcaagtggaacgcgtggccagtgccgcgtcgtcaaacagcgttgaacttcgtgatacctgccgacaattaaacggacagtccaccgacagtgcggcgccgctttaattaataaccatttttaatataaggagatataagcgttacttgcaccaaaaagtggcacttataacctcggccaccctaaaaaaggtgtggttattgaatgacttacgacgcttttaatccgacgaaaggattaaattaatcttgttacagctttttacaatcggtactatagccgggcgttcacctcccacggtttatgcatttttaaatcccaagtttccatcagctacttgggattttttttgcccggaatttgacctcagcgtcaaacttcaatctcggcaaactctgcgcgcatgcgtccattgcgtttggcctggtacagcaacttatcaaccgactcgacgaacccgagcatgtcgctggttggcgtcacgatctgcgtgccgacgccgaggctcagggtcagcagcttcgacaccgctgaaaagccatgttcgatctgctgctggcagaccaggtgcaagcagcgccgcgccacctgccgtgccgacgcggcgtcagtctccggcagcaaccacacaaactcttcgccgccgatgcgtgcaataaagtcccgtggccggttggccgcctgcgacaaggtgcgcgccacctggcgcaaggcttcgtcacccttgatatggccgtagtggtcgttgtactgcttgaaaaaatcgatatcgaggatgagcaacgacagcggcaactggctgcgttgggcgctggcccattcacgctccagcacggtgtcgaacatgcgacggttggcgatgcccgtgaggccgtcctggaaggaatattcctccagttgtttctgcaggcggatcaggtgttcttcggttttcttgcgctcgctgatatcaaacataaagccgatcaacgcttcgacctcgtcgcccttgcgcaccacatgcaccacgtcgcggatccacacatagtcgccgttgaccgtcagcgcgcggtaatcggcctcgtgatcgacgccggcgcgcgattgcgacacacagaaattcaccacgtattcgcggtcgtccgggtgcatgcgctcgacccagtcgtccacgctcacccagctttgcggggtccagcccagcaacgcctcgatctgcgggccgatatagctgaacgtcatggtctgccaatcgatgcgccaaggaatggctttggtcgattccagcagcgttttgtacacgtcactgtcgggctggctcggaggaatgaggcgcatggcgggctgctcgggatgatggcaaagagccaagagcgtcttttgaacggcgctctgagtcaagccttcaccacagcagcagacgagaggtcgtatgctgggtttctggcgtcagcgccccagcgtttacgcggcaaaatgcggcacaggtatcacttttgaatgaattgttcagtggccggcaaaagcttatctaagctggatgcatcacacctgcagggtcgaacccagggacgggggcttgtcatgatgtcgatcaccgaactcaaccgcatcatggccgcaggcttcctgccgctttcgtgtgattgcagccttaacagcgacggttcgttgcgcatcagcatatttgagccggcgtccgggcgtgtcgacttgctgttgacgcgggtgtcgccccaaggcctggacagcgtccgttccgtcgcaaaccttattggcgaactgcgcaccgagctcaaagccgggcggcggggctttgcggccgtcagttaactgttgacggtgctgctgggcgtggtgacggcgccgtagtagcgccagcagcaatgccggtgttccggcaggatcacacagccgctgaggctggcgatcagcagggcggcgacaagcagagtcaggcgacgagacatggttatttcctcatggtgtgcattgcgttacaccttgaacgccgccacctgcacaaatccgtcggcatgctttcaaacatttcatcaagcgccgccatcccctgagtaatactcgccttaaccgccgtcgagaaaaatgtcgtatttctcgcgacggatttttcccaccccagcgttcaacccatcagcagcgaacattttcgtccgccgtatgaaggagttgccatgaatccactggccaaattgcgctacgccttgctgatcccgatggccttcgccgcgcttgtcagcaccccgaccttcgcccagaccgaagtgatcattcgccaggcgccgccggcggaacgtgtcgaagtaatccccgccgaacgcccaggctttgcctgggaccgtggccactggcagtgggagcgcggcgcgtatgcctgggtgccgggccactggcagccggtgcagcgtaatgcccgctgggaacctgggcactgggaatcccgtggccccaactggtactggcgtgaaggccactgggtccgctgaaacctgaaacttagccagtgcattgagaactacccgattgaaagacactgatccggacgttgagctactggcacgtatcagcaacaacgagcccgccgccgtcaacgaaatggtgacgcgcaagctaccgcgtttgctcgcgctcgccagtcggctcctcggggatgccgacgaggccaaggacgtggcccaggaaagtttcctgcgcatctggcgccaggcagccaactggcggcctggcgaagcgcgtttcgacacctggctgcaccgcgtggcactcaacctgtgccacgaccggttgcgccggcgcaaggagcgcccgttgaacgaggacgaggtgctggaactggccgacaacgcgccggcccttgatgaacagttggaaacggccgaccgcagtgcaaggatggccgccgcgttggcgaccttgcccgagcgccagcgcgaagccattgtgttgcagtactaccaggagctgtcgaacatcgacgccgcggccctgatgaacatcagcgtcgaggcactggagagcctgctgtcgcgggcccgacgccagttgcgcagtcaacttgccgacacacccgggctcgcccgcccaggaaggggaaaaccatgacacctgaacgatttgcgcacctggctgacgcctacggggccagcctgcatcgctggcccatcgccgagcgggcacccgcccaggcgctgctcgacagtggtaacgccagcgcacatgcggcgttgcgcgaggtcagttggctggatgcgcagctggacagccaccaactggcactcaccgacccggcgctggcgcggcagattcgcgacgctgcaccgcgccgtgagtcgttctggtcgcgctacgccaactggctgtcaccggccggtctggtcggcgcgggcctcgccggcatcgccgccggggtgctggtggcgtcgctgagcgtgccgctgccgatgctgtcatccgacgtgctgcccagcgtcttcgatcagggcgatgccgacgtcgtcttcaccgtcaacgccgaggaaactgagcaatgaccgcaaaatcccttaaaccgtggttgctcgtctcggtgttgctcaacgtgtttttgatcggcggcgtgggcggtggtctctaccactttatggcggcggccaaacctgccgaagcggtggtcaaccagcacggcttgcgccaggcgatgatcaagttgccggctgagcgccgcaaggaattgcgccagttattgcgccagaaccgtgccgacagccagccgctgatcatggccggtcgcgaagcgcgcctgggcgtgatcaaacagctcgaagcgccgaccctggaccgcgcagtgctggtgacggaactggccaaggcgcgcgaggccgacgtggcactgcgggcgttggtggataccaccctggcgcagtttgcgagcaatttgccccaggatgaacggcagaaactggtcgaggcgttgtaccagcgtgggcaggccaaaagccgcgagaaacttccccaggtcgcagggaataaaccgcgctcttgagctgttatgcactcacgatcaccctcgagagttgcatatgccaactgctaaaaagaaacaggcttttgatttttcctgtggtgctgcgtccttgctgtgcgccgcggtggagttggacgccaccttacccggtggcatgaatgcggcggacgcgctgcgcaccaatatgtgtgaggttgagctctacaaactcacctccggcgcgctgaccggtggggtggtcaagccgtttgacccgaccaaggccggttactcctacccgcacagtgtggcgttggcggcgcggtcgctggggttgaatgtgaccatctacatggaagggtttttggccacggcgttggcgacgttgtatcccacctgtgaagagctgtgtgtgaaggcgggcttcccggtgatccacggcgcgccaccactgatgcccgccaatcgccgggcattgtgtgtggtgacgacgtttgtggtggggttgcattacgtgatgttgcgtccgggtgggggtttcatggacccggcggacggggataatcatgataatttcaagaccatgaacacatggtcgaaggtctattcgcagacggggattacgctggtgctggagaaggaagtgggggtttagctttcgagttgatgtagatccactgtggtcaaaatcaaaaccaaagcactgagtggttagagcaaaagcgctttgttgcggtgcggcggcgggttgcgatatccctgatacatcgagatccaaatgtgggagcgggcttgcccgcgaaagcggtgtatcagccaccggatacattggctgatccactgcgctttgtggcgagcgggctcgccccgcgttgggctgcgaagcagccctgaaaccagccgcctcggtcttcctgaaaaatcgaggtgaccttattggggccgctacgcagcccaacgcaggacaagcctgctcgccactgcgaagtcccctccaatcgatcaccggcctcctgcgccgtggccgccgcacatcgcaacaaactgctggtatgcaccaacgcactttcaaagctggtttcagcatcaacagcgaacagcatcggttctacaaaatggggcgatggagcaggggagagatagtgatccagcgcacgcttatacgcggcgtatttttgtgcttggtcgatgtctttgaactgtggatccgcgtgacctgtgttcgttatggaatgacctctagtcattgaaaaacgccccaaacaggcagttgcgactagtctttgacgggctgctaatcccggtcactgaatgggcagtgaccggcgaagattagtcatgcaatcaggacgaaacaacccacaggatcacgctcggaaacgtcctgcgagaaaaaaggaagcgcaggtcgttattcactactccccccaaatatccccacaacctccactggcggttcagtcatccgtaccgccgagtgttcgcgtaaatatgcgccacccaccgcggcatcaccgcgatcagatctgagcgctcgataatcgccaacatgctcatgtagtgcgacccacattagcggtgtgttgtgcccattagcactgcctgctcgccccccgcactgttgacgttaaccgtacgcgcaacgctcacagtattcccctcaaacacgcacaccacccgatcacgaaacgccgtctgcgggtagatccaggtcatctccagagccttggcatccagccagcgggcgccggcgacgatctgtgcgtccttgaattcatagccgtggtgcaacgcccggccgggcatgctggtagtgcctgcgcgccaatggtcgatgcctaccgccaagcgatgcgtcgcctcggcgtcggtgagttcgaaggtcagcacgtcgtctctgaagtcaaacgtcaacccgcgcacccccaagctgttttccgccattgcaaacacccgtttcgaattggccggcgcggcacaggccgacaccagcggcggccgctcagccatgcttgccaatcgcgcctccagccgcgcatctgccccaggcgcggcactggcgccaaacgcggccgggaaataccgctcgatatacggaatgatctccgccgagttcttcatcccgcccaccagtaccagtgtggcgccgtgttcgcggtacaccgcggccatctgcacaaagacgcccagcgcactgaaggcgccgctcggtttcatcatccagtggtagccatagcggctgttcggcccgccttggggttgggtcgcggccttgacccaggcggcaggcagtatttgctgagcgttccatacaccgccttgagcgtgcaacaccgcgagtttcaataccgccgacactggcgcgcgcaggccgttgccgccggggttcacgccgtccgggccgatatcccaggcgtggttgtgaatttccagcggcgcaaacaggcgtggcgtgaggtagtcgtgcagggtttgcccggtgacgcggttgatcagtgccgagagcatgtagctcgccgcgctggtgtagacgtattcggtgccgggcgcgcaggccagagggatcttgaaaaattcagcgatccagctggtggcgatgccacgccagaccgagccggaggtgttgctggcgtggccggtgcgcatggtcagcaggtgttcgacggtcatgtcggccaggcgcgggtcggcgtcggcggggacttcgtcggggaaaaagctcaccagccgatcctcgagcttcaacaacccggcgtcgatggccaggccgatggcgcagccggtgaaactcttggccatcgagtgcagcacgcgcggctcgttagggtcgaccggccaggtccagccttcggcaaccacgtagccgtggcggtgcagcatgaagccgtgcaggtcgaggccggcggccctgaccgcatccagaaacgcgatcacctgatcggggtcaacgccaacgctgctggcgctggcacggggcaaaccatcgtaggaagtcgggggcatgaaaaggctcttgaacagtgaagatcaacggctgcgatgcaccagccgggaataggaaatcagcatactggtgagttcctggctgacgccggtcagcggcgaggaacgccggctgatcaggcacacatcacgcgccgccaggggctcttcgatggcaatggtggtcagggcgctggaaaacagcttcatccccggcagcatgcgcggttcgatggtcaggtagtcggtttcggagacgatgtgcagggtttccagcagcgaatcggtggtgatcgcgatcttcggtggcgccaggccctgggtgcggaacaactccaccaggcggttctcggcgccgccgaccacgccggacgggcgcacgctgatccattggcagtccaccaacgcctgcacggttttggcctgggccaacgggtggcccttgcgcgcaatgatgccggcgttggagctgtagaggcggtcgatggccaagtcgatgtcggtgacattcggcgccaacgggcacagcacgaaatccaggcggccgtcgcgtactttctcgaccaggcctttggtggtgccgctggccacatgcacctggatgcgcgggaagcgctgggtgaagttgctcagcaccggcagcagcagttcggccagcggttcggaggtgacacccagggcaatatggccttcgggttcgcctttccagggttgcaggtcgagcagggcgcgttcgcagtcgagggtgatggagcgcgcgcgcaccaggaacacctcgccggccggcgtgaggttgatgccttggttcgagcgttgcaacagcaccacgccgagttctttttccagggtctggatcgattgggtcagggtgctctgcgccacatccaactggcgcgccgccgagcggaaactgcctttttcaaccacggcacagaacgcacgaagatgggtgagagtcatgaaggcttgcctcgggtgtggcgcatttaaaccgtcgaatgcccgccagcttatctgatgactataggtgcgcacagatcggtttgagcgatcaggttcattatttttgatcacctgaaaacggcgcgaacccctggtttttcggtaggctcagggcaaggcgacactgtcttttcggctgatcggaaaatccgagcctgatcacctggagcgttcttctcaagcgtgtaacgtgaagaataagatcggtccaggaacatgcgccgaccgtgagcggcgactaaaaacaacaacaacaactattcaggtgttcggccgtgcctcgttttgggtcctgccagcgtccgaacccatgcgtaaggatcacttaaggtgcatttattgatgaacaagacgttaatcctggcaggcgctttgtctgcggcgctgatgggcactgcccacgctgaaagtgtcttgaaagtggcgcttaacgccgatatccgcagcaccgacccgggcgtgaaccgcgacaccaactctgacgcggtgatcatgcacatcaccgaaggcctggtggggtttcgcgaggacgcgaccgttggcccgctgctggccaaagacgtgcaggtgtccgacgacggcctgcgctacaccttccacctgcgtgacggggtgaagttccagaacggcacgccgctgacctccgccgaggtgctgtggacctggaaacgcttcctcgaccccaagacccaatggcgctgcgcacctgagttcgacgggcatggcggcgccaaaatcgttgacatgagcgcgcccgacccactcaccgtggtgttcaccctcgaccagcccaacggcctgttcctcaccagcacggcgctgccggagtgcggcggcagcggcatcctgtcgccggattcggtcgctgcagatggcagctggaaggcgccgatcggcaccggcccgttcaagttgggcgagtggaagcccggtcaatacgtcgaactgctgcgcaacgccaactacagcccccgcgacgaaaaagaacccgacggctacaccggcaacaaaaccaccacgctggaccgcgtgcgcctgttggtgatccccgacccggcggcggccaaggcggcgttgctgtcgaaaaacgtcgacctgctgattgatgtcaccccaatggatgccaccgagctggcggccaaccccggcgtacgtgtgacctccagcggcactatgtcggttaacgccttgctgttccagacccgcgacccgttgcttaaagatgtgcgcttgcgccaggccattgcccacgcgctggactcggcgcaaatcgtcgaagccctgacgggcggccgctccaaggctaacaactcgatggttgcgcggggcagccattaccacaccgccgtcgaagaccagggctacaccttcgatccggccaaaaccgcgcaactgctgcgcgaagctggctacaaaggtgagccgatcaagctcatcgtcaacaaacgctacgcggcgatcttcgacatgggcgtgttcgtgcaagccatggccaaggccagcggcatcaacctggagctggaaaccctggagtggggcacccagctggaacgctaccagagcggcaactatcagatgatggcgttcccgtattccgagcgcctcgacccggccctgagttttgactcgatgaccggcgacaaggacaaggaagcgcgcaaggtctgggataaccccgaggcgcgccagtggttgcgtgaagcccagcgcgaaggtgacatcggcaaacgccaggcgctgttcgaccaactgcaccagcagatgctcaaggacgtgccgctgatcccgatgtacaacggcaacgcgattgccgccagccgtgattacgtcaagggcctgcgcacctggccggtgtccaagccgcgcctgtggacggtcagcgtgcctgcttcggggagcaactgaggatgtttcggtttatctctcaacgcctggcgatgtcgattccgaccttgctgctgatctcgctgatggtgttcgcgatcatccgtttggtgccgggtgacccggcgctgttgatgctgggcgacatggccgatgcgcatagcctggaagtcgcgcgggcgtctttgggcctggaccagccgttgccggtgcagtttgtgatctggctcaaagccgtgttcagcggcgaccttgggcattcgatcaccaccaatgaagcggtgctgccgctgattctggaccgcttccaggtgagtgccggcatcgtgttggtgtcggttttgctcgcggccttaatcgcggtgccggcgggcttgctggcggcgtggaagcaagacagtgcgctggactttggtgtggtctccacggcgacgctgttgctgtcgatccccagtttctggctcggcttgctgttgctgtacgcctttggcatcaagctcggctggttgccggtggtgggttatgtgtcgttcggccaatcgccgtggcaggtcttgagttttatcgtgctgccgattgtgaccttgaccctggtcgagctgggcgcaatcacccgcatggcgcgcgccagtgcgattgaagtgctgcgccttgaatacatcacccatgcgcgggccaaaggtttgtcggagcgcgcggtgctgtggcgccacgcgctgcgcaattcgtttgcgccgaccttgaccctgatcggcctgatcctcggcaacctgctcagcggcatcgccgtgctggaaaccgtgttcaccctgccgggcatcggccggctgatggtcgacgccatctatgcccgggactacccggtgctgcaaggctgcctgctgctggtgacctttgtttatgtgctggtcaacctgctggtggacctgctgtacccgctcttcgatcccagggttaagttatgaataagccacttcctgctgcacccgaggtgctgctgaccgcaccggcgcgtgccccgagggcctggcgtgtgccgtcgttgaatgcgctgatcggcgcgagtttgctggccttgctgctgatcatggccgcgctcggcctggtgtggacgccccacgacccgctggcgctgaacctgctggcgcggttgcaggcacccaccgccgcgcactggctgggcaccgatgagtacggtcgcgatgtgctcagccgcttgatgatcggcgcgcacaccagcctgtgggtgagtgtgttgacggtgactatggccatcgtcgccggcacgttcctgggcttgctcgccgggttcctgcgcggctgggtcgaccgtggcctgatgatgatcaacgacgcgctgctggcgttccccggcatcctcctggcgctgggcctgatggcgatcatcggcccgagcctgtacggcatcgtcttcgccctgagcctggcctacacgccgtcggtggtgcgcgtggtgcgcggcacggtgttgtcgctgcgtgagaaggagtttgtcgaagcctcgcgggtgatcggcaactccgagctgtacaccatgctgcgccatatcgcaccgaactgcgtggcgccggtgtgtgtgctggcgaccagcatgttcggctgggcgatccttgccgaaagtgccctgagcttcttgggcctcggcgtaccgccgcccgctgcgacctggggcaacatgctcgcggccagccggccgtatatcgccacagccagttggctggggctgtttcccggggtctgcatcgccatggcgttgctggcgttcaacctgtgtggcgacgcgttgcgtgaccgccttgatccacggatgagtaaataaccatgaccgacgtattgctggcagtcgatcacctgaaaatccgcgtcggcgcccacggcccgttggcggtcaacgacttgagcttcaccatcgcgccgggcgaaatcgtcgcgctggtcggcgagtccggcagcggcaagaccatggccgcccgcgccgccatcggcctgttgccgccgccgctggagcactgcggcggccaggtgcggttccagggccacgatctccacagcctcaggccggaacaactgcggcagttgcgcggggccaagatcggcatggtgttccaggagccgatggtctcgctcaacccgtccatgagcatcggcgagcaaatggccgaaggcctgcgcctgcacacccgactcaccgaggcgcagattcgcgaacgcagcctggagatgcttggccatatcggcatcaaggacgccgagcgctgcctggcggcattcccccacgagttctcgggcggcatgcgccaacgcatcatgcttgcctcggtcatgctgctgcgcccggcgctgctgattgccgacgaaccgaccaccgcgctggattgcctggcgcaactggacgtgctgaagctgatgctcgacctgacccgcgagcagggcacggcgattctgtttatcagccatgacctgtcgctggtagcccgctacgccgacaaagtggtggtgatgcgcgaaggccgcgcggtggagcagggcagcatcgagcaaatcctcttgtcacccaaggccgagtacacccggcaactgttggaggcgttgccgcgacgtggcgtgctggcgccgttgcccaaggccaatggcccgctgctgaaggtcaaggacgtgtgcatcgaacaccccggcccgcgcagcttgtggggccgcagccagttcaaacgcgtggtgcactcggccaacctgaccatcgcaccgggcgaaaccctggcgctggtcggcggcagtggctcgggcaaaaccaccctgggccgggcgattgtcggcctgaataaagcctgcgccggtgccatcgagtttgaaggcgtggacattctcaaggctggcaaccgcgagcatcgcctgcaatgccagatgattttccaggacccgtattcgtccctcgacccgcgtatgaaaatcggcgacatcctcgccgaacccctgcgccacgtgcccggtatgagcgccgagcagaagcgtgagcgggtggcaaaaaccctgctggatattggcctggccgagcagtttgtcgagcgcttcccgcaccagctctccggtggccagcgccaacgcgtggcgattggtcgcgcgctggtgcgtcacccacggttggtgattgccgacgagccgatctcggcgttggacatgactatccagaagcagattctcgaactgttcgaacgcctgcaggcgcagtacggctttgcctgcctgttcatctcccacgacctggcggcggtggagcgcatcgcgcaccgggttgcggtgatgagcgagggcagggtggtggaaatgggcacgcgcgatgcgattttcgaccgcccgcaacacccttacacccgcaagctgctggccgctgccagccccttggaaaaactcgaaaacggtggctaccgcatccgccaaggccccgttccgctagcgctgtaaccagagttgtaaagcagagctgactttacccaccgcgcaaatcgctgatttgcgcgaacggcgaagccatgcccgaagaacaataaaaacacccccaaaccgactgccaggagcttaaaaaaatgaaaaaatccctgactcaactcatcacaggcgtaggcgtcgtgagcagcgggatgatcccgttcgccgcccaggccgacttcctcaaggacagcagcggtacgctggaattgaagaactactacttcaaccgtgactaccgtgagagcgcatcgcagtcgatgcgcgccgagtgggcccaaggttttatcctcgggatcaaatccgggtttaccgaaggcaccgttggcttcggcctggatctgaccggcatgctcggcgtcaagctcgattccagccccggcctgtccggcaccggattgctgctgcgtgacagtgataaaaatgtacaggatgactattcaaaactcggcgtgaccgccaaggcgcgtttcgcccagagcgaactgcgcgtgggctacctggtgccggacctgccgaccctgcaacccaacaccagccgcctgttcccgcagtcgttcagcggcacgcaactggtgtccaacgacatcagcaacctcaagctgaccctcgggcagatcgaccaggccaaggaccgcgattccaccaactacgaagacatgaagctgaccacggtcagcaaggtctacaaaagcacggccctgagcgacaagtttcgcttcgccggcggtgactactcgctgacgccgaacaccttgctcagctaccactatgccgcgctggacagcatctaccagcagcaattcgtgggcttcaaaaacaacttcggcctgggcggcggcacgctgaaaaccgacctgcgctacttcaactccgacaaggacggcgcgggcctggccggcaaagtcgacaacggtgcgttgagtacacgcttcacctaccagtacggcggccacagcatcggcggtggttaccagcgtcagtacggcaccacgccgtttacttacctggatggctccatcagctacttgttcaccgagtaccagttcagcaacttcacccagacccgcgagcgcgcctggcacgcccgctatgactacaacttcgccgacctggggctgccggggctgttgttcggcatcaagtacgccaagggtgactcggccgaagtgctcggtttcaaccgcgaaggccgtgagtgggaacgtgacctggacctggggtatgtggtgcagagcggcaccttcaaaggtgtgtcgatgcgctggcgcaacgccctgagtaagggcaactacttcaatgatgtgaacgagaaccgcgtgatgctcgggtacaccctggcgctctggtaacggctcaaaatgtgggggcgggcttgcccgcgatggcgttgtcagggccgacacgcttgttgcctgggacaccgctatcgcaggcaagccagctcccacagtgatcggattatcagatcaagatagctgtggccgcccttaccggcgatcacccggtctcgttagtattttctcaagatccatcactcgaatatcgagacttccggtttatgaaacttaatcaacaccccttgctgcaagcgacacagggcacccacaggtacgtgcagagtgagcactacggtgcagtgggtgccggtcgaaaaatttatattcaggcggcgctgcatgccgatgaaaccccggcgatgctggtggcggtacagttgcgtcggcacctggtggcgctggaaagcgccggccgcctgaatgcgcaaatcgtgctggtggcggtggccaacccggcgggtttgggtcaatacatcatgggcgcaccgagcgggcgttttgaactgggcagcgggcgcaattacaaccgtggtttcccggtgccgtatcaggccatcgccgacaaggttgagctcctgctggggcaggacatcaacgccaaccgtgagctgattcgcacggcgtggggcgagtgcctgcgggccgcgcagccgatggatgaataccagtcgctgcaacaaaccctgatgctgctggcccatgacgccgacgtggtgctcgacctgcattgctcccgcgaggccgccatgcacctctacaccggcgaggcggtgtggccgaccattgaaccgctggcgcgttacatcggcgccgaagccaccttgctcgccaccgactcccaagccaattcgtttgatgaagcgttgtacttgctctgggtgaacctgcgcgaacgcctcggcgcgcgcttcccgattccagacagcagcatcgccgtgacggtcgagcatcgcgggcagcgggatgtgtcctatgagctggcggatcacgacgctaacgcgatcatcgattacctgacccatttgggcgccatcgaaggcacgccgcgcccattgccggcgctgcgcaacccggccacgccactggcgggcagcgagcagttttacgcgccgagtgcgggcgtgcttgtacaccgtgccgttgtcggcagccggattgaagcggggcaggcgttgttcgatatcgtcgacccacacagcggcaagaccgtgacgattaccagccataacaccggcgtgttgtacatgcgccgcgatgtgcggtttgtgaaaccgggtgatccgctggggcgtgtttccggggcgacgccgattcgcagtggcaaactgctcagcgcctgatttggaatgcattcaaacctgctcccacaggtgatcttcattgttggttaaatcttcttttggcaggacactttcatgcaccccaacccggcaatcaccctcgaacaccaattctgcgcccacaactattcgccgctgccggtggtcatcgtcaagggcgagggcgtctgggccattggcgatgatggcaagcgctacctggacatgatgtcggcgtattccgcggtcagccacggccatgtccacccacgtatccgcgctgccgccgtggcgcagatcgacaaggtcagcgtggtctcccgcgcgttctacagcgaacctttgggcaactttctcaaggccctgtgccgtctcagcggtttcgattcggcgctgccgatgaacagcggcgccgaagccgtggaaaccgcgatcaaggccgcgcgccgctggggctatcgcgtcaaaggcattgcgccgaatcaggccagcatcgtggtcgctgacaacaacttccacggccgcacctcgaccatcgtcggcttctcttccgagccggattacaaggcggatttcggcccgttctgcccaggcttcagcgaggcgcgcttcggcgatatcgagagtttccgccaagccattaccgccgacacctgcgccgtgctgatcgagccgatccagggcgaagccggtattcgcgtgcccccggccgggttcctgcgtgagctgcgtcagctgtgcgacgagaccaataccttgttgatcctcgatgaaatccagtcgggcctcggccgcaccggcaagtggtttgccttccagcacgagggcattcgcccggacgcgctgattctcggcaaagccctgggcggtgggattatgccggtgtcggcctttgtcgccgatcacacggtcatggacctgttcgacgccggcagccacggctcgacctttggcggcaacccgttggccgccgctgtcggcctggaagccctgaaggtgctggaggaggagggcctgatcgacaacagcgcgcagcttggccagtacctggtagagcgcctgactgcgatgaacgcgtcggccattcgcgagattcgcgggcgtggcttgtgggtgggcgtggaactggaccgcgatgcgcggccgatctgcgaagcactgcttgccgagggcctgctgactaaggaaactcacgaaaatgtgctgcggatcgcaccgccgctgtccatcacccgtgaggaactggactggggcctggcgcgtatcgagcgggtgttcgcgcagctatgagcgactacctcaaccacttgaccatcgacgggcaacgctacgcctatgtcgacctgcacaagctgctgacgccggtgcaattgcatcggctgccgtactcactgcgcatcctgctggaaaacatcgcccgttgcgccccggcgtcattgccgcaggtgctggcgcgggcgactggcacggggccggactgcgaggtgccgttccagcccaaccgcctgatgttccacgacaccacgtgcctgccggcgctggcggactttgccggcatgcgcgacgtggtggcggaactcggcggcgacccgacggcggtgaacccgtcgattccggccgtactgaccatcgaccattctgtgatcgtcgagcattacgccgaagccggtgcggtggaagccaacctcgacatcgactttcgccgcaacagtgagcgctaccgctttatcaagtgggcccaggccagcctggacaatttcaaggtgatcccgccgggtacggggatcatccaccagatgaacatggagtcgattgcgcaagtggtgtgggaaagcccggccgccgatggcggcgtgctgctgcaccccgattgcatggtcgccactgacagccacacgccgatgatcaatgccatcggcgtgcttggctggggtgtcggcgggctcgaagggcaggcggcgatgctcggtgagccggtgccgattcccttcccgcaggtggtagggattcgtctcagcaataccttgcgtgcaggcgttaccgccaccgacctggcactgaccgtgaccgagctgctgcgccggcgcagcatggtcggcaagtttgtcgagttcagcgggccggggctggcctcgctgagctgggcggcgcggggcacggtggcgaacatggcgccggaatacggcgccaccgtggtgtttttcccgtttgatgacgagaccctgtcttacctggagttgagcgcgcggcccgtgccattgttggccaaggtggcgacctacatggcggcgcaatcgctgtggcgccaggccggcgagccggagccgcagttcgatgagctgatcgagctggacctggccacggtcgaaccgagtgtcgccgggccgcatcagccgcaccagcgccagtcgttggcgaatgccgccgcgtcgtttcaccagcacgtgcaaggcgaacccgatcaacagtttttcgagccgtcgttcgacgcgccgctgacccatggcgcggtcgtcatgtcggccatcaccagttgcaccaacaccgccaacccggcgcagatgatccaggccgggctgctggcacgcaatgcgcgagtgcggggcgtggggcgcaagccgtgggtcaagacctcgctgtcgccgggctcgcgggtggtggccgactacctggaggcggccgggttgctggaggattttgccgcgctgggttttgacctcgcgggctttggctgcatgacctgtatcggcaactccggcagcctcgaggcgcatgtcgaggcctttgcccggcaagggctcaagggcgtggtggtgctgtcgggcaatcgcaatttcgaagggcgggtcaatccgaacgttccggcaggctatttggcttcgccggcgttgtgcgtggcgtatgcgattgccggcagcatcgatatcgacctgtcggctcgcccgctggcgctggatgcccagggcctgcctgtgtacttgcatgagctgatgcccagcgacgccgaggtagcggcgcaagtcgcccaggtggtgcgcccggcgctgtttcaggcgcgtggcgagctgttgtggcagggcactcaccattggcaggcgctggaggcgcagggcagtgtgcagtttgcctggcagccggcgtccacttatttgcggcggccgcagtacctggcaggcatacaggcgctgcccgcgacgagtctgtctttgcgtgacgccagggcgttggtggtgttgggcgataatgtcaccaccgaccatatctcgcctgccggcactatcccggccgatagcctggccggtgcctggctgcgcgagcgcggtgaagccgaggcggatttcaaccaatactcgacccggcgcagcaaccacgaagtgatgctgcgcggcgccttcaccaacccgcgcttgaacaacctgctggacccacaacaaccaccgcgccagggcgtgtgggcgtggaatgccgaccacaccgcgtatcaaccgctgtacctggctgcgcaaagctacgtgggtacgccgaccgtgctgtttgccgggatcaactatggcgccggttccagccgcgattgggcggccaaggtcttgagcctgctgggcatcaaggcagtggtggcgcgcagcatcgagcgtattcaccgcagcaacctgattggcatgggcgtgctgccgttggtgttcagtgagggtgcttgtgtgcaggatttggcgctggagggcagtgagcgcctgacatttgaagggctggagaatttgcaggttggcgtcaacccgatcaccttgcagatcgcgcgtgccgacggacgtgtcagcagcagcgcgttgaccttgcgcctcgactcgctgcaagagcttggttaccttgagcacggcggcgtgttgccgtttgtgatccgcaagaccgtgcaacggacccgacaaggagcgctcaatgattgaaccgcaagttctgcaacaactggcccccaatggcgtgctgcgcgccgcgatcaacttaggtaacccggtgttggcgcaacgcggcgtggggggcgagccccaaggcgtgtcggtggcattggctcgggcattggccgaggagttgggcgtcggcctggaactgatcacctttgaggccgccggcaaggtgtttgccgccttggctgatgacgtatggcgcgtggcgttcctcgccattgagccggtgcgcgaacagcaaatcgccttcagcgcgccttatgtcgcgatcaagggcacgtacctggtgccgactgattcgccgctgacacacgtcacgcaagtggatgcaccgggcaagcgtatcgccgtcggccagggcgcggcctatgacctgtacttgagccgcaccgtgcaacatgccgagttggtgcgcgcgcctacgtcagcggcagcggtggactggtttatcgagcaaggcctggacgcggcggcgggtgtgcgggatttcttgcaaaccagggtttctgaccaatggcggctgttggatgacgacttcatgacgatccgccaagcgatggcggtgccggtggcgcatgcagccgctgccgcgttcgtcaaatcctttgtcgaacggcagaaagctaatggttgggtgaagcgaggtttgctggacagcgggcagagcgcggaattacaggcgacgtaggaaggatttgacgatgtgtcgcgtggcgtcggtggtgtccagttcgtccagggcgccataggcgtgccagcggcaatcgacgatctcgttgcacggccgcgcgtcggcgatgttcaccactgaggcttcgaacacatggtgcacggtgtcgcgagccttcaattcctgcagatacagcaagccgtccacgttcagcccggtttcttcctccaactcgcgctcggctgcgccgaccgggcgttcatcccgctcgaccttgccgccgggcaacgcccattttgatctggccttgcgcacgaagaggatatgcccctcgtgttcgcaaatgaccgtggcccttattttcatcgtgtgtgcccccgcagcgagatgattgtcataaaagtgtaatgcaattgtcatgctaagtgcttatggcatacacggttggggatgtggatactgaccgattgatgaaaacggacgaggacaacagatgactaccgtacgttggggcatgatcggctgtggcaatgtcactgaactgaagagtggacccgctttctacaaagcgccaggttcggccctggttgccgtgatggggcgccgcgaggaagcggtgcgcgattatgcggcacgccatggcatcgtgcggttctacaccgacgcccaggcactgatcgacgaccccgaagtggacgcggtgtacatcgccacaccgcccgacagccacctcgaatacagcctgatggtggccgcagccggcaagcattgctgcgtcgaaaaacccatgtcgttgaatgccgaacagagcgcgttgatgcagcgcaccttcgagcgcgccgggctgcatttgtttgtctcttactaccggcgctccttgccgcgcttccaaaaagtgcgggagtggctgcagggcgggcgcatcggtgacttgcgtcaagtgatctggaccttcagcaagccgccgagcgccgccgatgccagccccgagaactggcgtaccgacccggccatcgccggtggcggctactttgccgacctggccagccatgggttcgatctgttccagtacctggccggcgatattgtcgaagtcaccgggtttacggcacgccaagccgggcagtatgcggcggaagatgcggtgacagcgtgctggaccttcggctcgggcgcattgggcatgggctgctggaacttcgttgcgcacagccgcgaagaccgcgtcgagctgatcggcagccgcggtcgcatcacctttgcggtgttcgaaaaccagccgttgcgccttgagggcgacgtcaacgaagtgctggaagtaccgcaccatgaacacatccagtggcaccatgtactggccatgaacgcgcatatccgtggcgaagccgagcacccttcgctggccctggaggcgttgaagactgatcgggtgctggacaaggtgttacaacgcaaccccaatttgccggggtaatcgcggtatacctgctttttctcaaggaataggcaaaatgaaatactggatggtggtgtggctgttgctgaccgcgcctgtcatggcggccccgcgcagccaaggcacgccgggggagtttgatttttatgtgctgtcgttgtcgtggtcaccgacgttttgcctgaccaaccccggcaacgagcagtgcacaggcaaaggctacgggtttgtgttgcacgggctgtggccgcagtacgccaaaggcggatggccgtcgtcatgcgatacacaatcgcgactgtcggcggatgagttggccaagggcgcgttgatcttcccgactcgcgcgttgctcaaacatgaatggaccaagcacggcacctgcagcgggctggacgcttcgcgttatctggaagcgacggatacagccttggcggcggtgcagattcccaagcaattgcagccgttcaatgtgccgaactacctgcaggcacgcgacatcgagcagctgtttcgcgagagcaacccagccatgggcgaccacggtatggcggtgatctgcaagggcaaggtgttgtccgaagtgcgcgtgtgcctgagcaaggaattgcgctttgccggttgcccgcgaagtgtgaaaacccagtgcaagggcggcgatatccgcattccggtgcagcgctgatcagttgcctgcgtgcaaggcgatggccgcaggcgccgtcgaactcaacgcgccggcgcggtccgccaggtaacgcgccggcggctggcccacggctttgcggaacatggtgataaagccgctggcgttctcgtaacccaggtccagcgccaatcgctgcacgctttcgcccttggccaggcgttgcagtgacaggatcacatgcaactgccggcgccaacggccgaaactcaaacccaactcttccaacagcaggcgcgtcatgctgcgctcgctcatgccgatgcgcacggcccactggctcagggtggccttgtcgctggggtcagcgagcaaactgtccgccaggcgccgcagcctcgggtcttgcggcatgggcaagtgcagggcctcgataggtgcgtcggccagttcatccaacaaggtattgatcaagcgcccctgggcgccgtcctcgtcatacagctgcgggaagctcacggccttgctgatcagctcatgcaacaggcccgacaccgccagggtgcagcattgcgcgggcagggcgccggcagcgtcggggtcgatcagcaggcaatacacctcggcctcaccggaaccgcgtgcggcatgcgacaggcccccgggaatccacagcgcgcattggggcggcacgatccagataccggcttcgatctggcaatgaatcaccccgcgcagggtgtacatcagctgacccttgcgatgcgaatgcggcgtgtgctcccagctctggctggtgctggaggcgctcacggccaccaccgcgcgggggaacacgtcggcatccttggacatcgagggctgatgcagatcgaggcggtggtgtttcatggtgggttccgcagcttggctgaattgcgaaatattctggctattttgtgcaatgccgtccagtggggcgcgccttatagtgagatctactctcatttaggagctctgccatgcgactcgacagcacaacatttccggtggtgaaaatcgtcttcgacgcgcccaacgaaggcgggccggacgatgcgtttacggtctttgaagggttactggcgcgtgagcaatccttcgtgctgctgcacgaaaaatccgtggacgaaaacaaccacgaacactcccacgaggagcgcaagcaagcctccctctggatgaagaaaaacaaacaggcgctgcgcaccttcgtcaaaggcatgatccaggtcgaacccagtgccgcccaacgcctggccctcaaacccttcgccgcgatgttcggcaaggcctggggctatccgctgctggtggtggaatccaaagaccaggcgtgggccctggcgcgggatgtgctggatgagcaggtgtccgacgtggcgcatttctaaaacgtgtcgcagaaaccctgtgggagcgggcttgctcgcgaaggcggtgggtcagctatacatccgccgactgacactccgccttcgcgagcaagcccgctcccacagtgtttaggtggtgcccattagtccgcgtaaaccacccggcccacggtgcctgatgagccgatctccaatgtgggagctggcttgcctgcgatagcggtgggtcagcagcattgatgccaactgacacggcctcatcgcaggcaagccagctcccacagggatttagtggtgctcattagtccgagcgaacaacctggctcaccgtgcttgatgagccgatctgcgacgtggcgcatttctgaagtgcacgcggtaaaacatgtgggagcgggcttgctcgcgaatgcggtgggtcagctacacatccgctgactgacactccgccttcgcgagcaagcccgctcccacagtgttcaggtggtgcccattagtccgcgtaaaccaaccgacccacggtgcctgatgagccgatctccaatgtgggagctggcttgcctgcgatagcggtgggtcagccacattgatgccaattgacctgcctcatcgcaggcaagccagctcccacagggatttagtggtgcccattagtccgcgccaacaacccggcccacggtgcttgatgagcagatctccaatgtgggagctggcttgcctgcgatcgcggtgggtcagccaccgtgatgccaactgacacggcctcatcgcaggcaggcacgctcccacagtgtttaggtggtgccctttagtccacgcaaatcgcccggcccagcttgcctttctctaccgtcgctgagcagccgaagtggctgttgtccacctggcaggtgcccgccacagggccgttgcccgattgcgtggtcacgctggtctggcactcgccctcacactggcttgaatcggtgcacgccttgcccgcgtccttgtacggcgtgatgcacttccagctctgcaacttgccgacctgcttcatcgtgccaccgcccgccaggcaggtggaggcggcggagtcctgtgccggcgcagcgacgggcgagtgggtcgagcaggccgataccagcaacagagcggccaagccaatcatcaatttcatgcaaaagtcctcgtggagtaagcgcagcggtgcagtgtatgagctattggactaatttgattgacgagcgatcccttcccggaagagtcccatgcacaccttatggaaacgctatatcgccttgctggaaaatgacctgagcacgcagattttcgacaacgtgaaaaacctgctggtgtgcgcgctgttgtttgcggcgggaaccaatacgttgctcgggcagcgtgaactgtttatcggcgtgttcgcctccagcgtggcgggctggggtttgatcatcctgtcgacggtgttgacgctgctgaacgtcagcgacggcattcgccggctggccaagctgcggtatcacctggcgttgcaactgttgctgatcctgatttacctggtgattgccgagcgagtggtggagatagtctggggctttcgggcgcattgaagtatcctccgcgccccgcttatcactgattcaaagaaacaatgaccggacaagacatgcaggcgttgctcgagtcgatcctcgacgaagttcgtccactgattggcctcggcaaagtcgccgactacatccctgcgctggccgatgtgcccgccaaccaacttggcatcgcagtgtacggcaacgacggctcggcctattgcgccggtgatgccgacacgctgttttcggtgcagagcatttccaaggtgttcagcctggtgcaggccatcgaccacggcggcgaaaccatctgggaacgcctcggccatgagccgtcggggcagccgttcaactccatggtgcagctggagtttgaacgcggccgcccgcgcaacccgttcatcaacgccggcgcgctggtgatctgcgatatcaaccaatcgcgctttgccgtgccgatcctgtcgatgcgcgacttcgtgcggcgcctgtcgggtaacccgcagatcctggtcaacagcgtcgtcgccgagtccgaagcccaacacggcgcacgcaacgcggccatggcgtacctgatgaaagccttcggcaacttccacaacgacgtcgacgcggtgctgcacagctacttcaactactgcgcgctgcaaatgagctgcctggacttggccaaggccttcagcttcctcgccaaccaaggcaccagcgcccacagcggcgagcaaatcctcaccgcgcgccaaaccaagcaagtcaactcgatcatggccaccagcgggctgtatgacgaggcggggaatttcgcctatcgcgtgggcttgccaggcaagagcggagtcggcggcgggatcgtcgcggtggtgccggggcaatttaccgtgtgcgtgtggtcgccggagctgaacgcggcggggaactcgctggcggggatcaaggcgttggagttgttgagtgagcggattggctggtcggtgttctaagggctaacgttgatcgttcccacgctctgcgtgggaccgcatccggtgacgctccgcgtcacgttgcgcaggccttgagtgcggcggacgcagagcgtccggggcggcattcccacgcagagcgtgggaatgatcttaggctttgcgcggcttcacgagcagatcgaacatcaagaacaacgccccggcagtaattgcgatatcagcaatattaaacacgccggtatgcgtcggccccacgttcagtaccatgtaatccaccacatgcccgtcgcgaaaaacacggtcgatcaagttggcgataccgcccagggcaatcgcgtaaagcggcaacaccttgcgcaatggctggctccagttggcgagcgaccagcccatcgcccacgccaccacgatggccacgccgacgataaagatgagttgtttgacctgcggtggcaacgcggcgcccaggctgaggaaagcgcctgggttcaagctcagttccagcgccaggttgaccgggttagagccgattttgaagctgttggcgtgcagtgaaaccagggccagcagtttgacgagttggtccacggcaataaaggcgaggccagcgaggagggcgaaggtgcggcctcgcagtaggggcgacgtgctcaagcggtaacttcctgtttcgggctttcgatagagcgcccgaagatagctcaggcgctttatcgcgtccatctcaagcagtcgggtgggccacgctgatcgttcccacgctctgcgtgggcatgcatccgatgacgctccgcgtcacgttgcgcaggccttgagtgcggcggacgcagagcgtccggggcggcattcccacgcagagcgtgggaacgatctttatgcggccgggtgggccacgttcagtgccttgtccaccagcagttgcacaccttcgagcattcggcagatgcccagcgcgacgttgcgttgggaaccgtcgatttcaaaggccatatggttggcgatgtcgcagatggacgccaggtcctgggaggcattgaccagcaaggtttcggtgcccaggtcggcgcgcacggtgaagaggccatcgctgggttcggggctgggtttgccggggttgaggtagtggttgatcgcgcggtagaccacttcgtgcagggtgctggtgtcgaagtctggatggcttgggggatttgggctgtctttaatcatggtgaagctcctttataaatggaactgccacgattcgcggtcaaacgaaagagggtggcagctatacgcgggttgaccgaccggccaaaaggagcaaaaccggcatacccgaaggtatcccgcgcacagctgccgcgacacgatacctcagacgtaaaaaaacgcccaatatcggtgttagcgcatttgctcttttggaatcggacggtcaaatccggccgctgaattggcagcgacgacgagaggttagtcagcccttttccgagccacaacctgaaacccttgtcggaaacttccgagagccgcaaagcctgcgcactatgagcgttcccacgctctgcgtggaaacgcatccggtgacgctccgcgtcacgacctcaagagcagacgcagagcgtccggggcggcattcccacgcagagcgtgggaacgatctttgagcgggtctagaaacccttatacacaccaccgcatccagcccacccccaacagcataagcacgccgacgcccagcagtagagcgcgcgccggccgcacacggcgaatgcggtcttgcaatgcgccgatgccgcagagcgcgattagcaccgcgaacgcccagcggggcaggcgggcggtgatgcccagacggttgcgtctattgggtttgataggcgaagtgttgcggtttgaggtgtagtggaacgtcatggacgaatcctttcgcacatggtgaatgggtaagccaatcgatgattgaactctcgactggctaagctaacggattttgcgggttcggtaacctgtgagagttgacagttttttagactgtttgggccgtcaactgatgttcaacctgtccagcaagctataccaggccacaccgatacctgtttagaaccgcatttatcccatgcaacaacgaaatctggagccggcaaaccggtccctacgggtggttggggagctgtgtttacacccacaaaaaatgcgcccctgagggcgcatttttttgttcggtcagctaccgcctattcaggcaatcgcatcccaagcccgatcaccgtgctcgtctttaatccgagtcggcaggcccatcacgtccagcgctttgaggaacggctcagccggcagctcttcaacgttggccatgtgcttcacatcccactcgccacgcgcaaccagcagcgcggcggccaccggtggtacgcctgcggtgtaggagatgccctggctgtcagtttcagcaaaggcttcttcatggcaggccacgttgtagatgaacagctcgcgtggctggccatccttggtgcccttgaccaggtcgccgatgcaggttttgccggtgtagcctggggcgagcgaagacgggtcgggcagcacggccttgaccagtttcagcggcaccacttccaggccttcggcggtagtgacgggtttttcggagagcaggccgaggtttttcagtacggtgaacacgttgatgtagtgttcgccgaagctcatccagaaacgcacgttgggcacgtcgaggtttttcgacagcgagtgcacttcatcgtggccggtcaggtacaggttttgcgaaccgactaccggcaggtcgtcggtgcgtttgacttcgaacatggtgttgctggtccactggctgttctgccagctccacacctgcccggtgaattcgcggaagttgatttccgggtcgaagttggtggcgaagtatttgccatggctgccggcattgacgtcgagaatgtcgatcgaatcaatgcggtcgaaatgctgttgctgtgccaacgcggcatacgcgttgaccacacccgggtcgaagcccacgccaaggatggcggtgatgttcttctgtttgcactcttccaggtggttccattcgtagttgccgtaccacggcggggtctcgcagaccttgcccggctcttcgtggatggcggtgtcgaggtacgcaacgccggtgtcgatgcaggcgcgcagtaccgacatgttaaggaaggcggagcctacgttgatgacgatctgcgagtcggtctcgcggatcagggccttggtcgcttccacgtccagggcgttcagcgcgaaggcctggatgtcggcgggcaccttgaggctacccttggccttgacgctgtcgatgatggcctggcatttggagatgttgcgcgacgcgatagcaatacgaccgagttcgtcgttgtgctgcgcgcacttgtgggccaccaccttggcgacacctcctgcaccaatgataagaacgttctttttcaattgctttatctctcctttatccgccagcttacgaaaggctggacaggtagtcgtcgtaaccaaattcacgaaccacctcgactgtaccgtcgagttgtttcactacgatggacggcattttcaggccgttgaaccagtttttcttgaccatggtgtagcccgcggtgtcgataaacgacagccgatcgccgatggccagcggacgatcaaattggtattcgccgaaaatatccccggccaggcaggatttgccgcacaccatataggtgtgttcaccctcgcttggcgccaacttggcgttgaggcggtagatcagcaggtccagcaggtgagcttcgatggagctgtcgaccacggcgaggtttttgccgttgtagagagtgtcgagcacggtgacttccagcgaggcgctgttggtgatcgccgcttcgccgggttccaggtagacctgcacgccgtacttctcggagaacgccttcaaccgcgcgcagaacgcgtcgatggcatagccttcaccggtgaagtgaatgccgccgccgaggctgacccacttgaccttgtgcagcagcgcaccgaagcgctcttcgatggtgccgagcattttgtcgaacaggctgaagtcgccgttctcgcagttgttgtgaaacatgaagccggagatttgctcgatcacgccttcgatcttcaccgggtcccattcgcccaaacggctgaacgggcgcgccgggtcggccagcaggtagtcggagctgctcacctgcgggttcacgcgcaggccacgggtcttgccctcggaacgctcggcaaaacgctgcagctggctgatcgagttgaagatgatcttgtcgcagttatccagcatctcttcgatttcatcgtcggcccaggccacgctgtaggcgtgtgcttcaccttcgaacttctgacggccgagcttcaactcatacagcgacgacgaggtggtgccgtccatgtattgctgcatcaggtcgaacaccgaccaggtggcgaagcacttgagcgccagcagagccttggcgccggactgttcgcgcacgtaagcaatcttctgcatgttgaccagaagtttctgtttatcgatgaggtagtacggcgttttgatcatttttgagagcctgcggcggtgcctgccaaaaaaggacacgcattgtgcccgcacttggatcagatcgaaaggttagtgggcggattttgctgcgcccgatttttaatcgtagcggcgaagtatgactgtctatgggtatatcccggatcagtgtgggagcgggcttgcccgcgaaggcgctgtgtcagtcacacgctttttaactgcaccgccgcattcgcgagcaagcccgctcccacatttggatctgtgtatacgcggacatagcggcaataactgccgtaaaactgtcatcaccttaccaccggaatgccatatttgatcgctactgtcctcgccaatgagatcgatctcaaagcgagtgacaatgaccgacctgaaagacgttgcgcagctggccggggtatcccgtgccactgccgcccgcacctttgcctcccccgaccaagtgcgcccggccacccgtgagcaggtgttcgccgccgcccgcgagttgggctttcggcctaacttgctcggccgccagctgcgcctgcaaaccaccaacctgatcggcgtggtggtgcccaacctgctcaacccggtgttcgccgagcagttccaggccatggagcgggccgcccgactgcgcggctacagcctgttgctggcgaccaccgactacagcagcgagcgcgaaagcatcgtggtggaagaattgctgcgccagcgtgtcgatggcctggtgctgacggtcaccgacgccgaaagcaacagcgtgctcaacagccttgcccacgaacaaacgccgttcgtgctggcctatcaccagccgagcaaccccaactacagcgcggtgtcagtcgacaaccgcgcgggcatggccctggccacgcgttatttgctggaagcggggcaccgacgcatcagcatggtcgccggccccgcgttgcagtccgaccgcgcacggctgcgatacgccggttactgcgacgcgatgcgcgagtacggtcttagaagccgtgccgtgattgaaatgccggcccacacccaggccgagttcgcggcaatcgagccgtttctgcaaggcccacaggcgccgaccgcgctggtgtgttccaacgatttcctcgcgatcagcctgatcgccgagctgcgccgcaacgcctggaatgtgcccgagcaactctcggtgatgggctttgacggcatcgccctcggcacccagatgcacccgacgctgtgcagcgtggtgcagcccatcggcctgttggccagcactgtgattgatcaactgctggcgcaaatcgccggcaacgctccgatttcccattgcctgccgtgccatatccggcccggcgacagcactcaaccccttgaggagacacctgatgcgcgcgttcagtaaaaccctggcagccgtgctgctgtgcggcttggccagcctggcccaggccgccgaaaccgcgatttgctacaactgcccgccggactgggccgactggggcagccaacttaaggccatcgccgccagcactggcgtgcaagtgccgctggacaacaaaaactccggccagtcgttggcgcagttggtggccgaaaaggccgcgccggtggcggacgtggtgtattacggcgtgaccttcggcctgcaggcgcaaaaagccgacgtggttggcacctacaaacccaaaggctgggagcagatccccgccggtttgaaagacccggccgggcactggtttgcgatccattcgggcaccttgggcatcatggtcaacgtcgatgcgctgggcggcttgccggtgccgcaaagctgggctgacctgctcaaacctgaatacaaaggcatggtcggttacctcgacccgtccagcgccttcgttggctacgtctccgccgtggcgatcaaccgcgccctgggtggcgacctggataacttcgccccggccatcgactacttccagaagctggccaaaaacgcgcccatcgtgcccaagcaaaccgcctatgcgcgggtgctgtccggtgagctgccgatcctggtggactacgacttcaacgcctaccgcgcccgttacaaggacaacgccaacgtcgcattcgtgatccccaaagagggcagcatcagcgtgccgtacgtgatgagcctggtggccaacgcgccgcaccgcgcgaatgcagaaaaggtcctcgatttcgtgctctccgatgaaggccaggcgctgtgggccaaggcctacctgcgcccggtgcgcccaatgaagatgccggccgacgtcgccgcgcagttcctgcccgacagtgattacgcgcgtgccggtgtggtggactacgaaaaaatggctgccgtgcaggaagccttcgccgcccgttacctgaacgaggtcaagtaagtggccgcatcggcaaaacaggccgcctgggcattggccccggcgtttgcggtgctgctcgcgttctggctgttgccgctggcgcacctggtggtgctcggcgccgagagccgcgacagcaacggcagcggttattggcaggtgctgagcagcacgcagtatttgggcagcctggcgcaaacctgtgtgctggctgttgtcgtgacgcttgcggcgttgctgattggcggaatcagcggcgtgtttctcgcacgtcagcagttctttggccgttcggcattggtggcattgctcacgtttccgctggcgtttcccggcgtggtggtgggctttctggtgatcctgctggccgggcgccaaggcctgtttgcggccctgggcctgcaactggccggtgagcgctgggtcttcgcctactcgctggcggggttgtttgtcggctacctgtacttctcgatcccacgggtgattctcacggtgatggccgcgtgcgaaagcctcgaccgcagccttgaagaagctgcgcattcgttgggcgcagggcattggcgcgtggtgtgcgacgtgattgtgccgggcctcgcgccggcattggcgtcctgcggggcgatttgctttgccacgtccatgggcgcattcggcacggcctttaccttgggcacgcggctgaacgtcaccccggtggcgatctacaacgtgttcaccaactacgccaactttgccgtcgccgccgcactgtcggtggtgctcggcgcggtcacgtgggcggtgttgctgctcacgcgccgcctggtgaaaaacgcggggactgtcctgtgaagcgctcatcgctgtttgtgattcaactgctgttcaccttgctggtgtgtgccttcatgttggtgccggtgctgatgtcgttgctggccgggttgacgcgtaacttcttcgtcggcctgtccagcggcttgaccttcgactggctggtgcaggtgtggcaggcctattcgccgaccgtgtggttgtcgctgcaactggccgtggcctgtgcggtgtgcgtctgcgtgatcggcgtgccggcagcctatgcgctggtgcggatgaacaaccgcttcagccgtgccttcgaggaactgatggtgctgccggtggcaatgccggggttggccagtgcgctggcgttgctgctgacgtacggccagttcggcagtttccgcagcagttggttgttcatcctcgtcggccatgtgctgttcaccttgccgttcctcgtacgcccggtgatggcggtgatgcaacgccagcaactgccggtgctggaggaggccgccgccagccttggcgccgggccgatcaagcgctttttcagcgtggtggtgcccaactgccgggcggggattctggcgggtgtgctgatggtggtgaccctgagcctgggtgaattcaacctgacctggatgctgcacacgccgatgaccaagaccctgcccgtgggcttggccgacagctacgcctcggcgcgcctggaaatcgccagcgcctacacccttatctttttgctgatgatcgtgccgctgctgattgcgttgcaggccatcagcgcccgtttgtcccgtggagagcgtcgatgaccgctatcactatccgcctgcagggctgtcgcaaggcattcgccgacggcaccgtggccgtgcatgacctgaacctgaccgtcgaaggcggcgaaaccctggcgattctcggcccgtccggctgtggcaaaaccaccaccttgcgcctgattgcagggctggagcgcccggacgtgggccaagtgtttttcggcgaccaggacgtcacccgtctgcccattgagcggcgtgatgtgggcatggtgttccagaattacgcgctgtttcccaacctggacgtggccggcaacattgtctacggcttgaaaattcgcggcgtgcccgcgcctgagcgcaacaagcgctgcgaggaattattggaactggtgggcttgcagcaccacggccagcgcagcatccatgaactctcgggcggccagcgtcagcgtgtggccttggcccgcgcgctcgcgccgcgccccaaagtgctgttgcttgatgagccgttggcagccctggatgcgcaattgcgcgagcgcctgcgcagtgagttggatcaactgctgcgcgggcttggcattacttcggtgttcgtcacccacgatcagggcgaagccatggccctgggcgaccgcattctggtgatggagcaggggcgcgtggcgcaactggccagcccacgggagatctaccagcagccggccaatgcattcgtcgcaggcttcgtcggcaacctcaatgccttcacggtgctggagcgcagcgcccacggcctgaaagtctgcggcggtgagctgccgtggcacaccgccgacttaccgagcactgtcttaccgagcactgtctactgccgccccgaacacctgcgtgtcatggaagacgaggggcatttgcacggccatctgttggcgcagttcttccagggcgcgcaaagccgcctgctggtggatgtcggcggcccgcaaccgctgctggtggacagcagcgacaaccaactgcaccgcgtcggcgcgccgattgccctggcgattgcgccgcacatgttgttcaccctgaatacgtgagtctttattttgaaccgtccgtttgttgttgctcaaatcagcgacctgcaccttaaagccggcaaccgcctcacctatggcgtggtcgatacgctgggcgcactgcgccgcgccgtcgaccacctgaacgccagttacccacgccccgatatcgtggtgatcagcggcgacctggtggacttcggccgcgccgatgaatacgccgtgctgcacccggaattggcgcgcctgcacatgccgtgctacctggtgcccggcaaccacgacacacgcgggccgttgctggaggccttcgctgatcacgcctatttacccgcgtcggcagacggcccgctggattgggtggtggatacgcacccgttgcggctgatcggtctcgattcgaccattcccggtggccatggcggccaactgctcgacagccagttgcagtggctcgacgcgcaattggcactgcgccccgaggccccgaccttgctgatcctgcatcacccgccgtttatcagcggcatcggccatatggaccgcgagcccttcatcaacgccgccgccctggagcacgtggtcgcccgccacccgcaagtggaacggctgttgtgcgggcacctgcaccggccgatgcaacggcggttcggcggcagcctgagttgtgtatgccccggcacctcgcaccagatcgtgctcgacctgcaagacgctgcgcctgcgcatttcaacctggaaccggcgggctacttgctgcaccgctgggatgaacagcaggggttgatcagccacaacggcgtgttcggggattacccggggccgtatccgttttatgacgctcatggattgattgactgaggttttacggaggttcacttcactcaactaagcacttaaacgttcgttaacgcggcggccaaccgagtttggccgcgtgcatcctgctgccctttttatgcgcccggaacttggattccgcgccggagttcgtcctgatgaaagccactttgcatgcactaagcgtattgaccggcggcctgggcattgccctgagccccttggcctcggctgatttcctgagcgacagcacagccaacttgaacatgcgcaatttctacttcaataacgacaaccgcgacggcactgccgcaccgtcgaagaccgaagagtggggccaggcgtttatcctcaactaccaatcgggtttcaccgatggcaccgtcggctttggtctggatgccgtgggcatgctcggcgtgaccctcgacagcggcgccggccgccatgtgggcagctcgatgatccccagcgacgacggcaaggccgccgacaactgggcgcgcggtggtgcgacggccaaggcgcgtttcgccaagactgagctgcgctacggctacctgcgcccgaacctgccgatcctggtgagcaacgatggccgcctgttgccgcaatccttcgaaggcgcgcagatcaccagcaaagacatcgacaacctgaccctgatcggcggccagctgcaacacaccaccggccgtggctccagcgaccgcagcggcctggcggcggcgggcggcactcaagagagcaataaattcaactatgcaggtttggattaccaagtgaacaaggacctgctggtccagtattactacgccaacctcgaagactattaccaacagcactttgccggtttgatccatgtattgccgttgggtgattacggctcattgaaaaccgacctgcgttacttcaatacgacttccgacggcaagaacagcagcgccgccgggcgcgcagaaggctataagttcagcggctataccaagaacggcaacggcgaaatcgacaacaacacctggagcgccgcgttcatttactcgctgggcccgcacgcgatcacggcgggctaccagcaagtctccgacgacagcaacttcgcccaactcaaccagggcggcctggtcaacaaaggcgagggcggctccagcctgtacctctacaccgaccgcaccgtgcagaccttcatccaggccggcgagcgcactgcgtttgcgcaatacgcctacgacttcgtcgcgctgggcctgcctggcctgaaggcctcggtgatgtacttgaaaggcgaccacatcctcaccaccgccggcaacaccgccagcgagtgggagcgggacatctccctggattacgtggtgcaaagcggcacattcaaaaacgtcgggttcggctggcgtaacggcgtgtcgcgcagtgaagtggcgcgggaccaggatcagaatcgagtgtttgtgagttattcgattccgttgctgtaacggtggcgccttaatactctagctgtggcgagcgggcctgtcgtgacaagcgggcttgctgtggcgagcgggcttgccccgcgttgggtggcgaagccgccctaaaaccaggcaacgcgatttgtctgaataaatgcggcgatcttactggggctgctacgcagcccaacgcggggcgagcccgctcgccacgacaagcccgctgccacgacaagctcgcttgccacaccaagcccgctcgccacagttgatctttatcgatcacgccacgcggtttctgcctgcgcccttggcttcatacaattgcctatccgcccgcttgagcagcgccagcgaatcacggtccgcaggctgcgcgatactcaccccaatactcactgtcacctggcccactgtcggaaactgtgcggccgccacggccgcacggattttctcggcgaccacgtcggggctgtcgggttcttcgacttccggcagcaataccgcaaactcttcaccgccgtaacgcgcgacaaagtcggtggcgcgggtggtgctttcgatcagcgccgccagttggcacagtacgtcgtcaccgacggcgtggccatacgtgtcgttgacgcgtttgaagtagtcggcgtcgatcagcagtaaggcgaaggcacgtccggtgcgctggaacagcaggctgttctcggcaagtttttcgtcgaagcggcggcggttgaagacgccggtgagggcgtcgtgggtggccagtttcagcaggtcggcatttgcctgggtgaggtcggcggtgcgttgggcgacggtggcttccagggacgcgttggcgtcttgcagctcgcgctctttgctgagcagtgactgggtcatgctgctgatggattggcccagttgcgcgatttccagcaccgcatgctcttgggggaagacggcgccgggcttctggtcttgcacttgcttggccgacctggccaggcgctcgatggggcggctcaggctcgacgccagatagtacgccaccagcccgaacacgatagcggcgagcacgccgagtatcagcaatttgtacagcagcacccgcgctggctgcagcgcgatgtccagcggttggcgcaccacgatgtaccaggacacgttggcgttcgaggggcttggcacagccaccgatgcgctgacgtaaccgttgccgctggtccagcccgacggtgcgcgcaggctggcgggcggcatttgttccccggccagtatctcggggtaaagcaccttgccgtcgaagtcgatgatcagggcttcaatgttgggcgtggcgtccttttgcatcaccgccgaatcgacgatttgcgtcacccaactccagtgcgcatgggcaccgagtacgccaatggtctcgccgttggcattgcgaatcggcgcggcaaagtcgataaaccgcaacggctcgccattcgccgcgcccggtagcagcttggcgagcaacaccgcttcgtgggggtcgccggtgtattcgccccgcatgcctgcctggaaccagggccgttgctgcaccgattgattcaccagcaagccgttgaccgcctggcgcacgcggccctcggcatcggccacgcccatccacgcgtactcggcgcgtgactgggtgcgcagctccatcagggtcatgatgtccggcgcgtccaggtcgcccttgcgcagcaccggtgccttgctcagcagtgacacttccagttggcgctcgcgcaactgaacggccaatagcgcggctgtcgagcgcgccgtgccgagcagcgaattgccgctggcctgcttcatctgctcggtggctatatgcccgacataaaagcctacgatcaacagggtgagcagtgataaaccggcaaaccataaggtcaggtgactgcgcaggctggctgtgatcatgggggctcatttgagtgtttattttggctcatggtatgcgcaacggatggagaacagccagcggcaggccagcaaggcgcaaccacaaacgtacaagattcagcacaaagcccctcagtagactcgcctgacttcttctactgcaggttctccatggacattttcctctacgccttcagcgtcatgtacagccccggtcccgtgaatttaatggggcttaacgctggcctcaccggcaagttccgccgctccagcgggttttacttcggcgtgggctgcgcgatgctgctgatgttcgtgctgttcggctacaccggcgaggcgattgtttcccaggcggcgctgccgtatatctcgttggtcggcggcgtgtatacgctgtacctcgcgtaccaagtgttcacggcccgcacggtggttgatgacgcttcaagcgcgcccgccaaggcgctcacgttctggaatgggctggtgattcagttgctcaatcccaagggcatcgtcgcggtgttgccgatcaccagcgtgatgttgccggcggcgcatatcaccggggcgtccattgctggcgtttcagccctgttggggctcggcgcggtcggtgcgccgtgggtctatgccttgctgggcgcggtgctgggacggcggatcaacggggcgacggcgtttaccgtattcaaccgctgcatgggtttggcgctggctggctgtgcgtatttcatgtttcacgcgttctatctgcacatcaccggcgcttaggtaaagggtgtggggcagtatgtaccccgaaaccaggcgcccgagtgctctctgccactctgcggcgcctgtattggggctgctttgcagcccaacgcggggcaagcccgctcgccacaaaaagcttaatcagccacctcaggcgagccggtcaaaccccttcaagcgatacagcaacaccgacgccgcccaactggcgataaagatcccgatgatgatgtagcccagcatcccgaaactgtcgttcaggctgccgataaaaccccagaaatttcccttgagttccagctgatccgcgatcagccccagcgcctcgatgctgccgatgatcacggccaccaccaccgacaccaaggtgatgctcatgttgtagtagatcttgcggatcggcttcatgtacgcccagccgtaagcgccgagcatcaggtggccgtccagcgtgtccaccagcgacatgccggcgctgaacagcagggggaacaccatgatcgaccatggcgacaagccttgtgcggcctgggtggcggagatgccgagtagggcgatttcggtggcggtatcaaaccccaggccgaacagaaaccccaatgggtacaagtgccaactgcggctgatcaggcgaaacagcgggcgaaagatgcgcgccataaagccgcggtcggccagcagcaggtcgaaatcctcctcgacgtaggcgccgccctggcgcacgtggcgccaggctttgtagatcgaacgcaggatcaccaggttcatcagcgcaatcagcagcagaaacagcgccgacaccgacgtgccgatcacactgccgacggccttgaacgcctcgaaatgctccttcagggtggcggcggtaaaggccacggcaatcgaggccagcaccaccaccgacgaatgccccagggagaaaaagaaccccacggccaccgggcgcttttgctcttgcatcaacttgcgggtggcgttgtcgatggcggcgatatggtcggcgtccactgcgtggcgcaggccgaaactgtaggcgagcagggcggtgccgagtaacaccgggtgctcatgaaacgccaccagcgcccagagccaggcgccgacgtttatggcgatcaagaggccataaatgccaaacagcttgctgcgcacttggcggttggaatcactgaaaacctgggcaagacggtggatcatcaggtaaaccctatgtgcggtggcgcgaccgctccgacgcaggagcggctccagaggggaaacttaatggattcttatggcgtcaatgatgaaatttgcagggctttctctgcggtaaacatggaggcaatgatgacgagcttgaacgggcaaccggccgaggcggtgattgaattctggaagcaggcggggcccaagcgctggtttgccaaggacgacgccttcgacgcggcgtttcgcgacacattccacactacgcacatgcaggccgcgcggcgcgagctggaaggctggctggatactgcgcacggcgcgctggccttgctgatcttgctggatcagtacccgcgcaacgcctttcgcggcaccgcgcatatgtttgccaccgacccgctggcgcgcttgtacgcgcagcgcatggtcgacgccgggctggatcagttgatcgaacccgagctgcgcgcgttctgttatctgccattcgaacactcggaagagccggccgatcagcagcgctcgctggccctcaatcagcacctggatgccagcacctaccactgggccaaggagcatgccgcgatcatcgagcggtttgggcgctttccgcatcgcaatgcgctgttggcccgcgtaaccactgagcaagagcgcgagtttttggataaaggcggttttgccggctaaacctgcgccaggctttccctggcgcgggccgagcgaaaacgccgcaggcccttgaggtcgaccgcccagcgcaacgcttcggtggccgacgggcgcgggccttgggtgatcgcgtgttcatctgtggtgagtgcacccaggtagccttgggcaccgccgcgctcgctccagtagtgagtgtggctgagccatgaacgtgcgagccagcctttgcccttgcccacggtcaccggcaaatccagcacgcctgcgcccatcaccggcttgaccgggccgccaacgatgtcgccaaacaggccaaacggcgccgggaagtacaggttggtccagcgcgtcactgcgaacgccgccgcgtggtgcaggtagtacggcgtgaacggttgttggccgagcatcaccggctggcgtgcattgtagccgtagcctttttcgtcctcggtcggcgggcaggccggggcttcgcggcgttccatgcgctttttgaagtcactcacgctgcggcccagcaacaggctggcgtgggccatcgggctgccgacggtgaccagatcagtgatgcgccatgggttgcccaggccgcgctgctcgataaacgcttcggcctgctgctcgcgaaacttcaaggtgctgccgaggctgccgtccagcgctgcgccggctttaggcagtgtgtctttgatcaccggttgcaacgcttggtgatcggcatagcggctggccagttcgcgattgctggggatgaccttggtcagttgatcgtgatattcgtgccagaggtagccgacgatatcgtaggcaatcacactgcccaggctgtggccgaccacgatgatgcggtcgtagtcgcccttattgtgcagtgcgcgcagcaaggccacgccgtcggcgcgaatctgctcacgcaccaccacgttctgcgggttggggctgaggtaacgcgcggcgtcgcccaggtaggacagtgcggaatagcgcagccccaggccgatagcggccagcagcagcggcaccagtgcgaaggggttgtcggtgtgctcgaactggccccaggcggtcgcaagggtgccggtggcgatcagcaccaacagcagcatcacggcccagcgcgtggtgcgccagatcggcacgatggcctccgggatgtcgcgacgggggcgtttgaaaatgtcccagagccaaccgagcaaatggccgactttggtgccctgcatcttgtgggcccagtagtactcgtagaaatccgtgctggtgcggcctgacgacttcaatacgcgcaggtcaaaattgcgcgacaacctgtccggcttgctccaatacaggggagtgccgctttgcgtgtcggcggcaatcattgcatccacaaagccatgcagggtgtccatcgggcgctgctcgccgatcccgtgaatgacgacaactgcttgtttcataagctgatctttccttgaacgcttcgaatggtggggcgtgttcgcaaactagcgaatcgctacgatattgccactatcggggctattcccgccaggaatggccccataaaaaaccgccattgtctttattgccgtgcatctcgtagcgtgggttttcacccaaggagacccgccatgcccgcgcacccgttacgcctctatgtggatgcccagttcaccagcccctacgccatgtccgtgttcgtgacgttgcgtgagaaaggcctggcgttcgacacgctcaccctcgacctggacgccgcacacaaccaggccaccgactacgcccaactgtccctgacccagcgcgtgccgacattggtggagggcgactttgcgctgtcggaatcttcggcgatctgcgaatacctggacgaggtgtatccccagacagccgtctacccgaaagaccccaagcagcgggcgagggcgcgccaggtgcaggcgtggttgcgcagcgatttgctgccgattcgccaggagcgctcgacgctggtggtgttctacggccagaagatgccgccattgtcttctgcggccgacgcggcggcgggcaagttgatcgccgcagcgcaggcgttgctcgcgggcgagtcggactacctgttcggtgaatggtcgattgccgacgtggacctggcggtgatgctcaatcgcttgatcctcaacggcgacagcgtaccggccgagttggtcgcctatgcccggcgtcagtggcagcggccgtccgtgcaggcctgggtcaacctgcaacgcccggcgttgtaagccgaccattcatcttctgcttaaggtgacgtgcttgacagccgtcactcggcgggcaaatactcggcgcatattcatatatatgactaaataacaaagtgaatgtgccccatgaatacgctgtccagtgatgcccgcctgccgctttatcaacgcctgcgcgaccacttggtcgagcagatcgccaacaatcgctggcgccccggtgaagccatcccgactgaagcggtgctgtccgccgagtacgaactgtccaccggcacggtgcgcaaggcggtggatgcgctggtgagcgaaggcatccttgagcgtcagcagggccgcggtacgtttgtgcgccggccgcaattccagtcctcgttgttccggtttttccgctttcagggcccctccggcgaacgtcaggtgccggagagccgcatcctttcgattgaatccctggccgcgccctcggcggtgagtgaagcgttgggcctggcgcccgacgcgcaggtgattcgcatcgtgcgtacacggttgctggaggtgcagccgctgctggccgaagaaatctggttgccgcgcacgcgtttccaggccttgctcgacatcgacctggcgcagcaagggccgttgctttatccgatttatgaaagtgtttgcgggcaagtggtggcctccgccgaggaaaccctcaccgccgaagccgtcaacgatgtgtacgcacgcctgctgcaggtgccggtgcacagcccggtggtggtgattgagcggttggcccgcgattacgccgggcaacccctggagtggcgacgctcgcgtgggcatgccgagcacttccgttaccgcgtggatattcgctgacgcgtgggcgggccaaggctcgccccacttcttacatgtttgccacccctggcccggctgcggcgcggttcgcgttcggctgccttgcgtttgacctataaggataagaaatcatgttcagttggtatcgccaagtcactccgcgcgagcgcaaaacgttttgggcctgcttcggcggctggtcactcgacgcactggaagtgcagatgttcggcctggcgattccggcattgattgccgcgtttgccttgaccaagggcgatgcggggctgatcagcggtgtcacgctgatcacctcggccatcggcggctgggtcggcggcacgctgtccgaccgctacggccgcgtgcgcaccttgcaatggatgattgtgtggttttcgttctttacgtttttgtcggcgtttgtcaccggcttcaaccagttgctgatcgtcaaggcgctgcagggcttcggcatcggcggcgagtgggcggcgggcgcggtgttgatggccgaaaccatcaacccgaagtatcgcggcaaggtcatgggcaccgtgcaaagcgcctgggccgtgggctggggcgtggcggtcggggtgtttgcgctgatctattcgtttgtgccccaggacatggcttggcgagtgatgttcgtggtcggcttgttgccggcattcctgatcatctgggtgcggcgcaatgtcgaagagcctgacagcttccagcgcctgcagaaagaacaggcgatcccgcagagcttcttcaagtccctggccggcatttttcgccctgacttgatccgcgtcacgctgtttggcggcttgctcggcctgggcgcccacggcggctaccacgcggtgatgacctggctgccgacctttctcaagaccgagcgcaacctgtcggtgcttaattccggtggctacctggcggtgatcatcttcgcgttctggtgtggctgcgtggtcagtggtttgctgatcgaccgcattggccgacgcaagaatatcgtgctgtttgcgctgtgctgcgtggtcaccgtgcaggcctatgtgttcctgccgctgaccaatacccagatgctcttcctcggtttcccgctgggctttttcgcagcgggtattcccgccagcctgggggcgctgttcaacgagttgtacccggcagacgtacgcggtgccggcgtgggtttttgctacaacttcgggcgcgtgttgtccgccgtgttcccgtttctggtggggcatatgagtgactcgatgtccctgggctcggcaattggcattgatgccgggattgcctacggcgtcgcggtgattgccgccttgtgcctgccggaaacccgtggccgtgtcctcgaagccgcgcctgccgacagtgccccggttggccagcgtgcccaggcttgaactttctttttggtgaacgataaaaccatgcttgataaccgcaccctcaccggcatcgacgcccatgcccatgtcttcagccaagcgctgaccctcgccggcgggcgccgctacacgccgggttacgacgccacattggcggattaccttgagcatctgcacgccaatggtttgagccatggtgtagtggtgcagccgagttttctcggcactgacaaccgctatctgctggccgctttgcagcaggcacctgagcggttgcgtggggtagtggtggtcgaccggcaggtcgcacccgacaccttgcaggccatggctcgccagggtgtggtcggggtgcggttgaacctggtggggcagccgctgccggacttcgccgcgccgggctgggcggtgtttttccagcggttagtcgagctgggttggcatgtggagctgcaccgcgagctggacgacctgccgcacctggtgcgccagctgttgccattcggggtcaagctggtgattgatcacttcgggcgcccggatgcgcggcgcggggttgatcagcccgcgttcggcgaattgctggcgttgggcgcaagcgggcaggtgtggctgaaggtctctggcatctaccgcttggccggctccccggagcaaaaccttgagtttgcccgtgcggccatgcccttgctggcgcagagctttggccttgagcgcctggtgtggggcagtgactggccgcatacccagcacgaaaaccgtatcagctatgccagcgtggtggagcaacgccaggcgctggatttttcgaagtcggtgcagcaggctttgctgatcgacacgcccagccggttattcggcttcgagcacgtgtagcgaagcctgttccacacggcggtcgaggtcttcccaatccgccatgcccagcacccgcgtggtgttcaaaccgcgcaggtagccgcgcaattgctgggcgctggcgtagcgctggtcggcatcggcggctgcgtcctgcagcacgttttcatagtcgaccaggtaatcggcgacccgctcgcgaaactccggcaaaacggcttcgcggatgcggtcgaagattttctggtggggcttcatggcaaggtccttatcgttttatagagatcgcgattcccgacactatcggttcaaatgatagtcaccatcaaggatcacaagttctgtttttgtgccaaaggcggacaatccccccatcgagacgctgttcaaggaaatgcgcgatgaggacgataatccaactgggtttaatgatgctgatgctcggcactgcggtgctggccaacccggcaattgctgatgatctgcgtacgggccatttgctgccactcgtcggtagcgtagactccctgcagcacgtgcagtcggtgggtgtgttgtacagcgaaaacacccgcgacaacctcagttaccttgaacgctaccacgccatggccatgaacggcgccaaggatgcccttgacggacgcatccgcgaggcgttcgtcaacagttccgacccggagctggcaattgattggctgatgaactcattgcagggcacttttcgtatcgtcacggtctatagcagcctggatgaactggtgcaggctcaccccgatgtggtggtgatgctcgatacccataaccaactgctgacccagcgaaacgatgtggtcgaggcgcgctttgttgcacggttctatgatgcggacctgcaatacatcgccaaggccgaaggttcggtgcacaaacaagtgccgtcggtatgggtgcacgacaaagcggccccggaaattgccgcgcagattgaacagcaacgtgatgtgcagcttgatgcgttgaagcagttcgacgcatcgctcaaggccctggtccgcgccggatgatgtgcggatcgatgtgaaccctattggttattttcaggaatgtttatgcgctcttttttcgtcccggccctggcttttgcttccttgttgctgaccggttgtatcactgctcccaacgctccgaccttgacgctgcaaacggacaagtcgcccgaaagctacgtgcaatgcgtactgcccaagcttgaaaaacacggcatttcctcgactgtgacgcagaactcgcgtcacgccaaggtggtgttgaccagcaagattgccgccgatgacgtgctggaggcttacaagtcccaggacggcaccaaagtcttcctgtacgagcgcaagccgctggcctcggcgatcaagccgtcgcggttggaaatgtcggcgcaggattgcaagtaatccaagaccacacacaactcttctgtgggagttggcttgtgtggcgagggagcttgttcccgttggggtgcgcagcgcccctgtttttttgggggcgctacgcaccccagcgcaagcaagcttgctcgccacacaagcccgctcccacatggtggcctagggcttcgcttcgctgctgaagatgttcacggtcttgaccagcccttgagccgccaacgccaccaactcaccgcctttttccaccgtcgccagggccgggtccgaccccatgcgcccgtcggggaagcgtgcacggaagtccagcgcttcgcgaattggcccggtgttggcaatttggggtgaatactcggcggacttgatcgaatccgcgtacgcccactgcgtcactgcaatttccgacggcgtggcatggctgccgtggccgaccggaaattggcgttgagccaggtcggtgacgccttccagatcccaccagttcaccagcttcagcgcgaaaccggccgggcggcgggcgaagctggcctcggcgtacagctcggagaatgccgcctcaatggtggcgatattgccgccgtggccgttcagaaacaggatcttgtcgaaaccatgcccggccagcgaacgcacccagtcgccaatcgcggcgataaaggtggaagggcgcagcgaaatggtgccgggaaaacccaaatgatgctgggccataccgatattgaaggtcgggccgatcaggatgtcggcgttcttctgcgcctcatgggcgatgatctccgggcacatccagtcagtgcccagcaggccggtggggccatgttgttcgttggagccgatgggaatcaccaccgtgcggctgcgttccagaaactgcccgatctcgatccaggtggagtggtgtagaagcatgcgacgctctcttttatctgtggggacaggctaaccaccacggattgtacgactactcgccacctgttggggcttgcaattgagataggttgaggacttcaaccaatgctggtcggggtaccaggaaaacatgaactgcccatccttgagcttatccaccacctggcgcgccacctgagggcgtacggccgggcaaccctggctgcggccgatgcggccttcgcgcttgctccataaggggcttacgtagtcggcggcgtgaatcaccagtgcgcggtcgcgggcctgatcattgaaacccggctccaggccgtccatgcgcaacgagtagccgtgggtgccgaggtagctttcctgggtgcggaacaagcccaggctggactggtggctgccttcacgattggaaaattgggtggcgaagttttccccggattttgccccgtgggccaccaggtcgcgcagcaccaaagtctttttgcgtaggtcgaagatccacagccgacgagcggtcgagggttgggagtagtcaataaccgccaggcgttctgagcgttcctcgccattattgaccgcgcactgcacggcgttcagggcgcttttcagcacggtaggattgagttctggagccgagcgcgccaggctgctatacaagttaggagtattcccattggcggcgagcgcaaaattgctcagcgcggccagggtgacggtgatcaaaccgaagcggcacatgaaagtcagcatctacaaaacgtcccccgctgtggattggagccagtcaattgttcaaaaaacacgcatgttacttgagcatttgcctgctcgttgcaccactggtcgcgacagccgatgagctgcccgtgggcgccgtaccggttatttcagccagcccgctgcaacaggcccttgcgcagttgcccagcgtttgccccagcctcgccccgcacatcgacgctgcggcccaatcgcgcctgcaagcgttctaccagcagcagggtgatgtgccgctatggtccgccgatgatcgccgccaagccctgaacacccagttgctgatgctcgccgacgacggcctggaccccacccactatagcctgcctgcggcggacgccacggccaacgtgctgtgcagcgatatcgacgtcagccgccagtacctgcaagccctgcaggatttgcattacgggcgtttgcagcaatcgcgcttcgaaccgctgtggcattcccagccgccgacccgcgacccgaataccgaggtgctggccttcgccgccagtggcttgcaaaacatggcccaagccttcgaccaggcgcgccccagcgccgacctttaccgcagtttgcgcaatgcctatgccaccgtgcgcctgcaaccgctgccgcattgggacccggtcgccactggcccgttgctgcgccccggcatggaagacccacgcgtgccggagctggcgcaacgcttataccgtggcggctacctggccaaggcgcccaccggcaatggcaagcaataccgtgacgaactggtcaaggcggtcaaagccttccagctcagccattcgttgcaggccgacggcgtgatcggcgcaggcaccgtggccgagctgaatatcagcccggcgatgcgccgcgatcagttgcgcatcaaccttgagcgtttccgctggctggcccaggacctggagcctgaaggtgtgctggtcaacgttgcggctgcgcaattgagcgtttaccagagcggcatccccgtgtggcaaacccgcctgcaagtcgggcgcgccgaacgccagacgccgctgctgaagtcgcgtatcacccggctgaccctgaacccgacctggaccatcccgccgacaatcatgcgcgaggacaaactcccggcgatccgcctcaaccccgagtatttgcgccagcaaaacctgcaagtgctcgaccccgaaggccgcccgctggcgcctgagcagatcgactgggcgcgccccggcaatatcctcctgcgccaggacgccggcccgcgcaacccgctgggcaaaatcgtgatgcgcttccccaacccttactcggtgtacctgcatgacacgcccagccagccgctgtttaccaaaggcccgcgtgcgttcagctccgggtgtgtgcgggttgagcaaccgttgctgctgcgcgacctgctggtgaccccggccgaacgcacgcgcaccgacgaactgctggccaccggcgtgacccatgaattcaggctggcgacgccggtgccggtgttgctgggctactggacggtggaagtcgatcgccagggcgggctggtgtacgcgccggacatttacgggcgcgacccggtgttgatgaaggcgatgggggcggtgctttaggggggtgggcttcctgtggcgaggaggggggggccgcggtggggggcggaggaggcgcagaagc

SEQ ID NO: 65 - DNA, 56370 bp, Pseudomonas poae FL10F
accttcgacgtaaataaccctgactacggggcataatgtgtccactatgtcctcgcacaggtgtcaaccatgtgtccggtccgtacaaacagcgcaaaagtaagcaaaacgctcttgccccaccactcggcacctcgcctaggctcggtgtgcccgcacgcaggcttgaatccgtgggccgccgcaatgggccatccttggcccagcgcggctaacccggcgtcctgccgggttacccacggattcaagcctgcgtgcggccagcgtggtttaacggggcgcctaagatcaagatcaaaagcagagcacggcggcctggtagccgacctgagtggttggatcaaaagcaaggccgaggcggcctgacagccgacctgttcattgaaactgtactcaatcaactgtgggagctggcttgcctgcgatgcaggcacctcggtgtatcagacataaccagttgatgctatcgcaggcaagccagctcccacagaaaagcaaagcacagcagtctggcagccgaactcggtcaaattgtgggagcgggcttgctcgcgaaggcggagggtcagccagctcatctgtcactgatacaccgcattcgcgagcaagcccgctcccacatttggatctcagtacatcagctagatgtgcttttgccctgcttttgccctgcttttgccctgcttttgccctgcttttgccctgcttttgcttcaaccactcaggtcggctactaggccgccgtgctgtagattttgatcttgattttgatcttaggcgccccatcaaccacgctggccgaacgcaggctttggagcgggggtaaaccggcaggacgccggtttagccgcgctgggccaaggatggcccatcgcggcggcccccgctccaaagccggagtgagggcacaccgagcctaggcgaggtgccgagtggtggggcgaggactttttggttactttttggtccctcaaaaagtgacccgctgtaagagcggaaccctaagtggccgttaccgcaggaatggatatgtactcggcctgatccagccccctggtcggctgtcaggccgccatcgcaggcaagccagctcccacagttgatcggggccgtcaggtgtagacgggccaggtttcgacgattttgccaccgcgcaccgccagcagatcaccgaactgcaacagcacaaactcactctgggtcggccttaaaaaaacctggtcttcaatattcaaccccaccgcaggcgagccgttgaccatttcctggttggagctgcgcccatacagctcattgctttgcagcccatgtggcgactcaaactccgccatccagttaccgccgtaaataaagtaggtttcccgctggttcgggtcccaccacgaaaacacccgcgacttgccgtccagcgccggaatcgtcaccggccctgcacttttcagcactggcgtggcgataaaggctgccggcacgtgttcactcaaagagggcagatcgtaatgggtgggcttgagcaacgccgtgcccaccgacacttcactgctggtgcgctcttgctcgtggatgcgataactcgggctgccggcggtgttcaacgtgaggccctcacgccataacccggcgaagtgctggcgggtgaaatcgacgtagccgttgtagcgctgcatcacctgttcgaacagcgtctgaggcgaacccagaatgcccggcacgcccatgcccacaaacgggtcgtagcccataaagccggcaaactccaggtgctgcgcattggcagtgatcaacccgagcatctgccccagcaccgcgttatcgctgaccccgccacgatgcaggcccacatccaactcgatattcacgcgcaaccgcgtgcccagcccttgggccagcgccaggtagtgctgcacgcgctccggcgtgtccagcagccactgcaattgccgcgacgggtcgaacgggcctttatgggtttgataaaacaactcggccgaacgcaccggcagcggcttgcccatcaagatgtccgcctcgggaaacacctgcgcatcgtgattcagaaacggctgatgaaacgacatcaaccgctgggtgcccgcacgcttggcgatgtaggccagcaaccgcggcgacggcaatgacttctccaccaggcgcaggtgcttgccgccacgctgcaccgactgcatgaccacatcgatattctgatccagccggtcgaggtcgatcagcatcaccgggcgcatcggcccatgggccttgagctcattattgagggtgcggaaatactcagtgtacgggctgccgcgatcactcgggcgcagccaccaggcaccggccgccgcgaccgcagcgctgcccagcagaaaatgtcgacggttcatcaggccactcccaggatggatgacaggtgcgcattgaggaatttgccgctcgggtccagctcgcggcgcacgcgggtgaattcgtcccaacgcgggtacaacggctgcaaggtgcgcgcattgagggtgtgcaatttgccccagtgcgggcgcccggcgtacttccagaaaatcggttccacggcggcgaagaagttgtgatggtccatggcgtaatgttggtggaccgagatcgagcaactgtcgcggccctcgaacatgctcagtgggatgtcatcggccttcacatagcggtactcgatgggaaaccaggtgcgcaggtccttgtcggtgatcagcttgaggatttcgcgcaggcacgccgggccgtgttcagcgggcaccgagtattccatctcgttgaagcgcacgttgcgcacgttggcgtagacctggaacgactcggccacgcggtcttcgaagctggcgaaaaagcgcaggctgttgagcaaggtgcggcgggtgtcggggaagtcgctggcgtatttgtcgagtttttcgatgaccgacacaaacgcattaccgcccgcctcggccgggtcaaccgggggtgtttcagggtcggtggtttcgttgagggcgatggacagcgcgtagtcggaatgggtcaccaccaacatttcccagtgctggttttcccgggtgtttttgtcgacgtcttccagcaactcttcggtcttggcgatccattggcgttcgcgcaggcggtacggtgcgcggttctgcgagcggatctgggtggctacgcccaaggcgccgagggacactcgcgcggcactgaacacttcgggatggcgctgggcgtcacagtccagcacctcgccctgggcggtcaccaattgcagcccggtgacgcagcccgaatacgaggtgaagcccacgccggtgccatgggtggaggtggaaatcgccccggccagggtctggtaatcgatgtctgccatgttcggcaacgcctggcccaccgccttgagcgccggccccatgcgcgacatcggtgtacccgccgcaaacgtggcttgcagcgtcgccgggtcgtggtcgagcaacccattgaagaaactcagcgacagcaaggtgccgtcagtcggcaccagggcactgaatgaatgcgccgagccgaccggccgaatcgtgctgggcgcctggcgaatcatctgcaccaattcatccaggttcttgggcgccaggcgcgccagcggcaaacacgtctgcgcccccgaccagttgcgccacggaatcaggcgtggcgcgcgggccagttgggccagcaccgggttgccggtcagcgccagaaatgcccccgccgccgccgttcgctgcaagagttgccgccgtgaaagcgccatccatcaccccttttttattgttggatttgaacaccggccataaagctgatcagcgccaggaactgctcttcggaacactgcatgcacaaacccatcggcggcatgccgttgtagccgttgatgctgtggtccagcagcgtgtcggcgccctgggcgacgcgcgggctccaggcggccttgtcaccgctcaggggcgcgccggacgccgggttggcgtggcacagcttgcaactggtgtcgtagacctgggccagtgccgggtcggcgggcatggcagtggtcgcagcagcgcgttcggggggaggttttggtgggttgtcacaggccgtcagcaggcccagcacagccaacaataatgcgatgcggcgcatggccaccctcttttcttatgatgtggaagcggtttccacactaaggcagcgatggcgcggcgttgagggttttgggggacacaaagggggcttgatcggacagtcgaatgcggggcgttggccaccccgcattcaggggtacgcttagaacgcgataccgaccttgaaaccgtactcgtcacgcttgagcttggtgttgtcggccacttcagagtcttcgtcgagcttgtattcggtacgggtgtagtacaggcccgccatcaccggcaggtcgcccttctggttcatcagcaggctgacttccgcatacgggttggtgcggtccttgaggtccacggtgtcgctgccaacgtcgtcgaccttgagcttggcgcggccgtcgatggtgcgacgggcaccggcttcgacgcgcagggtcatgtcatcgaactggtggttgtaacccagggcagccttggcgaacggcgatttgttggtgagcttgacgtcgtagtcgttggtgtccggctcgtagcgggtccagctgtagccgccgcccacaatcacgtcgacaaagttgcgcgcgtccagcgcggcacgccagccgaggtccaggtcagcctggccttccttgagtttgttgctgctcttttcgccgtatttggcttcgacgccggcctggtagataaagccggattcagccgtgagcttgttgccgaagttatagaacaggcccgcttcgggcatgtggtccttgtcgctttcgctaccgccttcaagtttgaagtcgttgtagctgccctgcaggccgagtacggaaatcgggccggtggacggtgcagcgaacaccatggcaggcgcagcgaccagcgccagcagcgaggaacccttgaggaattttccgaatagcttggacatcgttttacatctccttgtctggtgagcaaattattcaggaaccgcttcgaacctcggcatttgcgaaaggttcgaattaatttgcgtcgatttggaggaaaaacggttcagcgcaggctctatctcaaccttctttggaatttgccattattaagccattaactatctcgcgtaattgcggatgtgccggcaagcgaatgccgaaggtcccctgcaataacgtcagcagctcatcggcactctcgatggcgcgcttttcactgggccggtccaggtaatggacggcgtagttggcgttattcaacgtatggcgtttacccacggccaacagcgctgccttcaactgaccgacaaagaccgaagccgggtgcgtcgacacgtaccagttgccgatttcatagtcgatatccgcctgtgtctgcaggtcgaacacatacaagccccgccattcctcaccgacttgtgcccacagcgtgtaggcgccgtcattgaacgtcagccgatacggctcatgggcggtggcctgggtcgcatcggtgtccagctgcaacgggctgctcggcaccatgccgccaaagccgacatcggtgacgtagcgcacgccctccagcgtaaccaggctcagccgatgggtacgcccggtgcgcgcgtccggcggcccgcccatcaccacccagccggtaaggccgcgcgcgtcgaaacccaaatcctgcagcaaggccagaaacaggtggttcagctcgaagcaatacccgccacgcccgtcgagcagcaccttttgctcgatgctgggcaggtcgatcggcaccggcgtgcgcagcaacgtcgacaagctctcaaaggcaaacgtgcacacatggcgcaattgcagttcctgcaaggtttgcaaggtgggcggtggcggcgagtcgtagcccaggcgttgcaggtagagctggcgatgagtcaaacggggcatggcgcgatccttgggcgcgtgacgaaggcatcactatgcagcgcaagcaggcgacttgtcattttgactgaacctttttcaacgctcgcctatccatctataacaagacagggaggcaacatgagtaccgcaaaaatctacaccatcaactatcagctgcacggtcgaccgaagtcctttgtggtgcgcgccgaagtaatgaacaacgccgaagcctggcattgggcggcggtcgatgccgacatcgctcacgtcagccgcattgggcgtgtgggtcacgaacaggtgaagaaaaccacccggccctgggcggaaaagttcggtattaccgacgtcacctggatcgcgcccaaataagcagcccctaactaagcaaaaaccccgcacagtggcggggttcgcgttacttcttcaagtcgcccaacggatcgtagggcggcttttttttggcttcatctttatgtttctgatccagcggcgcgatagccgggccgatggggtcgacttgcgggtcggatacatcgggggagtccgggtcgaagcccagttcatccttgccgctggcatgttcgcctgaacgcgggcctttcggtggattactcacagtgctctcctcagttacagcgggcgggctttgtcgtgcagggcttccaggtcttcctcaacctgctctgcctcatcatcctgacgctccgccgggtcgttggggcgtaacgcatcgttgtcgcgctcctcttctccgggtgtgcggtcagggtcgggcgtacccggcggcggttgcttgtattcgggcatgatggttcacctcacgggggattggctggcctacacgggtttagagaaagcgccgcaagccatcgttcaacttgattgcgcaaagcatgcgaagatgccaccccgcccttcttgagacctgacccggatgttcgagctcaaaccctgcgaccccgtgaccttccgccaacagacgcgccgcagcacgctgatcatcgccgtgctgttcgtggccctggcaatgctgctgtcgagcctggcggtgatgctgttcggcgaacccggcggggacaactttcgcttcaatgtcggcggcgtgtttgccggtgtcttgatcaccgtcgccctggtgcgcgggccgttttggacccagccctggttcgcgccggcggtgtatggctggcagctcaagcgcagcctgatgagcgtgaccaacgtgatgcacaccgtcacccaacgcgtgcaggccaacgacccgacggcgatcaagctgctgcgcttctaccatttgggccttacgcagatgcatgagctggatgccaattccagcgcccaggcgcaattggttggcgaggtcgaggcgcacaaagagaagatgcgggcgctggggatcgtcaccgagcaaacccgcctcgaccccgcctggcttgaacatgtaaaaaaagcctgacctcgtcagtaggcaaccttggctcgccagcagaacaccgcgctcaccgcaatggccgcgcccgctgcgccaaacacccatggcgccgaggccaccgggagcaacaagcccgccagcaacggcccgaggccagcgccaacgtcacgccacaccgcgttggaggccagcgcggaaacgcgcatcgagccggggttgcgctcggccaccaaggtggtcaccagcggcagttgcagcgcgcgcagcaccagcaccgcggcggcgccgacgatcacccaatagctgccgaatgcgctcaaggccagggcactcaagaacgaaaacagcagcagcatcgaggtagcgccgaagcgttgtgccgcgcggccacccaatgggctcaggagcatttccgaggcgtatcgcagggccatcaggccaccggcgatcagcaccgcatcgccgccgagaatcttctgtgcctggatcgacaggccaaaaataaacagcccgtccagcgccacgccttcgataaacgaccaggtcgccacgctgtcgggccacttgaaacgtcgcccggtgctgtgcaggtcatgcccggcggtgggcaaaccgcgcgccgcccacacgcccgccaggcagcagccggcgaggatcataaagatcgggcgcggcccggcccataaggtcaaccagccgcccagtggcaacgccagcattggcccgagggcgatcatcgcccttgagcgccctgccctgcgcgcggcgccagcgggttcggaggtcgccaacacttgggtcgacaggttcagcgcggcaaaacacaagccccagatcaaccgcagcccgagcaatgcggcgaaacccgacagcatcgagttgcccaaggcgcacaccgtggcggccccggcggcgatcatgcaggtcagccgatcaccgttgcgcgcgtagaaattcagcacatgccggtagccaaaaatccgcaccagccggttagccgccagcagcaccccggcctgggccagtgtgatgccaaacgcctgggattccatcggcagcagcagatagagcagcacgtcactgggcaggcataacgcgagggtcagcgcggcgcgtcgggaggtcgtatcagcagtgcgttgggccaggctggacataaatctgaaacatcccgaaatactcaggccgccacgttagccttctcgtgccgggttttacaacgccccatcaggcttttttctcatagggcaacaagcgcaagccgctggccacactgcccactaacgcgaacacgcaacccaaccacagcgcgtattgcggaccactgcccagcgacaggtggaaacagaacgccaccaatgacgcccccagcgtttgccccagcaaccgcgaaatcgcgacgatgccactcgccccgccgctgcgggccaacggcgcgctggtcatgattgccttgaggttgggcgattggaaaaacccaaagccggcgccgcacaaggccatgcgccagccgatatcaaaggccgacgcgccactgcccaaagtcgccagcgcagccatgccggcgctgagcatcaacaggccgacgccgcacagcacgcccagcgacacgcgatccgccaggcgccccgccaccaaggccatcacagcgaccacggccggccacggcgtcatcagaaaaccggtttccacctggctatgcccgagcgccgcctgcaacaggaacggcaacgacacaaacgccaggccctgagcgctgaacgcgcagatcgcggtaagggaagacagcgcaaacactggccgcttgaacaggtcaagggccagcatcggcgccgggtgaccggcctggcggcgcagcagcaacgcgccgcacaccagcgccacggcgatcaggcccaacgtcagtgcgccctgggcaccgtgcaccgccgtgcccaggccgagcaccagcaaggcgaacaacccggcacacagtgcagcggcgagacggtcgaaggcgtggccggtcatgggcagcgtcggcaatgaacgcaggcccaaccccagggccagcaaacccagcggcacgttgatcagataaagccaatgccaggtggctaccgacaaaatcgccgacgccgcagtcggccccagcgtgaaggccagccccaccaccagcgagttatagcccagcccacgccccaacatttttgacggataaatatgtcgcagcagcgccgtgttaacactcatcaccgccgccgcacccagcccttgcgccacccgcgcggcggtcaacgtcagcaacgacccggccaacccgcaaaacagcgacgagagaataaacagcagcaagccaccgaggtacacccggcgatgcccccacacatcactcaacgaagcaaatggcagcaccgtggcgataatcgccagctggtaggcgttgaccacccagattaccgaggcggagtcagtgccgatgccttcggccagcgtcggcaacgcggtgttgacgatggccgtgtccagggttgccatgccgatgcctaaagaaagggcgatcaccgccggcaggcgtttattggagggcaacccatcggcaacagaagacatggacaatccagcgctggtaacaaaggcctctagagtacgggcagacgcggattttttcagtggccaattgcctggctgtcagaattttcatttaaaccgtcgatttattgtggccagacgcttgttgtggcgagcgggcttgtagtggcgagcgggcttgccccgcgttggagtgcgaagcgctcccaccccagtcacctcggtatttctgacagagccggttggttgcctttggggccgcttcgcagcccaacgcggggcaagcccgctcgccacaacaagcccgtttgccacaaagggccccgttactcactcgccccaacacccacaatcaactcactgcccaaccaccccgccaggtattcaccggcctgggccacgcccgcctcttcccccaatcgcgccaccagaaactcacacagcccggcgaaactgccgtcgacctgcaagtgctgcaaggcgtgcaactccagcgcctgcacctggcgcaagcgcgaggtgaactggcgccgccataccagcaggccgcccgcctcttcgagcatcgtcgcttcgggcgcgggcgtctcctgccacagcgccgaccagatgctctcggcattggtggtcagggcatggcagcgcagcgacggtgtcagccgcaaaatggcggtgtcccagtccaactcagccaacgcttgcagcggcacaggcgacgcatcggcggcgacaaaggcttcgttcaaggccgactcgatccaggccaactcatgcacgtcggggttacgcggaaacagcgtcttcaacgtcgcgtagaaaccttcaggataagcatccagcgtccaggcatgcggcggatgcaggtcgatatgggcaatgctagccgccagaaacacctcgtcgccgagccaacggcgcaggttcggaaacgcttgctcaaggcacccgaccaactgcgcgcggtagttattctggtacaccgccaggcccgcgcggtgattgcccagcacctgcgcggcgtcttccgacgcactcaccagccaggtgtgaaaggcctgctgccactcactcaggttcatcgctgcgcccccaactcgcgggccatcgacagctcctgaagcaacgcggccagcggcggaatctcatcgtcgcgttcaatcattaccgccactggcccaagcaccttaatggccttggcatacagttcccacaccccggcacacaccggactgtcatggctgtcgatgagcaaatcgcggccctggctatggccggccaagtgcacctggcgcacacgttcggcaggaatgccctcaagaaacgccagcgcatcgaagccatgattgcgggcactgacaaacacattattgacgtccagcaacagctcgcagccggtgcgccgggccatggcggcgataaattcccactcgcgcatggatgcaccgtcgaaggccatatagctggacgggttctcaaccaacagcgtgcgacccagcacttcctgggcctggtgaatattggcgcacacccgctccagcgcctcctcggtatagggcacgggcaataaatcatgggagttgaagccgccactgcgcgaccagctcaagtggtcggacacaaacagcggctcgatctcatccaccagcgacttgagccggcgcagatagtgcgggtccagcccttcagcgctgccgatcgacatcgacacgccatgcagcgccaccgggtggcgctggcgaatctggcgcaggatgtgccgaggctggccgccttcgaccataaaattctcggagatcacttcgacaaaatccaccggcaccgaggtctccaggaagtcgcagtagtgttccttgcgcaggcccaggccgtagccggaaaaatgtgggttgggtgttggcatagcctgttctccatcaactgcaggagcgagcttgttgtggcgagcaagctccctcgccacaacaaacccgcacctcacaagggtgggtgagttacttcggctcagtcagcgtgccgccagccttgaggcattcggacggcgtcttgacgatcacgccttcgcctttgcagctgttgaggcccttgcagtcgtgcttggcggtggcgcacaggctttcgcccttgcagctgttgacgccgtagcaacggccgggtttttcctgctggtcggcggcgctggcggcactggcgaatgaagccgaggccatggcgatcagggcagcagcagcggcgaggctcaggcgggatttgagtgcagtgttcatggtgttttccttttttcgggggagttatttgatgacggaagcagcgtcttcgatgaccttcgccacagcctcaggctgggcgatgtacaccgagtggctgcccttgatttcagtgaccttggaaccggcacgctggtacatccagcgttgcagcgcggggctcagtgcacggtcttcggtggagaccaccgcgtaggtcggcttcttgtgccaggccgcagcccacacggtgccgccgaacagcgcggtggtggcaggcacctgggaggcggccatgaaatcggtgcggttggtggtcaggtcggcggcaaaatctgcgttgtacttggttcggtcaaagaacaggtgaccgtcgcggctctgtttgatgtcatcgctgggcgccggcatcgagccgatcagttgggccatgttctcgcccacttccggctgcagcgccgagacgtagaccatcgacttgaccttgtcgcggtcgccggcaatcgagatcaccgcgccaccggaactgtggcccaccagcaccaccgggccgacttgttgctccagcacttcgcgcgcctcggccacgtcggcggccaggttttcgtggccctggtgcaccacggtgaccttgtagcccttgtgaatcaggatgtcgtgcaccacacgccagccggaaccgtcgacaaacgaaccgggcacgattaccacgcttttaccggtgccgggctgcgcggtgtcggccgcctgggccagcagtggaacagtcatggccatcgcaacggccagggaagaaagcatgcgcatcgggaatctccatcagggttgtaaaggtttaccgaacagcaggcggtccaacgaccaggccccaccgccagcggccagcagcggcagcaacagccccgcccaggtcaggtgcaccggccaggcgtcggggtacacaaacgcctcgatcaccagggtcatgcccagcagcgcagcggcggccgggcgggtcagcaggcccagcaccagcagcagcgggaacaggtgttcggcgtaggtcgccaggtgcgcggcccaatccggcgggatcagcggcaaggcgtattccgagcggaacagcgcgtaggtcgacggtttaagctcaagaaaccccgtgaccttggtacgccccgacaggaagaacaccgctgcaatcgcgacccgcgccaccagcaacagcagggcctggggcagcagccgctggatcacggttgttccgtcaggctgccgtagcctttaggggttttgatctgggtgcaggtgcctttgtccaccagcacccaggcattgccctggtagtcggcggtggcggtgccggcgcacgaagtgcccttgccggcggcgcaatcattggcgccggcgagggacacgccgaagcatttttcctggggcttgggctcatcggcatgagccaccgccgcgaaggcgctgagggacagggcgagggttgccgcgagggcagcgtagggacgcttcatcggtgtatctcctggcttgactgagtgtggccagggcgcgagtggcggtgagtgaccgccggcgccggctggtgaacagagttaaagccaggcgtgtatccgctctgtgtcgcaaacacgacagaacgtcatgccggtgtatcaaggtggtgcggggatacagtgcgatacacagtcaataaaacgctgccaaatttccgcccatttattcggcatcccgaacgacacaattagaaatattcgcctttccgaacggtgcctcccaggcgccgccaacgaccgcaaaaatcaccataaatttcatgaggttgttgtcatgtttgttacatgccaactggcatacattctgctttatcactatttctagtaataaaatgtttcagctttgagacagtctcatccactgaaacacgacccgtgacacgccaataaaaacgacaacgccccaaaggagggcgacctttccgactttttgatcgacatcaactttccaagactgctgctgcacatctgcaccccaaaaagggcgaatggcctgatcgccaataacaagcctgactataaaaaggacgaattgatgagctcgagcaagaatcacgcagtgtcctgtatggacgcagaccaccaagccccaaataccggcgataacgtcttgggctttggccccttcctgttactggcacgccagcacgtgttgctgcgcaacggcgagcccgtcaccctggggagccgcgccctgtacctgttgatcgccctggccacccgcgccggcgagttgctggagaaagccgaactgatctccttcgcctggcccaaggtggtcgtggaggaatgcaacctgcgcgcgcagatcgtcgccctgcgccgcgccttgggcgacgacggcaacttcagttacatcgtcaccgtaccgggccgtggctatcgctttgtggccccggtgaccgtgcaggcggcgggcgaagacagcttgccggtgcccgccccgcgcagccaggaaccctgtgccacgccgccgtcctttgaggtgatcggccgcgatgcggtaatcgaaagcctggccgaacaagtgctgagccaacgcttcttgaccctcaccggccccggcggcatcggcaagaccacggtagccatgggcgtggcgcacaagttggcgaatgaacttcaactggacacctgtttcgtcgacctcgcacccgccaccagcgggcaatgggtgaccggcatgctcgccagcgccctgggcatccagaccgtcagcgacgatccgctgcacagcatcgccgctaccctcgtcaagcgacgcctgctgctggtgctggacaactgcgaacacgtgttgccggccaccgccgacgccgtcgaaaccctgctgcgcagtgcgcctcactgctacgtgctgaccaccagccgtgaaccgctgcgcgccgagggcgaacgcgtgcacgacctggcgccgctgcaagtgcccgacgatgggccgcacctcaacgccgccgaagccctgaactggtccggcgtacgcctgtttgtcgaacgcgtgcgcgccctcgaccccgactttgtgttcaacgacgccgatgtggcggcggcctgcgcgatctgccgcaaactcgacagcaacgcgctggccatcgaaatcgccgccgcgcgggtccgcaccttcggcatccaggacctggtcggcctgctcgacggcagctttcgcctgcaaatgaccggccggcgcaccgccctcgcccgccaccgctcgttgagcgcgaccctggactggacctattcgatgctcagcggcgacgagcaggcgatgttacgccaactggcggtattcaccggttcgttcacccttgatgcagtcaaggcgatgaccacccacagcagcctcgacccacgcaacgcgctgcccttgctcgaaagcctgatggacaagtcactgctgatcgccggtgagtcgcagttgctcaagcgctaccgcctgctggaaaccacccgcgcctatgcccaggaaaaactcactgagcatggcgaaaccaacgccaccgcccaacgccatgcccgttacgcccttggcgtgttgcaggaggctggcgaaaccctggatggcctgtcgccggaaacctggatcgcgctgtacgggcccgaaatcagcaccattcgctcggccttggactgggcgtattcggccaacggcgagctgcccctgggcatcgagctgaccctgggcggcgtgccgctgtggttgcgcctgtcgctggtcagcgagtgccgtacctgggtcgaaaaaggcctggccagcaacgccatcgcgccgttgccagtgcgccaacgcatgctcctgcaaaccgccctggccagtgtgttgatgctcacctacggcaccggcgggccgatgcgcgaagcctggcgccaagtgcgcgaagacgcccgcgacctgggcgacgccgaacacaaaatgcgcgccttgtggggcctgtggacggaccgctgcggctgcaaccaatacgctgaagcgctggaactggccgagcgttatatcgccttgaacagcagcggcaaccagcaattgctgggtaaacgcatgcgcgcggtggcgctgtttcatatgggcgacctggcgggcgcgcggcagaatatcgacgaagccctcggcgcgccgtcggcaccgcgttcgcacatcatcgacgtgcatttcgaccaacgcatcgccgcccgttgcctgaaggccaaggtgttgttgctggagggtgatgtcgacgcggcgctgcgcttgatcagcacctgcgtcgacgaagccatctcactcgatcacccggcgacgctctggtacaccttgtgcctgggggcgattcctttggcgctgttggcctctaacttgccgaaaatgcgttattacctgggcctgctgcaagacagcaccacgcgtcaggatttgcatatctggcggcagtttcgtctgtgttttgagagcatcctgctgattcgccagggttcgccggaagaaggcgtgccgcagcttggtgaggccctgcatcacttgcagggccagggtgacagccagctctatagcctgttgcggtgtgaatatgctttgggtttggcgcgcctgggtctggagaaacttgcgctggaagtgttggaggacacgctgcatttggcgattggccgccatgagcgttggtttgtgccgcagatgttgcggatcaaggcgcaactgacattgcgccaggggcactatggttcggtggacaaggccaaggtgctgctgcgtcaggcttgggtggatgcgcaattggcgggggcgcatttttggcgggcgcagattgctacggatttggcgcggttgcaggagcctaaattgcggattgcttcgttgcctcggtttcagcatcgttgattgagtacatatccgttgtttaggtgatggctgatatgggttccgctcttacagcgggtcacttttggaaaagagccccaaaagtaaccaaaagggctcttgccccaccactcggcacctcgcctaggctcggtgtgccctcactccggctttggagcgggggccgccgcgatgggccatccttggcccagcgcggctaaaccggcgtcctgccggtttacccccgctccaaagcctgcgttcggccagcgtggtttaacggggcgcctaagatcaagatcaaaagcaagagcacggcggcctagtagccgacctgagtggttggatcaaaagcaaggccgaggcggcctgacagccgacctgacttttgaagctgaactcaatcaaatgtgggagctggcttgcctgcgatggcatcaactggttctgcctgatacaccgaggtgcctgcatctcaggcaagccagctcccacagaaaagcagagcacagaagtctgaacgccgaactcggtcaaattgtgggagatcaaaatcaaaagcaagatcaaaagcagagcacggcggcctggtagccgacctgagtggttagatcaaaagcaaggccgaggcggcctgacagccgacctgattttggaagctgaactcaatcaaatgtgggagctggcttgcctgcgatggcatcaactggttgtgcctgatacaccgaggtgcctgcatcgcaggcaagccagctcccacagaaaagcagagcgcaaaagactggcggccgaactcggtctaattgtgggagcgggcttgctcgcgaaggcggtgtatcagccagctcatgtgtcactgacccaccgcattcgcgagcaagcccgctcccacattttggaactcagtacatcaggtagatgtgcttttgccctgcttttgctgtgcttttgcttctaccactcaggtcggctactaggccgccgtgctgtagatcttgatcttgattttgatctgaggcgccccatcaaccacgctggccgaacgcaggcttgaatccgtgggtaacccggcaggacgccgggttagccgcactgggccagggatggcccattgcggcggcccacggattcaagccggagtgagggcacaccgagcctaggcgaggtgccgagtggtggggcgaggactttttggttactttttggtccctcaaaaagtgacccgctgtaagagcggaaccataagccgccgttacctaaataacggatatacactcacacccaaaaccacatacccccccatttcacacctgtgaaagcttgtgcgatctcacccaaaaccccattttcacaccccaccaacgcctactatcaagccccagcgagccccctcacatggactgaaaaatgatcaaccgacccgagacagccaccgccccccgcgcaggcgaaaccaaagcccccgagcgcctcttcgacgctctgctcaacaaggccaaaaccctggcagccgccgggtcgggcgacaaaaccttcaaacccaaagtcctcgccaaaacccccggcgaaggcctgaaaccctcgggcgaaatcaaacccgacgactacaaggaagtcaccgccctgcccgccaaactcgacatcgacaaactccacatcgtgtccgaagacaaagacaccggcgtcatctacttcgaacaagacggcagcaaactcaagatcacccgcgaaagcgccgaaaaagtccaggaaggtttcgacaccctcaaaggcctgcactttggccacgcagtcgcccccgtcaaccagggcggcccggacgaaggcacaccgctctacgacctgctgcacaccctcgccgaaacccaaggcacacccgccggcaaagaaatccgtgaagccctgagcaaccccgaccaacagctgctgcgcgaagacgaccccggcgtgcgcctcgccaacatcaaatcggtgggcgaagccaaagacggcgtggtcaaggtcagcctggaaaacggccagaccctggtgatctccgaagcactcacaccccaggccttcgccagctacaacagcgcaggcgtgaccaaggaagccctcgccgacggcaaggccaaaggttatgaggaagtcaccagcctgcccggcgacctggatttcagccagcttaaagtcgtgtccgaagaccccaagtccggcgtgatcctgttcgaacaccaaggcaagaaatacatgatcagccagtccgaggccgcgctgccgcagcccggcgcggacctcagcaaccccagccccaacgccggcacgccgttctacaacttcctgcatgccgtgcacgccgccgaaggctcgcaggcgttcgactacatcaagaacgcccaatccctgcccggccaggaactgctgcgcaaggatgaggccagcctcaagctcagcgacatcagcaaagtcgacgcgcccatggacggcatcctggtggtcaacggggccgacggcaaactgctggtggtgtccaaggacattacccccgcagccttcgccgcctacaccaccaagggccagaccctggccggcatcgagaaagccaagggcgacggctacagcctggccgggccggacgcttacctggcgtccaccgaagacatcatgagcgtcggcggcgccggtgattatggccccggcctgatcgccttcacccagcacaaaccaggtggcagcgaagagaaaatcgtcgtcagcgaagacagcaacccgcagatgttcgagcagatttccggctaccgcaccgatatcgcgcagcagaccaccgatgtcgacaaattacgcgccgacaacggcctgccgccgctcaaggacgtgtccgtcgacagcctcaccaccaccgaaaaagatgacagcggcaacccgctgtcggtgcaggacctgtcgatgaaaaccctggtggacagctaccgcgccggggtcaaggacggcagcatcggcaaggacgacccacgcgccaaattcctgcgcgccgtggaagccaaaagcatggccgacaacggcatgtcgatcattcccgaacacggtttcggcaaccagggaattgcgaccacgccaatcgatgtgacctcacgcgatgtgcgcgacaatattttcgacaccaagtccatcgacaagaccatcagcgaattgctcggtgactcgaccatccaggccgacatcaaggccaaccacgacgcggccctgggcaaagtcgacggcggccaggccaaggtcgatgaaacccgccagaagctggtggacagcacctcctcagagaacttcaccaaatacataaaagccctgcaggacgacggcaagaccgaactggccacccaggaaatccagaccgcctataccgcactggccgacatggacccggccaaggccgacaacttcctgcaaaacctgcagatcgacggctacaccgattccgttgaaaagctgatggacgacccgagcaagatcagcgacgacaacaccgccctggccaccaccgacaacaccctggcgatcctgtcgatgctcaagggcggcgccgacggcctgccgcgccaggcgctcggggtgtactcaaagttcgtcgaccagttgctcaaggacaaaggcgccgccgccgacttcggcaaggcgatgatctcgttgggcgacacctggcagaaaaacggcgtgatcagcttcagcgatatcgagcacgcggtaagcaaggaaatcatgccgagcctcagcgaagaaaaccgcagctcgttcgtgaagaacctgaccttcctcaaggacaatggcgtactcggctcggtcggcggcgccatcggcatgggccgtatcgtctaccaactggcgggccagggcggcaagctggcggacactccaatgaagcgcctgggcatcgccaacgacttccttggcttcctcggcaccggctcgcacttcgccaccctgggccttaaggtctacgacaaactgcgcggcaccaacgcctacaaactgatgggcttcgaccgctccctgcctgacctgtgggccaagcctggcgagggctaccatgccctgcccaaagacgccgaagccatccagaaaaagtacttcgacctcgtcgaccaggccatggacgatggcaaggacgtgggcaaggtgctcaacagcggcggctggagtgacgaaggcgcgaagaaggtgcaggaaggcattgaaaaaggtatcgccagccgtggcggcgtggccggtgccggctttggcgccaagtttgccagcagcgcgatcaaggtgatcggcatggccaccgacgtggcgggcggcgtgatcagcgtggtccaggccgccttcaccctgcgcgatggcgtgcgcgagaaagacccggtgaaaatcgcctccggttcgctgtcgatggccggtggcgtcagcagcctggtggcagctggcggcggtgtactcaccacccttggcgtgaccgggcgcatcattccgttcctcgggccggtgggcttcctgatctccggcgcgctatcgtttgtcggcgcgatcctcagcaccattcagtcgcacaagctgcacaagatctcgatgcagaactgggaccagatccaggacttcaagcaggatggactgctcaaacccaatggcgatgaagcctatgtgtggctgcagacgtacctgtccgactggggccagcgcgatgcaccgcaggaccagagcatctttgatttccgcaaggaagaatgggacgcgcgctcgagcattcgtggcggcgatcatcggcgtgatcacccggactatatcggcgatgggaataaccgtaattccgaggactacaagtattcactgaaaccgtcggaatggaccaatgacaaccacgacattatctggcgcgtgggcgatgggtatggtgggccgtatcacgatgtagataacggctgagattaatcacacacctgggtccactgtgggagctggcttgcctgcgatagcggtgaatcaggcactgaagaggttgcctgatacattgccatcgcaggcaagccagctcccacaggttcagttgtgtcgggtcagatcaggcgggcggccaccagccaatccgccacggcctggaacgaagcatccggcaccggatcgccgggcacggttttgcgcgcgatctcggtagccagggttttatccggcgcatgcggaatgcccaaatcgtaagcctcctgcaacatcaacaacgcctcctccggcgacgcccggcacacaatcaccggcaccggcgtctcgccgcgcacatagcgcacgccaatcacccagccatcggtggtgccgatcatcatcgacgccctgcccaaccccagcttggtcgccagtgcctgcatttcattgcgctggcggcgccgctcgctcttgatcagcgggtcgccgtcgatgtccttgcgttcgcgcttggtctcgctgcgggtcattttcatgtcgcggccaaacagccagcgttgcatgatcacgtccaccgcgcccaccaggatgaaggcgcacaatacggtaaacaccagcggcttgagcaccaggaaaaacgtcgattccatgcactccgcaccacaacgtgacgactccatcagcgcctgcaacgcatgcttgccgatcacgtaaaacgcgatcgccagcacatgcaccttgatcaggcccttgatgaactccaccaggttgcgcaaggcaaaaatctttttcatgccctccgccgggttgatgcgcttgaactccggtttgatcgggtccaccgagaacacaaagccgcgcatggtgatgatattggtcaggatcaccacgccggtggtcaccgccatcaccggcaaggtgatgctgatcaccagttgctcggcatggtcgagtacccgtggccacacagtagcgaacggctcaatgtagatttgcgcggtgaggtcgatcagcgccgtgacctgggccttggcccgcggtgcgaggatggaaatgcacaatgtgcagaacaagatgaccatgcccgacaccagatcctggctcttggcgacctggcctttctggcgcgcgtccttgagtttcttgtccgtggccggctgggatttctcttcgctggtatcggccatgggctactccatgcccgccagggttttgagcagttcgacggtgccgcgaaactccgccagttggtcgagcatcaacggaatcaggaagccgatatagatgaccatcaagatactgaaaaacaggtttttcaccggcagcgacaagtcgaaaatatgcaggttcggcgccatccgcgacaggtaggcgagcatcaagtcggtgatcaacagcgaaatcagcaagggtgaaaccatcagcacgccgacgcgcatgatctggtcgaggatcgacaacaccgcgagcaacgcggagctggcgaacaccggggtgaaggaggtcaccggccataactggtagctgtggtaatagccgtcgaccatcaggataaaaccaccggacatgaagaacagcgtgatcagcatcaccgtgagcagcgtcgccatcacgctggactcgccggacgacaacgggtcgaccagttgcgccatggtcgagccgcgttgcaggtcgatcaactcccccgccacttccgccgcccagaacggaatgccgaacaacaggccgatcaggatgccgatcaggaactccttgatcagcaacccggcgataaacacgctgccgtgttcgggcatatgggtcagcgcgtcgaacaccggaaagaacatcgggattgagatggccacggccacgcagccgcgaatcatgccggtgaggcccaggcggttgaacgccggggtgatcaccaccacgcccatcgcgcggcaggcggcgagcgaggcggcgctgatcaccgggtaggcgacttcaagaaactgcgcggtaaggctggcatccatgggcggtcagcgcgtccacatgggaaagttgtccagcacctggccgcccagctccgcgacttgcccggcgagtaccgggccgagaaatacgatggtcaacaacaccgccaccagcttcaccacctggggcaaggtctggtcctggatctgcgtcagtgcctggaacagccccacgctcaaacccacgataatcgccacgcccagcgccggtgccgagagcatcagcacggtcatcagtgcctgtttcatcaatgacaggaaaacgtcctggcccatgggtcgtgcctcagccgtaactcagaatcaaaccgtgcatcaagcgcgaccagccactcagcgacacgaataaaaagatcttcagcgggatcgaaatcaggttcggcgacaccatcgacatgcccatcgccatcagcacgttggacaccagcaagtccaccaccaggaacgggatatagagcagaaagccgatctcgaaggcgcgggtcagttccgagctgacaaacgccggaatcagcaccaccaggtcatcgtcacgcaggtcggcgcgggcttccggcgaccagatggtctcggtggcctgcacaaaaaaaccacgctcggactcattcgcaaagcgcttcaaatgcgcctgcagcggcgggcgcagcgcatcgcccaggtccttgagctgctcgacatgttcgatgttgaggtcgcgcccttccacctggcggtacatgtcgccaatcagcggcgtggtcacgtacaccgacaggatcagcgcgatgccatacagcaccaggttcggcggggtttgctgcacgccaagggcgttgcggatcaggaacagcaccaccgaaatcttcatgaacccagtgagggtgaccaccgccaacgggatcagcccgatcgtcgcaacgaccaggatgatctcgatcaggttcggctgataaccggtcatggggtggcgaaactcagcaggcgcacgcccaggccgtcaccgattttcaccagttggccctggccgacgcggcgcccgttgaccatcaggtcgacgctgtccacgccttgagtgctgagctgcaacaggctgcccgcgcccagttcccgcaattgcgccaggctcaattccaggctgccgacctggcacaccagtttgagcggcaagtcatccagggccgcagccgcatccacatcagtcattgtgttctccatgtgcaaaaggggcgctttcaattcttcttgcaaccgcaaggcttcaccctggtattggcagcgggcctgcaagcgcccgtccaggtccagcagcaagcccgcgtcgtgttccagcatcagcacatcgccggggcgcaggctgcgcaattcgccgaggctcagccactgctgccccgccagcaccgccagggtctggcgcagcgcgggcaatgggtcgggctcgacctggccgtattgcgtgagcaactgcgccaccagcacggcggcgccttcactcaggtccagctgcgcgcccatggcgggttgattgccgaaggtcagctccagcgccaggctcacggcaaatgtgcgcgggtcgtctttggcttcgagcaactgcaccgggtggccaagcaacggttccagggtctcgatcaggtcgagtactgccagttccagcagcaacgaacgcggcagcgagggcaacagctgcacgtcgaattgcagcgccaacggcaccagcacctgttccagtgcggccgtcgataaacgcaggcgcaccggcgcgcggccgagcaacagcagcacatcgcgtggggcgttgaggctgtgcggctcagcggcccacctcacgcgcaggtcttgcccggcgcagcggccctgccaggcgcgtcggcgccgatgcaattggttatgcaaatccagcaacgccgggtcgtagtgcgtcagccacggcgccagagggtcggcaagggctgggatcatgtgccggtgccttcatcgcgtaactcaccgacgcggcgctcggcgctttcgcgtccgtccagcaggctttgccaggcttcggactggcgctgacggttcaggcgttcctggcgaaacaggtcgcgctcgcgctcctggctttgcagggtggtggacacgtgggtcacgtcgttttccagcagttgctggtcatccgacaggccgcgcaaacggtcctgggccgcctgccaactggccaccgacaagccttcggtaagggacgcatacacctggcgcgcctcttcggcaatcgcctcacggtgcaggcgcagttgttccttggcgtcggtcaacacgccgtgggtttgcgcgcagcgttgctgttgggcagccagttggctggcggcgcgttgttcacgcagcacccgcaggatttgcagggtgcgtagttggtcagttttcattgggttcactccttccttaagcctgcgtgacaatctttagatccatgaagatcaaaggtgggagctggcttgcctgcgatggcggtgggtcagcttgcccttgtgtgactgatggatcgctatcgcaggcaagccagctaccacagggttttgtatggggctgaagttcactgctgttcattgatctcatgccagcacctggcgcatgcggaccaaggtctggtccaggctgctcggttcgccggcgttctggcgcaggaacgcttcgatggccgcatggcggttgatggcttcgtcagccagcgggtcgctgccggcggagtactcacccacgcggatgagcatttcgatttcgccgtagcgcgccatcagttcacgaatgcgcatggccaggcgtttgtgttcttcacccgcgacctgctccatcaagcggctgcggctgcgtaatacatccaccgccggaaaatagttgcgctgggccagttcggcgctgagggcgatatgcccgtcgaggatcgaacgcgcttcctcggccaccggatcactggcggcgtcaccttcggtgagcacggtgtacagcgcggtgatgctgccggtggggccggggccggcgcgctccagcaggcgcggcaaggccgagaagaacgacggcgggtaaccgcggcgggttggcggttcgcccaccgccaggccaatttcacgctgggcacgggcaaagcgcgtcaggctgtccatcaacagcagcacattgcggccctggtcgcggtggtactcggccagggtggtggccacaaatgccgcacgcacgcgctcggccgccgggcgatcagacgtcgccaccaccgccaccgtacgcgcgcgggcctgggcgtcgagttgcacgtcgagcaactcgcgcacttcccggccgcgctcgccgatcaggccgatcacaatcacatcggcttcgctgttgcggatgatgctcgcgagcaacgacgacttgcccacgcccggctcaccgaaaatgcccatgcgttggccctgggccaaggtcagcaaaccgtcgatggagcgaatacccagcgccatcgagcgcacaatcagttgccgcgaaaacggcgccggcggttcggcgtgcagcgggtagcgctgcagggccagggtcggcgggatgccgtcgccatcgaggaaatcgcccatcgggctgatcacccgcccgagttgcgcatcgcccaccgccacgccgagggtttcgccggtggcagtgatttgcgtgcgggtcgacaggccttccatcgagccgatgggcgacaggatcgcctcgtcgccatcaaaaccgatcacctcggcgctcaaactgcggccgctgccagggtcgcgcagctggcacaactcaccgatgcttgcgccggcgacactggcgcgcagcagcacaccacggatgctcaacacggtgccgtgcattggtcgtatacgcgcctgggccaagcgctcagtcaggcgcggcagcaattgctcaaggttcatgccacgccctcttcggcgaacggcaacaggctgcgacgcaggttttgcagttgcgcttccaggcccagctcgacggagccagccgggctgttgaggcgtgcctggccggcactcagctgttcatcggcgtctacggcaatcgccaggccttcgtgcttgaggcgttggcgcaaggcctcaacctcggcaggcggcacccacagggtcagcgcctggtcctgacgaaacgcactcaaggcctggcgggtgcaacgcaccacgcgctcggcgttgtcgagttcacccaacacctcgcgcacgatgcccagggccagatcggccagggatgcctccaggctgctcagatagtgctgcacttgggactgggtttgcaccagtaactgcgcgacttgctccgcgccttcttgccgcgccgtttcaaaaccctcggcgcgcgcggcttgcagccactggtcgctgtcggccttgacctgctcggcctgatccttggcggcctgcaaaaaggcaaaaccgtcggtccacaacgcggcttcttcggcacgcaggatgcgtgcagtgggacggctcggcaattcactcatcggttttatcctcggccatcagggcggcggcggcggcctggacgatctccaggtcgcgcggcagccgtgcgctgtggccctgggggaaggcgaaacgcaaacgcatccagccctgcaaatcggcctgctgggcgtgcagccaggccgccacgcagccctggccatcgcggtcgatggcgtcgatcagctccgcaggctcgcgcagcaaatccgcagcaccgcccagttgtcgcaaggccagcgcctggctgaagacctcggcgcccaggccttcgcgcagttcattgaccacgtcgcggcgaatctcgcggctcaaggtcgaggcgtgccagatggcgccgcacaacctcggcaagcgcgcaaattgcgctggtgacagcaacaacaccggcaggtcggccgccaagggcgtcaccaggtattccagcggggccagctgatagtggctgaccagcagttgttccaggcgctggcgaaaacgaggctggttttgcatcgcgtgcagcacatcttccggcaggtcatcagcaaaacacgcgcccaggcttggcgcgcgcacgaactgcagcggctcggcgatcagcccctgccagcgttcaaacaaactcattcaccctccttgagcacatacaacgcctgggattggcgccgcgcccactgctggcgggccaatacgccgagcgcgccaagggcgaccagcagcaagccgccaaacataatgcgggcctgggtgaggttatcttccagcaaccacaggcccataaagcgcgccagccgaggctgtgccgggttctggctgatggtcacggcggccttgatcgcggtcaccgacacgccgtcgtagctgaggccggagatgccgttggcgaccagggtcttgatctgcgggatcagcgtattgatgtcggtgcctgggtcgtaacgcaccagcaccgaggccgacgacggcgaaatcacgcgtttgagcaagtcgttgtcgggcaacaccacgtgcacacgggcggcgacgatgccgtcgatctgcgacaccgagtgcgacagctcttcgctcagcgcgtagatcatctgcgcgcgctcctgcaccggcgacgacaccaggccattgcccttgaacacctcgcccatattggaaaagctctgttgcggcaggccggcgttatcgagcagggtcatggcttcggcaaagcgctcctcatccaccaccaccttgagctggccgttgtcctgggtcttgcgctccgccgggatgccaccgcgcagcagcaccgcgaccatggcgttggcatcgcgctcgctgaggttggtgtagaggtcggtgttgcacgcctgcaagaggctggcgagcaagccgatcagcaacaggcgcagagcgcggtttgggcttggcatggcgttattgacccttgagcaaggtattggcggaaccggaaatttgcgtcgcgccgcgcaccaccatctgggtttcgatggagtaatcgaacatcttgcccagcgagtgcacgatctgatcgacctgctgttcgccgactttcttgcccggctcgccctggggcgcagcactcgcggtgcgaatttccgccgaggccggtggtggcgccgacggggtattggtgagcacatcggcgcgctcggaaaacgcccgggtgcggtcgatgaaactgttcatgcgctccatcaggcccgagccgatctggtgcgggctggcgccttcgggcatgcccttggcggtattggccatgtgctcgaacaggttctgcgaggccccggcgggccccgcaccggcggacggcggcaaagccgaagcgccggcagcgagactgatagtcataggggctccctactcgtcgtcgtcatcggacatggcgtcgttcagcagttcctgcatcttcggcatgatgatgaactggccgccgatagtgaccgcctgggtgatcagcgcatcgttgaactcggcgtcgctggtgtccgaaggtttgtcggcggccttggcgttatccaccgccgcattgaacttggcttcagggctggcgccaccgggggcgaggttgctgtctacggccgttacggacatggtgctgctcctttactgggttggggtttcggtactgacttgggcgccacggaacacccgcacgccatgctcgcgtgccaccggggcggccacgacgttgggttgcaggtgatcgacatgctgttgcaccaacgccaggtacggcggtgggccggaaacaaacacttcatcgccctcggggccattgcgcatcgacaactgctggccgaacacgtcgagggtgttcaggtaggtctgcaactggtcgaggttgagcgcgttggccttgaacagcttggtgctgatttcgtcgctggcattgaggtacagcaggttgccgtcgaagtaccaggtcaggccgttggtgctgcacagggtttgcaggaactcaccggcagtggcggcgcgaatggtgctgcgagccttgccgcgcaccttgtccgagagcaccagcggcacgtcgaggttgtggccgaattcttccagggcactgcgtacatcctgatcgaccagcacgtaggcgtagggctgggagaaccaggcgggctcttcggcggcgttggccaaaccggcgttgaacaggcataggacggccatcaaaaatatgcttacatgacgtccgccttcgcccgacgagttgtgacgatgaccaagaattttctgctcgccagtaccctgctgttggcggcctgttccagcaaacctgcgaccgataccgacaagtccctgcaactggccaacgacctgagcaaacgcggcgactacagcagcgcggccgcgctgtacgagcgcgccgcccagcaaccgggcgccggcatcgacctgtggctcaaactcggccaggccaagctcgacgccaaggacgcgctgggcgccgaacgcgccttccagcaggccctgggtttcgacgcccacaatgccgacgccctgctcggcctgggcaccgcgcaattgcaattgggcaagacccaacgcgcggtgaccgctttggggcaggctgccgagatcaatcacttgccggtcgcctatacccgtttgggcatcgcccaggtgctgaatggccaggccgtcgcggcgcagacggcgttcgctaaaagcctgagcttgcaggcggacgacctcgacagccgttgcaatctggccctggcttatgcgcttggcgggcaggcgcagcaggcgctggagaccattgccccggtgactcagtcgccccgtgccttgccacggcatcagcgcaatgagttgttggtgatggtgttggcgggctttgaacaaaaggttgccgggttgccgttggatgatattcccgcagctgagcgcgcgcgtttggtggtggaggccaagcgcatcaaggcgatcagtgatccggtggcgcaggcgaaggaattggggttggtggacccgcgctgactgatcgttcccatgctctgcgtgggaatgcaggccgggacgctctgcgtcccaaggcgtgacgcggagcgtcacaaggggcattcccacgcggagcgtgggaacgatcattggcgtgtctttggtcattgttggcctccggcggcgccggctttggcttcttgctgatctttgcggcgttgcagttgctcgcggtcgaagccttcgatgtagacctgggcggcgcggccgacgggggcggccatggccgggccggtggtgcggccttgggtcaggtcctgcttgcgctcaaccatctgcatcaaattcaaattgttcgcacagcccaacggcaaggtcggtttgaaatcttcgtccagcccgattgcatccttggccggcggctgctggcattggcttggcaaaccatccgcgcggtattccggcgcgtaatacaccggcgccaaatgggtctggcagcccatcaacgccaggggcaacagcatcaacacacgcaaagcagtcatcgcaggccccctcatcaattcatgtagaaaccgaacgccccgccgctgcgcggtccggtggccgcggcggtagccggttgtgcgtccaacggtgtggcgaggctgcggctgcgcaccggttccaccaggtacggtgtaatcaggatcaccaactcggtttcgttacgctggaaacgcttggaacgaaacagattgccgaggatcggcaagtcgcccagcaacggcagtttttcgatgtcctggctgctctcacgctggaacagcccggcgatggcgaaggtctgcccactgccgacttcaacccgcgtatccgcacggcgcacgctgaaggacggcacatggaaattgccgaaatccacggtgccgccgctgaccacgctgctgacttcggggcgcacttgcagggcgatgcggccgttgggcaacagcgtcgggttgaacagcagcgacacgccgaacgacttgtattcgatgcccaccaggtcgcggttgaccggcaccgggatcgccacttcgccgccggcgaggaagctggcagtctggccggtcatggcggtgatgttcggctcggccagtatctgcaacacgccgttggcttgcagtgcgtcaagcatgccgtcgatattcacattgcccgagccggtgcccgccgtcgccaagccacccgccgtggcagccgccaggccaccgccggtgatcagcccgaaggagaaggtgccgttgttgaacatcgcgttccagttcacgccgtagtgcagcaattcggaacgcgacacttcggcaaagcgcacacgcaggttgacctgggcggcgcccgcgtattcggtggtattgattgcgctctggaagccttggccctgcgggttgagcagcgcgttgaggtcggtcgcttcggccactgagccgacagtgcccttggcgatcaaacggttgccggcaccggtgatttgcgcgccattgccggggtgcagttcctgcatcggcgccgtcaccgcctgggtgccgctgctgaccgacaaggtcaggctggcgagttgtttgccgtcattgccgagggcgatcaggctggtattgcccggcgccttgccgaagatatacagcgtgccgggcgacaccacttgcaggtcagcgacgttgggctcggccaccagcaccgactccaccggcgcgacaaaatgcaaaatacgcccttcgccggacgccagattgatcgagccgcccgccccattggcaatttcctgagcctgacttgcacaactgaccagagccagcaacaacacacaaaaacgcatcatgaggcagacgccagggtagtgacggaagccgcggcaggtgcgcggcggttagagatatcggtgaggctgatggtcaccagcgcttgcaggttgtattcggtggccagctcgcggaacgacagcactgccagttccagctcgccgcgcagtaccaggcgacgcaggctgcggcgcaattccgggtgcaccagcaataccgcactgttgacttcgcgggtgttctcacaggcctggcgcagttgcacgagcaaggcgcggctgacgtcttcggggatcaattcgcgctgcggttcctggcgacgcagggacgcgcgcaactggtcttccaggccgggcgccagcaccagcgcgccgatcacccggttacggtcggcgtattgatggctgatctgccgcgccaacgctgcgcgcaagtgttcagccaggcgcccggcatcggtctcgcgggcgccccactccaccatggcttcgagcaacgcgcgctggttgcggatcgacacgccttcgccgaccaacaggcgcagggtttcggcaacccgttgcaagggcaccaggcgcaaggcctctttgaccagttcgccgtaggtggcttcggtgcgttcgagcaacaggcgggtttcctgaatgccgaggaagtcggcggcataacggcgcaggctacgttccagcacagcgcgcaagacttcatcgggcagcaggaaaccgatgccggcgttgcgcaacgtctcttcgtgctggcgctcgatccagtgggcgttgcgaccattgagcggcgaatcggcttgcacggtggcgatgtccagcagctgcacatgcaccggatcgtcctgcagcaacaggcagttgaccggcaactcgccttcgctcaccggcacgccttccagcgacacgcggaaaccgcccggcggcgccttgggttccatgtagatgcccggcaccggcacatccacgccgaggtcggtacgaatgtcgtgacacagcgcttcgacacgctggcgcagcaactggcgcggcgcgctctgggacacgccgctgccgatggtcagcagcacgcgggtatcgggcagcaggttgtcatccagctcggcctgcacttcgaccaccggctccggcgcctcgaccaatgcctcaagctcgccttggggctgacgcgtatgccggcgatacatcacaaatgccgccccaccgaaagcagcggacaaaccgaggaacacccaggtcgggaagcccggcagcaggctgacgccgatcatgatcaacgcggtcaggcccagcgcgcggtagctggcgcccaactgtttgatgatctcgctgcccaggtcaccggcttccccgtcgctgttgacgcgggtgaccacagtgcccgccgccaccgaaatcagcagcgccgggatctgtgcgatcaggccgtcgcccacggtcagcagcgagtaggtgtgcaccgccacgccgaacggcatgtcgcgctcgatcatgccgatcagcatgccgccgagcaggttgaccgcgaggatgactaaacctgcaatggcgtcgcctttgacgaacttcatcgcgccgtccatcgcgccgaacatctggctttcacgctccaggcgcgaacggcggcggcgcgcttcggcctggtcgatgtcgccgttgcgcaggtcattgtcgatgctcatctgcttgccgggcatggcgtcgagagtgaagcgcgcggccacttccgccacacgttcggcgcccttggtgatcaccacgaactgcgccacggtgatgatcaggaacaccaccatgccgaccaccacttggccggcgatcacgaagtcaccgaaggccttgacgatatgcccggcgtcgccgtgcagcaggatcaaacgggtggtggtgatcgacagggacaagcgaaacagggtgctgagcaggatcagcggcggcagcgcggagaactccaccgaatggccgatgtagaaggcaacgatcagaatcaggatgctcagggcaatgttgaggccgatcagcatgtccaccaggtaggtgggcagcgggatgatcatcatcacaatcgccatcagcatgaacgcgacgatgatcacgtcagtgcgctgcgccgccatgcgcgccaggttgttcaggcggttgagtgcactcatgcgctggccctgcgtgcggccaggtagcgtttgaagcattggcgcgcttcgtccttgcgctcgccgtaccacagcgcgcgggcgcgcagcagcaacaggctggcggactcaccttccagcgccaccagccggtcaagcgcacccagggcgcgagtggcgtcgccgctgtcggtaaaagccagtaccagcgagcgcagcaacacggcgtctgcgggcgcgacactgacggcaatcagcaacatcaccagcgcacgctgggactggccattgcgccggtacagctcgccaatgcccttgagcagttgcacggcgtcgtcgttatcgcgggccatcaggcatgtacctccgagcgttgctgttcgagggtgcggcgcatttcgatctcttcgctgatcaggtcgtgggccagttccttgatctcgggctcggcgtcgaggctcggcaggatgtgttccatcacgtgttccaacagttccagggagcgggcgctgccgaacagcagcgagtcgacgccggcggcgctggtgagttcttcgaggtcactgcgcagagagcggcgggtttgggtcttgcgggttttcagcaccgcttcgaaggcagtggcctggcgtgagttgaccgggcgaacggcttcgacgggtgcgctgcgcacgtcgctggggatgagcgggcggggttcgactttcatgcgtaggcctgatcgttcccacgctctgcgtgggaatgcagggtgtgacgctccgcgtcaccgtgcgctgacgtcaggacgcggagcgtccggggcggcatgcccacgcagagcgtggggacgatcatctgggtgtgtgccatggcgcagctcatagggtgaaggtgaagcgttcttcgccgcgggcgaggatcacttggttgttctcgatgcgctccagcacccagttgtccgccagggctgcgccggggtacaggcgtttgccgctgtcgttgatcacgtaggggttggtgccgaaccacacggcctggaagcgcacgcgcggtcgcgcggcgtcggcgcgcacggccacgcgggggttgaggacgatctgttggccgtagcgctggtcgaaggcttgttgcagggccagccactgcggtttttgcgagtgttcgaagctgcccacagcgctgagctggccgtcggcgtcagtgacctttatcgcctccagatgggcggcctggagttgctgctccagccaggctttggcgagttcacgggacggctttttcagcgccggaacctctgctgccgcaacggcagtttgagccattggcgcgtcgttacgcaccgccaaggtccccgcacacaaaaacaataggacgatcgcgacaatccagggggtaaatgggcgcctcgcgtccgaaggtttttgcaccccttccggtaaggccaggctcacacccgccgcgccgaggcgcaattgcacaggcaggcgcgcgcgatggccgctgccgtggggaatacgcacattgccactgagcagcacatcgccgcccaaggcctcgaccgccacctggtcgccctcaaaacgcaggcgcaggtgcaagccggcgatgccgggatcgctgagtaccaggtcggctgcaaggtctgcgccgagggtatagacgggctggtcgagcaccagggaactgccctggtgcaaaccgccggtcacagtcaaggtcggtgcgccaataccggcgaccgggcctaaagaaatcaaggctgtcatgttcgggtttgcccccttgagcatgtgcaacggggtcaacaatcaggaggtaaaagtactcaggtaaacgggcagcgccggcgccgcccgttttggcgaatcagttctgcggacgctgtttggtggcgtcgagctccgcttttttcgcggtgctgatttcagtgatcttggccgacttctcgatagccatgttgaaggtcgcttccatcttcgcgatagcgtcgtcggcgccgccggcttttactggtgggacatcagccatgttcatctccttgcatcgatagggaagttattcagttgcgcaacagcaagctgaaagtatgcaaaccggtgaatgcccaaaacgtcagacagtgagccttcgaaccgtcgttggtttgcatggcagccatactactcacgatcaaaacgccttcgctgtgaaagcttgtgaaacgtttcggcgacagggtgtgaaaggtttggctcaacctggcgttgagaaaaactcatgtatttgaggctgttgaacttttttcaaaaaaaccaaacatggccaaccccagtgtttacgcggcttgcctggcctgacctggaaccttgttgaacactttgcgcctctgcgagcgatcgttccgagcttatccggcaactattttcgcgaccacttcacatttttcgctaatagccctttgcccaactttgcagatatttccatttgtaacaaaagcgacttgatcatcgcgttttatagctcggcgcaagcgaccttaatgcgcgttaacaactaatttcctgcgccattagttagtgcagttgcactaatagctaacaccctgcgtgcgcaggccctgatataggcaagaacttccaggtgatcatttatgccagcgatcccaagtagtcgtgacccggctgaaaccccaggcacagacggcgcgcagaaaaaattcgaaaccgcgctgttcacggctgtcaaccagccgacgtttgacccgtccaagatccgtggccctttgatccccctgccctatcagaatgtgcaagcaccggtgaacaacaccatcacctatacgccgctgggcagcgacaaaccggtgacgctcaagcagatcgacaacccgcgcctcttcgaaacactggtcgaccagtacaacaggcaacagaacgatgccagcttcgaaaaaaacctcgccgacagcaaagccgccggctacaccgaggccgacgccggcaccgtggcgcccggcctgggcaactacacagccatcggcagcccgactgaactcggcccggggttgattcgctacgagaccgcctccggagacaaggtggtggtcagccagaaggaaacgccacagctgtttgatcaagtcagtggcgacttcaccaaattgtcggcgatcaatgcgagcggcgccgaaggctatcgcctggccggccccaacgagagcatcgacccggccgccagcattggcgcgcccgaggaagtcgggcctgggctgatccgctatcaaaccgcgtccggtgacaaggtgatcgtgtcccaggacatcacccctgccctctacgaccaggtggccaaactgtatgccgggaccaccggcgcagccggcgcctcggacacgtcgtggatcgacaactcgtcgtttggcgtctccggtgccaaggactggggcaccatcaccggcaacaccagcggcacgcccaccaaggaagaactcgacctgaaccgcccgcgcgccgccgcgcagctgctctcgcagaactgggacgcgtggggcctgcacggcgcgccgatcgacttcgccaacccgcccaccaccttgccacccgaggcgcaggcggtgctcaaatacgtggccagcagcccgaacctgatggcggcgctggacagtggcgggcgcggtaaagccgacaacgtgatcacccactccgacgtcgaccactttatcgataacgccaacaaggaccttggcgccgcgtcgaaatccttcggcagtttcatgggcagcaagcccggcgacctggcaactgccaacgccaagtccgccgctatcgtgatggccaacgaaagcctggtcgcaagctccggcacggtgatgcgccccggtgacaaccagcgcagcaacgacggcatgattcgccccgacaaccttgaggcgctgggcagtgattcggccttgagcaatgagctgacgggtgctgcggccatgtggtcaaaacccggcatgttccacgccttggaaaccggtggcgacaaccccgccaccggcaaatccgacaccatcggcacccgcgacaacatcggcgcgtggctggaaaaacaggcgccgaaaaccgacagcgacaccctgaccttcttcgacggcgccgccacccgcgatgcggtcacgggcgtggacacctcgaagctgaccgccgacatcctggccaacccacagaactacagcggcgaacaaaaagctgcggtgatggtgcaactgaccgacgcgcaaacgcgcctgctggtcagcgattacgtgggcaacgacggcttgatggacaagtacacctcgccgaactggggcctgaaccccaacgaagacaagatcaaggcgcagctgcaaagcggcatcgagaccctgtcggccgacccggacgtgcaggcctttttgcagaacaaccgcggcccggcgttgagcgatatcgtcggcagcgacccgaccatgaaagtcgcaatgcagaactatgtggccgacggcatcgagtcgggcaagaacctcaacgacaacctgaatgccaaggaccagaacggcaagcagatcgacatgggcatgggcctgcagaacgccgcgaatgacgcaaccatcgccaacctggcgctgggcggcaacggccatgtcgacctgagcaaaattgccgccaatgccgggcaaagtgacgcgatccagagctactacaagaaccaactggtcaccggcaaagccttcaccgacgccgtggccggtggcatggacccgacggtggcggccagcagtttcgccgccagcaccgcgtcggcccaggctttcctgggtgacaaggccacggcggatgacgcggcgaccttgcaggtcaacttcaacgaaaacctcagcgatgccctgctcggcggcgctactaccgacaccctcaacgtcacgctgggcgacggcaagggcaactttgacgaggccaaagtcaccgccgcgatcaacgacgcacagcagaaagacccgcagatgttcgtcacctccgatggcggcaagatcgacccggcacaggtggtgtcgatgctgcgttcggtgtgggacatcggccgccagggcaacaagatcgccgacgccttgcccaaggcgatcgaaggcatgaagttcggcgacgtcagcccggcgttcaagcagggcctgctgcacatcggcagcgcggtgttgatgagcggcgtgctgatggcgcgctcggccaatggcagcaacacgccggtggcggatgccaaccgtgtgtcggcaggcctgcaattcgccggcctgttgctggaaggcggcaccaagtacgccaaggaagccggctacggcgtgacctgggtcaaccgcccggacggcggcaccattggtgatttccccggcaaggtgccggtgggcaaaggcccgctgtcagcccagcagatcgccgatatcggcgccgccggcaagatcatcggttcggccggtgggattatcggcggcgtgatcgggattatcggcggtgtcgattcgctgaaaaaaggtgactacctcaccggcagtttctcggtggccaccggcgtgctcggcacgggcgcggccgtcgccggcctggtggaagccggcgccgggttgtatggcgcgactgaaatcggcgccgtggctggcaccatcagcggcattctcggcggggccacggcgatactcggcggtatcggcagcgccttcctgccgttcgccctggcggatgcccacggcaaggcgcaagacgcgttctacggccagctggcaccagtgctgcagcaatacggcttgaccggtggcccgaccatggatggcgattacccggccgacccgatcccggccatcaacacctgattggattaagcgttcaccgcctaaaggttctacgacatgacgtatctcaccgatgacacggcttcaagtatccacttcggccccttccaactgctgccccaacgtcacttgctgctcaagtacgggcaacccgtggccctcggcagccgcgccttgaccttgctgatcgccctcgcctcgcggccaggtgaactgcttgaaaaaaaccgcttgctcgccatcgcctggccgaaaaccgtggtggaagaatgcaacctgcgcacgcaaatcaagaccctgcgccgagcgctgggcgacgatgagtcgttctacatcgccacggcgccgggccagggctatcggtttgtcgcgccgacatgggtcgagcgcgcgcccgtgccggtggtcaaagagccggtaatactcggcgtgtacggctgccgccattgccgaggcgccgggatgatgccgatgttggcgcagctgggcatgcagaacagctgaccggctaatgtgggagctggcttgcctgctcccacaggtttagagaggcggcgaaacagtgatcgcacccaaatccaaatgcccatccttcaacggcgggcaccagtaatacccgcccgtcaacggcgtactgatgcgatacaacccatcgacaatcccatcctccaacccgctcatgcgccgcaactgcgcttcaaacgcatcaaaggaatgcccgaacgccaggaacatcaaccccgcctggccgttctcggcccatggcatggagcggcgcaccacgaaggcttccggcgtgaagctttcctgggcggtacgcttggtgtgggcggattccggcgcgtcgtccagctcttcgttgtcgccatggcgacggccgatgatgtggtcacgctcttgagcaggcagcgcggcaaaaccgtcgaggtcgtgctgccattgctggatcgcggcaaagctggcaccgctgtcggtcatcgcggcgtcgacggctgcatcgtcgtgggggttttcggtgccgtcttcgtagtcggtcaggtcgaagccggtcttgtagcgaaagccttcggtcatctgcaccaggcgaaacgccggggccagggatttttcaaaagcacggctgcgtaacagcagctcaccccgatccacgccatgcagccatacccacagcgcctgctgggtggacgggttatgcgcacccggcccgctgacggcggggaatgcacgcaggccttcgacctgggcgccgagtgcgcttaccagcggctcaccgaaaccgaccaccgcggccgaatccaccagctgcaccagcgcgtccagcgcggcgggcacggctgccagggactcgacggcaaaaaacagatggcgtgcctgcaacggcaccggtgcggcaagaatgcccggctggtactgactcatgtgaactccttcaagaaagccgcgcagtttactccgacgagcgtggcgcacacagcaatgtgtacaagaaagcgcacaagccttgccatagagccgcttgttgggtgactctctagtcatgttttgcaactattccaggggtagcgacatgaccaccagtaacctgctcgcccagctgtttccgaccttcgccgccgatattcccgagcaatttcgcctcgcggcgccgattgaacagcgtgattacctggtcgatggccagttacaggtgtggaacggcccgttggcccaagtgctgagcccggtgcaaatcggtgatgagcgcgtgcatatcggcagcacgccgctgctggacgccgacacggccctcaccgccctcgacgccgccgtgcgcgcctatgaccgtggccaaggcgaatggccgacgatgcgcgtggccgaacgcatccagcatgtggaagcctttttgcggcgcatgcgcgaacagcgcgatgctgtcgtgaagctgctgatgtgggagatcggcaagaacctcaaggactcgcagaaagagttcgaccgcacctgcgactacatcaccgacaccatcaatgcgctcaaggaactcgaccgccgcagcagccgcttcgagctggaacaggacaccctcgggcaaatccgccgcgtgccgctgggtgtggcgctgtgcatggggccgtataactacccgctgaacgagaccttcaccacgctgatcccggcgctgatcatgggcaacactgtggtgttcaagccggccaagctcggtgtgctgttgattcgcccattgctggaagcgttccgcgacagcttcccggctggggtgatcaacgtgatctacggcagcggtcgcgaaaccgtcagcgcgttgatggccagcggcaagatcgatattttcgcgtttatcggcaccaacaaggccgccagtgatttgaaaaagctgcatccaaaaccacaccgcttgcgcgcggcattgggcctggacgcgaaaaaccccggcatcgtgctgcccgaggtggacctggacaatgcggtcaacgaagccgtcaccggctcgctgtcgttcaatggccagcgctgcaccgcgttgaaaatcctgtttgtgcatgaagacgtggtcgacagctttatcgaaaaattcaacaccaaactggccacgctcaaacccggcatgccgtgggaagacggcgtctcactgacgccgctgccggaagtcggcaaggtcgattacctcaatgcgctggtggccgatgcggcgcagcatggcgcccaggtggtgaatgcgaatggcgccaccagccgcggttcgttcttctacccggcggtgctgtacccggtgaacccgcagatgcgcgtgtaccacgaggaacagttcggcccggtggtgccgatcgtgccgtaccgtaacctggagaccgtgatcgactacgtgctggattcggatttcggccagcaactgagtatcttcggcaccaacgctgtggaagtcgggcgcctggtggatgtgtttgccaaccaggtcggccgcatcaatatcaacgcccagtgccagcgcggcccggacaccttccccttcaacgggcgcaagaactcggctgaaggcacgctgtcggtacatgacgcattgcgcgtgttctcgatccgcacgttggtggcgaccaagttccaggagagtaacaaggcgctggtcagcgatatcctgcgcaaccgcgactcgagctttttgaccactgactatattttctaagaacactcggttcctggatgaaagcagtcttgtgtgggagctggcttgcctgcgatgcaggcactgcggtctttgagtcagaccgcagtgatgctatcgcaggcaagccagctcccacaccaagctcccgcaccagcccgctcccacaatttaaatcgagttttgccctgactaccgaggccattttactcccgatgaacctgcccttcttcgcccggcgcctgctgcgcccgttgctcgacccgtaccgccgctatcgccatgccaagctgatccacgcggtacgcgtgtccatcggcctgctggcgacgatcctgctgaccaccggcatcaacctgccccacggtgagtgggcctcggtgaccatgctgatcgtgatcggcggcttgcaacaccacggcaatatcggcaaaaaagccgtggagcgcgcctacggcacgttgatcggcgccagcgtcggcttgctgctggtggtgcaacaggcctactttggccagccgttgttgacctacctgttgatgtcagtggtatgcgggttcttttcctatcacgccatcggcaagggcggttacatcgcgctgctgtcggcgatcacggtgtttatcgtcgccggtcacggcgataacccgatctcggatggcttgtggcgcacggtcgatatcctcatcggcatcgtcctggccctggcgttctcctttgccctgccgctgtatgcggtgtattcgtggcgctacaacctggccagcgcgctgcgcgactgcgccgcgatttacagccggatcatcaacggccagtcggtcaccgacgacgaacacttcaaactgctcaaccgcttgaatgcggcaatgctgcaactgcgttcgttgatgccatcggtgtccaaggaagtgcgcatttccatgaccgagctggacgcgatccaacggcacttgcgcatgtgcatcagcaccctggagattctcggcaatacgcgccccgaccctcgggacgagcaggccatggcgcggatgcaggtgatgttgaaggccgagcatcgacagattcgcgtgcaactggtggggatggcacgggcgttgaaatcggggtttaccgagcggctggaacggcctgctgcaaatgcgatggatgaagccgtgctggacgcgccggtgcagagtgcgctggatgggtatcggttgttgacgttgcagctggcggggaatgtggacgggatgcgtcagcggttggcgaagacggcgaggcattggaaaatctaagtcggcaataaaaagggacagcctacatttacgtagcgctgtccctctctttgtactcaaactgctctcttattccaacatcagtcgatcaattgtaatgccatcactgggtacctttcctctgcgtacctgccatagatgccagctcttgcttcaaaaaatgtccaagcctgattatagacaaacgtgctcgtccaacgactatcaatataattccacgaccccacgtaacagcgatgtatatcgtaaagggcagcatcaaacatataactccctcgataaatagtattaatccaagcagacccctctctggcagtcagtcgggaattattgaacacgaaccgataaatgttagacacccatacatagtaggaaacttttgttaagttcttatcggtcacggtaatcgcggcgctcccgttcgcgttaccggtcactttcccgcctgcgtccactgaagccactcgtgggttattagaggcataagtgtaaccgccggcaccgccgctggcttgccggtattgagtattcgctactgaatccgcacctgttcttcccagagggaactctttaatagaaacgccattcaagatcatataactttgatcaattttcaactgccccgaagcagtataggtggttgatttaaacggctgcttgttttcttctttgtcactgccatccaatgcgaccccgacttccaccaccaccgtgcgattagcgggtaacgcctccagccaggctctcgacaccggtatattttgcagccctttcgttacatcagtatccgttaccacatagttcgccagcacattcaactgcgcaacgcccaagctgcgcagggtaatccaaacccgctgaccggcaaatatcaaaatccatataggcagcgtcaaggtcgggtcaccgccgaaggtcgccaggttaacggcaccattgtccgcgatcttattaatcaatgcctgagggaagtactctgccgaaatagggctaactttgacaatctgggtgtctgaccagacaactttggttcccgttgtcaccttgtagcgcaaggtgagcgttttacccacacactgggcgataaatcgcggcgtcaaggcgaaggttactcgcccgccgctcagccctttcagtgcagtaaaagcgaaggtaccgtccgatagcatcatttcgagggtgatgtcctgcgccgtcgtcataccggagtacgccaccagcacattggtcccttgcttatagcccaggcctgagacattcagcgtcggccctgtattggcgtcgaaggccggggccggcagcgtcgccggaacagcctggacatgatactcacacttggcaaacggcacctgcgtctccgcctcatcccgttgcgcaaaactgacgccgaaaataaggctcaagatcgagtcaggcttgaggttgcgcagttgctccaccggcccaagcacgttcaccccgttggcaacttcttcctcggtaaccttttcagcagagtaaatgacctcatcaagtgccgagccgtcgttcaacgtgcctttgaccctcaaaaacatccgttggtctttttgaatcataatccacttgggcacgtggatcttcgcttcattccccagtgccagcaacggaaatacaccgttctcaatcttgttgagcgtcggcgccggcagcgcagtgacgagcagcaacttgatctccaatggtttggatcggtacgtgatttgcccgcgggtaaaacggtagtctaccgttatatagttgcctctttcacgaatggccaacgcaatgatttcgggtggaataacggctttaacttttcccttggagtcgccattaacggtcacctcagtgacgctgatgccaaactccccctcccaccggaaaataacgtcgtcggtggggcgcagattggtgatagtcccctccagggtggcgccattcattacgtttttggggtgaagttgatcctgcaaaaccttatcggcctccaccaccctgggcagcgaaagctccaccagtgggccgacggtgaggttaagcaattcggaacgcacgtacgttttcggcgtcgtcgctgtgccctccttttgcacgctgtaactgcaacggatcgagccgtcgagattcaggcgcatgaccgacgggcttacctcgatccacagttgcgtcaaaagcggcccttcggtcgacgcatcgataaggaagctgccgctgtccgacgcttcgggatccacaccgactatgttccagaagattctgcagccaacggtcgcaccgatgaagggaaacgacatctgtatgacagagcgttttacgtcttttgggtcgaggttgccgttaacgttgtacttgacgatcggcgcaggcgcatcgatcacgcgaacaccaatctcagccgtcaccacctcggattgacggatggacgacgcgaggcccttgccgttattgacgcggtaaaaaatagagaacgggcctttattttcaaactgtttcagatcttccttgagcacgtcgcgcacgccgccttgttcaccggccagtcgcgaatccgtatagatcacactactgccgccttcttttcccagtcggatcaccaggtcttctcgccaactgcgattgtgcggctgataactggggattgtcgctgccgcgtccgtatccaggggcatcaacgtaccttccagcggggagaccagcggtgccggcatcttggtcgccgtacctacgacaaagatctgggcgtatcccgacgaccctaacttcgtaccgctggcgttatgcacctccacccataccaggatttccccgcgttcctgcccgcctgccgctttagcaataatgtcgttgggaacattgatatcctccccctccacgttagtgtcgggaacacccttcaagcgcacttcgacccaggtgtcgtcatccttcttaatggaaaggacgaccgtgatcgtatggcgtgggttgggctttggcttgttgtaagaaggtacataggtcttcagcacgaatacggagttgtgttgagtatcaaaatcgacttgggtggtgggctccgcatccactttgagggcgggtggcttatacaggtctttattcgtttgcaggcgtaccttgtagggtttggaatacgtgtaattcccaccaggctgattcccgaccacatcttgaaccgtaaacccgacgccgatctttccatcctggatacccttcctgatagtctcggcaggcacctgaacccgaatcggtccagggtgggcgacgtcttcggggcttaccgtgtaataaaactcctcccccgcccatttgatggtgaacctgtcgttcttgcggcagttcggatatttttcaatcaggcaccacactccggctgcgacgatgtctttatcgataatggaatcttccggcaggtcttccagcgacagcttcaactcgctatgccagtcttcccaaaacctcagatcgttcccgccgggcagtgtcgttttgatcaacaccaagatggtgtgcgtgcggccttcctgcccattggagcgaaaaacccggataaagatcgggacttcgccctccggcaaatccgccttcttgaccgacaaaaagtattcacttttctcttctcgaacgtaaccaaaggcttttgggtctttctggtccttcataataacttcgacgtagtcgcccacggcgagttcaaaccaagccactaccctgatatcgagcataccctcctgcatgcttctgtggccgacgccccagatggcatcttctcgataaaggggtttgcgaggaaagtcgggctcttcaggcccatcgggatcatcagcgtcaatcggctttctcagttgaatctgagcaggcgacgaaggcggaggtttaagtaagtcatagggcggagtaggaacagtggacatgaccatcaccttgcagggttaagccgcgcaagaatggcgcgacgggcaagggaaataaggctcctggaggcgcagccctatctactgtcagaattgacagtggcgaccagcggtaggtgcgtaggattaatctggcagccaccacggcgagcagaactttcttgtcgccgcgttttttcttacatatttttcacgatttattcacatccacagacgtagggtgaagcctcatccgttacaaacgttgcacatcaagcccgccgccccagcgggcttttttttgcctggattttttaagtgagggcgcttaacgcgcggccttgatggcaggcgccgccgcttgctctcgaatggcgcgctgggtatccagcaccttggccaacgctgtttctgcttccgggctttgctgcggcacgcgaatcgcggccgataccaacgtgatcagcttggccatcacctcggcgtccgtggccgggcggcccaggctcatggagttcatcagcaggcgcagttcagtgccggccattaccccggaaatcgccttgagcgcaaattgcaggcgtacgcccagctcattgcgtggcaagtccggcaaggccagggcgaaggcttcgaaaaaacgctggaacaccggctggtaatgcaccttgaggtattcctggataaacggcgaggtgtcgctgtagacccggccgaggaaacgaatgaatgagcgcccttccccactggccgggtcactgcgctccaggcccatggccggggcgaacagcacgccgagcaaggtatcgcagtccagcggcccgtcggcttcggcttcacagcgcgcgagcaattccaggcgttgctcgttgagcggctccaggcgctgcatcagcagggttttcatcagggagtccttgtccccgaagtggtagttcacggcggccaggttcacctgggcgcgctcggtaatctgccggagcagaacggcgtcgtagccgtacttgatgaagagagcctctgtcgcatccagcaatcgagtcttggtaacgtttggagcgctgagtttcttcgcgaccataggagttccacgggggaaatattgttttaaaaaataatttgattttttataccggggcagcccttcgaaagcaagtactgccactgcgttacccctctaaaagcctgtataaacgggcataacgagggtagtcgagggttttgggcgccgctcgaacccggccgcagaaaattcgtttcaaggggtaaaaccgctctacatccatggctggcgaagcgcattgaacacggttactattcaaacaatattttaaaaacaagaaataaaaccagtccgtgacgcgtaccagccagctcccgaacttgttacaaagatttaccgggggcaagcggcaccgtcgagactgcaggcgtagtcatgatgacagatacccccgcgcacccaggcttgatctccctgcaaggcatcggcaagcactatcagctcgccgggcaacacctgtccattcttaacgatgtatgcctggccatcgcccgcggtgacagctgcggcattctgggtgcctccggctccggcaaaagtaccctgctcaatattctcggcctgctggacctgcccaattgcggccagtaccactttgccggccacgatattttcagcgccagcccggatgagctggcggcgatccgcaaccagcagatcggcttcgtgttccagagtttcaacctgctgccgcgcctcagtgccgtggacaacgtcgccctgcccctgagttaccgtggcgtgtcacgccatgagtccgtggagcaggcgttgcgcatgctcgaacaagttggcctggccgagcgtgcccaccatcgccccgccgacctttccggcggccagcgccaacgcgtggccattgcccgcgcgctggtcggcaaaccttcggtgatcctcgccgacgaacccaccggcaacctcgacagcaccactgcccaagagatcatggacttgctcctggccctcaaccgcgagcagcaggtgacgctgatcatcgtcacccatgacccccatatcgccgagcgcctggagcgcaaaatcctggtgcgcaatggcgtggtgcatgaggccggacgcctatgagcctgcgggtcgagcagaacctgagccaactgctgcacgaagcgtttgtgagcctgcgcaccctgggcaaacgctcggtcctggcgttgctgggtatcgtgatcggcagttcgtcggtggtggcgctgatcaatatcggccataacgcggcggtggatgcggcgctgattttcaaagacatgggcaccgacacgctgatcgcccagttcccggccaagggcagcggcaacacaccgatgcgcgccagcctcgacctcgaggccgtgcgccgagccgtaccgggcatcgcccatatcggcgcactcagtttgttcagcgggcccatcgtgttccatggccgcagcgccaacgccaactttgtcggcgctaccccggacatcaaggacgccatgcgcctggccgtgcgcgaagggcgctttctgtcgcgtttcgacgccggcgaaacctacggcgtgattggcgaccaagtcgcccaagccctgggcgcgccgggcgacccgctacggctgggcgaccgcatccgcatcaacgactacctgttcctggtggtgggcatcttgcacaaccaaccgcgcgccatgctgatgccggtgcaggccaacgaatcgctgtttatccccgccgaaggcatgcgccgcatctaccccgcgccgcagatcggcaacgtgattatccgcgccgcgcccggcgaggacatggagcagatcgcccgcgacgccgccatcgccctgaaaagccagctcaccgaccacgatgtcgatatccaggtgccccagcagatgatcgatggcatgacccggcaaagccgtacattcgcctacttgctgctggccctgggcgcgatctcgctggtgggcggcggcgtcggcgtgatgaacgtgatgctgatgaatgtctctgagcgccgccgcgagatcggcatccgcatggccctgggtgcgcgccagcgcgacatccgcaacctgttcctgctcgaagccgtgaccctgacagccgtcggcgcactctgcggcgcggtgctgggcatgaccgccgcctggttctacgcctggctgtcgggctgggaattcgccctggccgccgccgcgctgccgttgggggtgggcagcacgctgctggtgggcttgttctttggcatctacccggcggtgtcggcctcgcggctgcagccggtggaggccttgcgtgatgaataaatggccgctgctactgattttcgcgagcctgccggccatcgccgccgatgtggtgatcaacccttcggcccccagcaccacccgcagcggttatgaccgcagtgtctcgctcaaagcccaggccaccaacatgaccctgggcgatgcggtgtacctgggcttgcgcaataacccggcgatccgcagcgcgtacctgcagcgcgttgcacaaaaattcgacctgcgcgtggctgaagacaccttcaaccccaagctcaccctcaacagttattaccgccaaagtcgcggtaccgcggataacgcccgcaatgccaacctggcgccgaacgccaccttgctcggcgaatacggcacccgcctgagcatggcctggacccagcaactgaacaacgccgaccgcgccggccgctaccgcagcgacggcctcgacctggcgcttatccagccgctgatgcgcggtgccggctgggacgccaccaccgcgccgctgcgcctgtcacgcctgtcggagcaggccaaccgcctgaacctcaaggccaccgtggcgcagaccatcagccagatcatcgccacctaccgcgagctgctgcgcgcccaggagcaattgagcatcgtccaggacgcgctcaaacgttcctccaccttgctggaagtcaacaaggccttgatcagtgccgggcgcatggccgagttcgaaatcgtgcagaccgaagccgacattgccacccagcaactcggcgtggaagaagcccagaaccagctcgataccagccgcctggcgctgctgcgcctgctggccctggacctgtcgacgccaatccgcgccagcgaggccctggaggccaagcctatgaccatcgacaagcgccaggccttcaacctggcgcaaacccagcaaccggaatacctcgccgccctgctcggcagccagcaggccgacctcaacctggtgatcgccaaggattccgggcgctggcaagtcgacctggtggccggggccaaccagcttcgcgatgcctacaataacgacaacggcagcagcaataaccgctcgtggaacagctatgccggggtgcaggtgcaaatcccgatcggcgacatcagcacccgccaggccgaagtgcgcgcacgggtcaatgtggaagatcaggagatccgcatcaccgacgcgcgccaggaactggaacgcagcgtcaacgacgtggtgcgcgacctcggcacgcgctggcgccaatatgaaatcgcccaacgtgcggtggaactgtcgcggcgcaagatcgagatcgagcgggaaaaactcagcgccgggcgctccaccaacttccaggtactgagtttcgagactgacctgcgcaacgccgaaaattcgcggctcaatgcgctgatcgcttatttgaacgcccagacccagctcgacttgacgctgggcatgacgctggaaagttgggaaatcgccctcaatgactactaacaaaaaatacctgctgggtgccttgctcgtcgtgctgttggcgggcaccggcattgccctgcgcagcccggcgaccggccaggccaccgcgtccgcgcaatggctggccgtcaaacctgacccgctggtgcaccagatcggcctggtgggcaagatcgaacccgacaccaccctcatcctcacggcgccgttcgacggcaacgtgctggccaatctggtagagcaaggtcagcgcgtcgaggccggccaggtgcttctgcgcatggacccgtccaccctcgaagtgcaactgcgcgacgcgctgtccgtcctgctcaaggcccgtcgcgccgtgcaggaaatgcaggactggaacagcagccccgccgtcagccgcgcgcgccgcagcctgcgcaccgccgaaatgaccgccggcaacacccagcgcaaactcaccgagagcgaaaacctgttcaagcgcggcatcatcccgcgcaatgaactggacgatctcaagcaacaggcccagcaacagcaactcgacctcgcctccgcccgcagcgaactgcagcaagcgctggatcaaggccagggcgaataccggcagatcgccgatatggaactgaccaacgccacggtgaaatacgacgccctgcacacgctgctggagggcaaggaggtcaaggcgccgttctccggcatcgtggtgcccgcacccggcagcaacagctcgccccaaggtgccggcaacaccaatgcgccagtgcaggccggcagcaaagtcagccagggccaggtgctgtttggcctggcgaacatcgagcgtttgaaaatcgtcgccaaagcgtcggagttggacatcaaccagttgcaccagggccaggcggtggaagtgatgggcgatggcttcgacggtgaacggctgaccgggtccgtgagcgtggtcagtggcttggcgatagccagcgacagccagggcagcgcgcaatttccggtgaccttgtcgatacccaagctgacgccgcagcaattgcagcgggtacggctggggatgagtgcgcggttgaccattgtcacgtacaacaatgagcaggcgattgtagtgccgagccaggcgatccaggcggacaaaacagtcgaataccgcgaggcgatggacaagccagtggaacgcgtgaaggtcaccaccgggcagtcgaccgcgcagggggtggaagtgtttggcctcaagcctggtttcgtgaagattggcagttgaaatgctgattaactgtgggaggtggcccgctcccacatttggaatggagggtgtcaagtagatttggggtgcttgggaggccgctatcgcaggcaagccagctcccacagaaaagcagagcacagaatactggcggccgaactcggtcaaattgtgggagcgggcttgctcgcgaaggcggtgagtcagtgacagatgaattgactgacaaaccgccttcgcgagcaagcccgctcccacatttggatcgcattgcatcaggtggatgggcttttgccctgcttttgcttcaaccactcaggtcg

SEQ ID NO: 66 - DNA, 52996 bp, Pseudomonas poae FL10F
tctgtactgctgtaacagtcagaatcgggctttgtccctcctcctcccttcaagtcctagcatacaagcgggcttgctcgcgaatgcggtagatcagccagtaaatttattgactgacacaccgccttcgcgggcaagcccgctcccacattttgatcgcatttcaaaacacaaaaccccggcacatggccggggttttgttattcagcgttcacctgctatcgcagggtcactcccactcaatcgtcgccggtggacaagcgacttgtcgctaatcagttcctgttcttctggcgaagcagcttgttaccgttgaaatacgcagcgacctgacaaacagattcaacctgacgtaggatgccttcgtggctatggaacaccttccttctaacctcctatgacctaggggtttcgctctccacactgcgcctgcttcttgcaggcgtttttacatcagctgtaaaacaatgctgcagctcgtccacgacggcggccaaggagaaatcaagcatgaatcaggatctgttcctgcgtcgccgtagcaaagttcacgtcccagtgggcactggcggagccacgcgcgctcaggtcgcgtcggctatccgcgaagtctcggcattccgatgcgtactgtcagagcctctgattgaacaaatcggtaggttgtcagcgacagaactcaagtactggctgcgcgaaatcgttgcagttcttcggcgggaaaatggcgcccatgtacaccacagaccgctttatcctgactttcccgagcaagttctgacagcctcagaggcggagttgtaccttaacgccgtcattcactacctcacactttggcgcttaccggcgagtgaacactctcgacctgcgatgcttgaaggcaacttcgtttcccgcgttatcgaagcaggaagcgcctctgaattcgaatcactgctcgagccgctggtttcatcgcgcacttcgctctcagaaacggacaccgctgatgtcgtctggtttatccgagagtacaaaaacgatgtgttccgtctgctgcctgaggccgtaccgttccgggaaatccgtgcacaggttggcggcgcacttatcctgcatgtcgctggcgatgcacgggtgaatgcgtttctggagcggaacgtcgaaaccgcaactgacgtgctaaggctcgcggtggcgctgagcggaggagacgtgtcactgacaacagcttcgacacgtttcaaagcgatgaagcgctcgatgcgccgtctgctattgagcctgctagaccgcattcccaatgctgtagaagacgtgatgcgccatgccgagcgctggaagcgcctggctgaggtactacatccgggcgactacgctgataaatacccacgagcgctagccgccatcacggcagcacgtcgcaacgaagcgccagactcatttggatcacgtgttgaaacattgcttgcccagcattacatcgccacgcttacgcccatactacagagccgtcctggtgaattcgcgcgacgactggacgtaaccctgcggcgcgcgacagaaccagagccggttctcgacgcgttcgaggtggttgccacacaagtgtcctcacctgtcctgctgcaattgctgactcacttacgcgcgccgcgccccctccctctgcgagcattcacaccgaaaggtgcatttgccaaagtctatgcaatcaaggaccgacgcgaacctctcacgcccgacgtgttggctcgtgcggtcagaatctgtgaggacgctctcgtcacgcgttttgcgtcactgccacctctaggccgctgttttgtcgatccagcattaagtgaatacagggtgccgcttgcgcagcgtgcctcatcgaagtcgctacgaacgcttgtgcgaggcagtcggttacctatacctgacacacgtttcattcgcctgttcctgtggtggaagaatggcagcggacgcacggatatcgacttgtccgcggcatttttcgacgccaacttcgtattcaaacaaacggtcgcgtattacaacctcaaggatttcggcggctgtcacagcggcgacatcgtcgacgcgcctgacggggcttcggagttcatcgacctcgacctcgaggtcctcgtcaagaagggcatccgctatgtcgtcacttctatcaactctttcacccagcaaccgtactgcgatcttccagaatgcttcgctggctggatggcccgcaccgacacagcgtcgggtgaagtattcgagccgcgctccgtgttcgaccgtatcgatatcgcatccgacacagcgatctgtctgccatttgtgatggatttgcaggaacgacgcatgatttgggccgacctggggctcacttcatctgtgcggtggaacaacgtcgagaacaacctcagtggggtatcgctgatgttgcgagctttaatacatacaccaaaaccggatttggagaccctgttcgatttacacgttcgagcacggggagaacgagtagcgtcaccgcagcaggcacaggcggtgtttgcgccggatcaagggataacaccgttcgatacggatttgattcggtcacagtttctctaatacctgcgtcagcccttggtattgattgaaaacgagactctgccacagcaggctaccaattcggcggctccccatgaactcgctgcgcggtcggtcagccgcgatgtctttttgggaacgccaatggtcttgcgctcaccggttgcacaaacttcataccccttcataacccatgtgtcggcgatcaaggtttcaaccaagtagtaagcctttctggaaaggtccaccccacggcatctcatacttatccgagtcaaaacatgaagaataacgccatgtgtacaacaagcgtgttgctgagtttttgcgctgcattactggttggctgcacgggaaggggctttcaaccgccgccgccggagtttaccaattggaagaaagccgggatgtctgaaaaggacgtcaagaacgctatgatcgcatgcggctacatcaacctcacagggacaggggacagaaccccgattgaccaggtactcacgcagttttattgcatgaaagacgcaggtttcaagcgaacagataacattgacctgtgcaaggaaggccgcatcggcgaatcaccggtgtgcgaaggccgccgataatccattagcgggagagcgatctacgcggactgtacggcaccgcagggatgtcgaccgtagcagcgctgggccgttgcgccttctcgaccgccatcatcggcgaggcaggcgagccccaaaaagccaaaagcccgcatttacgcgggcttcagggcatttcttgctagtgggtgcccggcaatgccggacgccccgtcattcccactcgaacataaaccatcttaaaaaaccaatataaatcatatctttattttgatcatctctgctgataccacgaaaaataccataaacgaaaacctgttttcacacgcaatgcatcattcatgcgatgtcatgctcggctggggaattgacccgtctgccaataccgcactgatcctatattgactcaagatccaataccggaaagtactcgcagaccaggagttacggtcagtgaaatgttggtaaatggaccaatacttcataagctgaaacacgctcgcctatgggaatgactgaacgtgctggacggcaatcaaacagtgcataaccgctatgaggataccggggccgcttgcaaacccttctagagcgactcaccctacggcgtctcacacttatccgagtcaacccataaggaagaacgccatgttcacgaggagcttgttgctgagtttttgcgctgtgttactggttggctgcacgggaaggggctttcaaccgccggatccggattacacaaaatggtacaaggagggcgtatcgcagaccgggatcattgctgcgatgcgtgcgtgcggatataccaatgttgatggcgcaggcgacaggtcgccaatcgatgtgaggttaacgaatttctattgcatgaaagacgcaggctacaaacgcaaagataacctggacatgtgcaagctcggtcgtgttggcgaatcaccggtgtgcgacggccgccgttaatccatcaccaaaaggacacagggaatgaacaatctacgcaacggactgtatggtgccgcattggccctgtcggcaacagcgctgggcggttgcgcctcctcggccgcgatcaccggcgagcctggggtaaacatgggcgacagctatcagaaggtgctcgcggtggtcagccgcaataataccgtgaccaaacaggtcgatggccaaggcttccgggcggagggttactcagggatgttcaaggactgtcgcgtcaaatacttcctgttccaggacgccgatggtttgcagcgcgtgagctatgagccggcgccacatctgtcggtcaaccagaactgccgccagccttaacttccccctacgagtcgattcctgatgagactgttgcctgtaatccccgccgtgctgctagcgctcggcggctgcggccaagtggcgaacgtgcgttcgctgtccaccggctatgtgcccccgcagggcggcgagaccgcgcgcatccgcctgctcaccgacggcctggtgcgcgccgtgccggggcgtgattgcctcgactggaacgtgcccggcgcgggggtgatggcgtcggccaaacccggcttccccgaccataacggcgaaaacctcggcattcccggaccgatcttttcgtgggccggtgcggtctcgtcggagctggtggtgccggcgaacaagccgatcgcgttccattacttggggcgcctgcaatattcccggcagtgtgccaagaccatgaccttcgtgcctcggcctggcgtggactacatggtgcaggccaccatgtcggcggactgttcgttccagctggatgaattggaggcgggcggcaagcagtgggcgatggtccaaccgcagccagcggggaaggtgtcgatgtgcaacgcgattgataacttctagccggaaatctgcgcgggttgaaggttgcgcgtgaagttcttcaaaacacacgccaacaccataggggagatgggcaaacagttattgctgacatctgcgctgctaagcgttctcgataccatgccggcattccttgtccgggacatggtatcgatgtagctctctcacatacgtacgatgggcgccattaaaaacgccattgatgacgtagtaaaggtcactatcaattcttattttttacaataaaatcagatagttgaaaccaaacctcattcccactcaatcgtcgccggtggcttgctcgacacgtcatacgtaacgcgcgaaatgccttcgatctcattgatgatacgcccgctgacagtctccagcagttcgtacggcaggtgtgcccaacgagcagtcatgaagtcgatggtttctacggcacgcagggctacaacccaggcgtaacgacggccatcgcctacgacgcctaccgacttaaccggctggaacaccacgaaggcctggctgactttgtgataccagtcggccttgcgcagttcttcgatgaagatgtggtcggcgcgacgcagcaggtcggcgtattccttcttcacttcaccgaggatccgcacgcccaggcccgggcctgggaatgggtggcggtagaccatgtcgtacggcaggccgagttccaggcccaggcggcggacttcgtccttgaacagttcgcgcagcggttctaccagcttgaggttcatttcctcaggcaggccacccacgttgtggtgggacttgatcacgtgggccttgccgcttttggcgccggccgactcgatcacgtccgggtagatggtgccctgggcgaggtacttgatgttgtccagtttgttggactgggcatcgaatacgtcgatgaaggtacggccgatgatcttgcgcttcttctctgggtcggactcgccggccaggttgttgaggaactggtcctcggcgttggcgcggatcaccttgacgcccatgttctcggcgaacatggccatcacttgctcaccttcgtgcaggcgcagcaggccgttgtcgacgaacacgcaggtcagctggtcgccgatggctttgtgcagcagcgcggcaacgaccgaagagtcaacgccgccggacaggccaagcagcacgttgtcggtgccgacctgggcgcgaacctgggcgatggcgtcttcagcgattttcgacggggtccacagggcttcacactcacagatgtcgaggatgaagcgcgacaggatgcggccgccttgtttggtgtgggtcacttccgggtggaactgcacgccgtagtaacgacgctcgtcgctgaacatgccggcgatcgggcagctcggggtgctggccaggatgtggaagtcttccggcatcttggtgaccttgtcaccgtggctcatccacacgtcgaggccgaacaggccatcggcgtcgatgtggtcttcgataccgtccagcaggcggctcttgccgacgacgtcgacacgggcgtaaccgaattcacgcagttcggaaccttcaaccttgccgcccagttgctcggccatggtctgcatgccgtagcagataccgaagacgggtacgcccaggtcgaatacggcttgcgggcagcgcgggctgttggcttcgtgcacggactcggggccaccggcgaggatgacgcctttaggggcgaattcgcggatcgcttcgtcatccatgtcgaacgggtgcagttcgcagtacacgccgatttcacgcacgcggcgggcgatcagttgggtgtactgggaaccgaagtcgaggatcaggatgcggtgggcgtgaatgtcgagggccatggggtcagtctcgtctatgcaattcggtgaagaaaatcagaaacaactcggggctgaaaacagccccggttacttaacgttttgctggaagcctcaacctacgcggtagtttggcgcttccttggtgatctgcacgtcgtggacatgggattcagccatgccggcgccggtgatccgtacgaactctggcttggtgcgcatttcttcgatgtcggcgctgccggtgtagcccatcgaggaacgcaggccgcccatcagttgatggatgatcgcgctaagggtgcctttgtacggcacacggccttcgatgccttccggtacgagcttctcggcgcctgccgaggagtcctggaagtaacggtcggaagagccttgcgcctgggacatggcgcccagcgaacccatgccgcggtaagccttgtacgaacggccctggaacagttcgatctcgcctggcgcttcttcagtaccggcgaacatcgagcccatcatcacgcaggaagcaccggcaacgatggccttggacaggtcaccggagaaacggatgccgccgtcagcgatcaacggaacgccggtgccttcaagggcagcggcaacgttggcgatggcgctgatttgcggcacgcccacaccggcgacgatacgcgtggtgcagatcgaaccagggccgataccgaccttgaccgcatcggcacccgcttcggccagggccttggcggctgcgccggtggcgatgttgccgccgatcacttgcacttcagggaaattctgtttgacccagcgaacgcggtcgatcacacctttggagtgaccatgggcagtgtcgaccaccaccacgtcaacaccggcagcgaccagggccgaaacgcggtcaccggtgtctttaccggtgccgaccgcagcgccaacgcgcagacgaccttggtcatccttgctggccagcgggtaagccttggctttttcgatgtcgttgacggtcatcatgcctttgagggcgaatttgtcgtcgacgatcaacacgcgctcgatgcggtgcttgtgcagcagttcgcgcacatcgttcttgtcggcgccttccttgacagtaacgaggcgctctttaggcgtcatcacttcgcggacggtcacttcaagacggttctcgaaacgcacgtcacgggaagtgacgatgccgaccaggtcgccatcgtgcagcaccggaacgccggagatgttgtgcaggcgggtcaggtcgaacagatcacgcacagtggcgtcggcttcgatggtgatgggatctttcaccacaccggcttcgtaacgcttgaccttgcgcacttcggcagcttgctgctcgatggtcatgttcttgtggatgatgccgatgccgccttcctgagccatggcgattgccaaacgggcttcggtgacggtgtccatggcagcggaaaccaggggaatattcagctcgatgccacgggttaggcgggtcttgagactgacttcgttaggaagcacctcggaataaccgggcactaggagaatgtcgtcgaatgtcagagcttcttggctgatacgcagcatcgcgggggctcccgagcgggaaaatggaagcgcgccattatatacatgcaccctgtcgggctcaatgtaaaactctgacaaacttggtaatactgatagatgggtaattgatcgttcccacgctctgcgtggaaacgcctccctggacgctccgcgtcctgccccagcgcaagggtgacgcggagcgtcaagggatgcattcccacgcagagcgtgggaacgatcggacgcaggagcgcgggaacgatcagacgatcgggttaaagctcgactttgacccaactcatcttctggtccagccagtcggcgaattcgtcgataaagctctgcttgaaccccgcctccgcccagttgttgaagatgaaccccaggttggaaaacccgcattcctgcaggaacagaaacccgttgatgtcatcttcatgcccacacagcgggcaggtgaagttgtcggtgtggccgggcatccagtcttccaggctttcgaacagcgcctcgccgacttccttgaggcattccgggcagccggcctcttcgagaaagcctttggccggcgtgtagatgcagcgcttgtagatgatctccaagccattgatcggctcgttgaacggcagcgcttccgggtgcagcaccacggcgcgggcgccatcggccagggcataggccatgcggttgccggtgcgcccgcaagtggtcagttcttccttgatgatgttcttgcgcaccagccaacgcacgatcgcccgcgcgcggggttcgtggacgggcaaggtggagattttcgggacaaggatgctttgggagttcatgggtgtcctgcggtgtggctactggccccatcgcgggcaagcccgctcccacattgaaatgcaatcacctatgggagcgggcttgcccgcgatgaggccctgaaggctggcagcttaatccctgccccacacaggtcaagtgctcaagtaccgcccgatcaacgcaatcccactggccagcaccaaccacgtcaccaaccgcacaaacgcctcacgcgacatacgcatcgtcagcctgcgccccacccacagccccaaggccatcgccggcaacaagcacagcgccaacatcagcagcggcaaatccgcgtaaaccccggcgatcaggaacaggctcaagcgcaccaccgtgctgcaactgatcaacgcactctgggttgcccgcgccgcctctttgggcaaacggctgttcaggtagatcgcatataaaaagccgccactgccaaacagcgcaccaaacaacccgccgacggtgcccatgggaatcgaccaggccgccgccagctgcgttggccgcgccttcaccgccaggctgtaaatcgcgtaggcactgataaacaggcccattaatagcaacaacaggtccgaatgcaggttgagcaaaaacaccacgcccagcgtgcaaccgattgccatgcacggcagcaatcgcaacagctcgggcttgttcacgtcccgccgcgattgcagcaggttgccaaaggcggcgacaaaatccagcagcaccagcagcgggatgatcttcgacaggggcataaacacaatcaggattggccccgcgaccagcgccgtgccaaagcctgcgataccaaacacgatgtacgccacgacgatgccgaggccgatcaccagccaatcaacgccgccaaatgaccactgactcatcagctcgaccgggctcatgggcacttccttgaaagagttggtaatcactttagcgatgagcgagtgttgcgactaatatcatcaaagccctccacccatctcgaaaaggcatgacgtgtgatctccactcgccaactgcgctactttgtcgaaatcgccgacagtggcagcttcagcgctgcggccgaacgtctgtttgtggcgcaatcagcgttgagccgacagataaaagagctggaaacccagctgcaaaccccgctgttcgaacgcaccgcgcgccagccccggctgacggcggccggtgaagccttttaccctcgggcgcgcaacctgttgagtgagttgctcaaggccagcgaaatggccacccaagtcggcaatggccaattgggcacgctgcgcctgagccattcgagcaccgtgccgatgagcggcgccttgctggaaggcatcagcacctggctggagcgctgccccggtgtgtcgatggacatcgtcaaactgtcttccgaagcgcagcttgaggagcttgccgacggtcgcctcgacgtcgggctgttgcgcttgccggtgctgcgccaacgcgaaggcgtgcgggtggtgccgatatacagtgagaaattgctgctggcggtgccgccgagtcacccgctggcacgcagcaatacgccggtcgaattggcgcaactcaaggatgaggcgtttatctcgattccgcatccgcagcgcggtgggttaagttatctgtcagccgaattgtgcatgcgcgcgggattcttccccaaggccgcgcgggtgatgtcgcgcaagaccacgcagttgcaactgatacaggccggtttcggtattgccttgttaccaaaatccatgcaggacatcgcgcccgccaacgtgcattttttgcctctggccgacccggactgcctcagcaccgtggccctggcctgcgcgcaggcgccgagcgcgctggtcgagcaattctgccaaaccttgcacgaatgcctataaactgccgcccatgattaaagatcgctcctcatgattaaagacccgtttgcccgcttgggcctggaccgcgaagtcctgactgtcagccagctcaacggccgcgcgcgggtgttgctggaagacgtgttcaccaatatctgggtcgaaggcgagatctccaacctcgcccgcccggcctccggccatgtgtatttcaccctcaaggacagcggcgcccaggtgcgttgcgcgctgttccgcaacaacgccgcgcgggtgcgccaggcgttgaaggatggcctggcggtgaaggtgcgcggcaaggtctcgctgttcgagggccggggcgactaccagttgatcctcgacaccgtggagcctgccggtgatggtgcgctgcgcctggccttcgatgccttgaaggaaaagctcagcgccgaaggcctgttcagcgccgagcgcaaggtgccgctaccggcccatcctcgacgcattggcattatcagttcgccgacgggcgcggtgatccgcgacatcatcagcgtattcggccgcagggcgccgaacgttgagctgacgttgatccccacagccgtacaaggccgcgaagccgtgtcgcagattgtgcgtgcgctaaagctggccgacgcgcgtggttttgacgcgctgatcctggcccgtggcggcggttcgctggaagacctgtggtgtttcaacgaagaagcggtggcgcgtgcagtagatgcctgcgttacgccgattgtcagcgccgtcgggcatgaaaccgatgtgtcgatctgcgacttcgtcgccgacgtgcgtgcgcctacaccttccgctgctgccgagttgctcgcccccgacgccagccacttggtgcgccaagtcgaaaacctgcatcgccgcctggtgatgctgatgcgcaatcgcctgaatcatgaccgtctgcgcctggaaggcatggcccgccgtctgcgccaccccggcgagcgtctgcgccagcaggcccagcgcctggatgacctggacatgcgcatgcgccgcgccttcgagcgcagcctcaatacccgccgcgaacgtttaatccgcctggaaacccgtctcgccggtcagcaccccggccgtcagttggccctgctgcgccagcgcctggacagcctcgccgaacgcctgccgcgcgccatgcgtgaaggcctcaaggcgcgccgcctgcaactgcaaagccaggtgcagacgctgcaagtggtcagcccgctggcgaccctgggccgtggttacagcatcttgctggatgaacgcggccaggcgatccgcaacgcagcgcaaacccacaccggccagcgcctgaccgcacgcctcggtgaaggccaattgcaggtgcgggtggaagataaccacctgacgcccgtcaccctttcgttattggattgattgatgcctcgtctatttagcctgctgatgctgttgtgcctcaccttcaacgcccatgccgacagctacatcactcggctgttgaacaagccggtgccgggtggcgtcgcagtggtcgacctcggcgtttcagccgcggcgccaaaagccacctaccagaacaggccggtgctggtcgtcaaggaacagaacaactggctggcgattgtcgggattccgctgacggttaagcccggcacacagcgcatcaccagtggcgggcaaagcctgccgtttgtggtgggcttcaagaagtaccccgaacaacacatcacgctgaagaacaaaagccaggtgaacccggacccggcacagctcaagcgcatcgagggcgaactggcggtgcagctcaaggcttaccgcagtttcagcccaaacacgccgagcaacctgctattggacaagccggtcaacgggccgctgtcgagcaagtttggcgtgcgccgcttctttaacggcgaggaacgcaacccgcattcgggcctggacttcgccgtcggtgccggcacgccgatcaagactccggcggcaggcaaagtgatcctcaccggcaactacttctttaacggcaacaccgtgttcgtcgaccatggccagggctttatcagcatgttctgtcatatgtcgaagatcgacgtgaaggtcggggaccaactggcacgcggtgcggtggtgggcaaggtcggttcgaccggccgggcgaccgggccgcatatgcattggaacatcagcctcaacgacgcgcgggtcgacccggcgatctttatcggcgcgttccagccctgataccggcctcatggggggcaagcccggctcccacaggtgagcgcgattccctgtgggagccgggcttgcccgcgatggcgccaggtctgccaacacaattgcgcacccaataaaggccgcgcaataaaaatcaactctcagctaaataaccgccataaaatctcgcccttgcgtcagatagcagaacctctatcaatttttctcgactgcttgccatctttcacccctgcggttagggttgagcttatgaaaacctctcacaccctcattcagctccgccagcaccgcagcctgtgcctcgtcagcgcacgactgccaggctgaatcgatctgcctcgtcttcctgctttatccctaaaaacagttctacggcaggccgccttttctcggcccctacaacaaaggatttcccgatgagcatgctcaaagacccgtcttcgaagtaccgcgcgttcccgactatcgatatcccggaccgcacctggccgtcgaaaaccatcaccgaggcgccgatctggtgcagctccgacctgcgtgatggcaaccagtcgctgatcgagccgatggacgcggtgaaaaagctgcgcttctggaagaccctggttgcggttggcgtgaaggaaatcgaagcctcgttcccggcggcttcgcaaaccgacttcgacttcgtgcgcaccctgatcgaagacaatcacatccccgaggacaccaccatccaggtgctgacccagggccgtgaagacttgatcgcacgcacctttgaatccctgcgcggcgccaaaaaggccatcgtgcacttgtacaacgcgacctcgccgtcgttccgccgcatcgtgttcaaccaggacaaggacggcatcaaggccatcgcggtcaacgccgccaagctgttcgtcaaatacgccgcgcagcagccggaaacccagtggaccttcgaatactccccggaaaccttcagcgccaccgagctggagttcgccaaggaagtctgtgacgcggtgatcgaggtgtggaacccgacgcccgagcacaagatgatcctcaatctgccggccaccgttgaatgcgccacgccgaacatctatgccgaccagatcgaatggttcggccgccatatcaaccgtcgtgacagcgtgatcatcagcctgcacacccacaacgaccgtggcaccggcgtggccgccaccgagctgggcctgatggccggcgccgaccgtgtcgaaggctgcctgttcggcaacggcgagcgcaccggtaacgtcgacctggtcaccgtggcactgaacatgtacacccagggcctcgacccacagctggacttctccgacatcgacggtgtgcgcaaagtcgtcgaggagtgcaaccagattcaagtgcacccacgtcacccgtacgtcggcgacctggtgcacaccgcgttctccggttcccaccaggacgcgatccgcaagggcttctcccagcagaaagacgatgcgctgtgggaagtgccgtacttgccgatcgacccggccgacattggccgcagctacgaggcggtgattcgggtgaacagccagtcgggcaaaggtggcatcgcctacctgctggagcaggaatacgacatcagcctgccgcgccgcatgcagatcgagttcagccaagtggtacaggccgaaaccgaccgcgtgggcctggaaatgacggcgccgcagatctacgccttgctgcagcgtgaatacctgcaagccaacacgccgtacgcgctggtcagccatcgcctgcaggaagagaacggcaacagttttgtcgaggtggaagtctcgggcaaaggccagggcgaaaccaacctgcactggaaaggcaaaggcaacggcgccctggaagcgctggtggccggcctgccaattggcgtggagatcatggactacaacgagcatgccatcggtgccggcaccaacgccaaggcagcggcctacatcgagctgcgcgtgaatggcgagcgtccggtgcatggcgtgggcattgatgaaaacatcaccacggccagcttcaaggcgttgttcagtgcgctgaaccgctcgttgagccagcaggaagcgaaggcggcgtaaacacttaccgctgaaatgcaaaaggccgctgggtgagaatccaggggcctttttgttgggctttaaaaatgcggggcctggaagggcctcatcgcgggcaagcccgctcccacatttggaatgcattcttctgtgggagctggcttgcctgcgatagcggtctgtcagacaaactcaaacctgtcggcatccaggttcgctgggaacttgctgcgatacgccgccagttctgccgcctccaggcacacctgaaacacgccatccgcctccccggcactgagcaaagtctcaccctggaaatccagcacctggctgtctcccgtgtaggcaaagcccttgccatccgtacccactcgattcaccgccgccacgtaacacaggttctcgatggcccgcgccggcaataggcggttccagtgctgacgccgcgctcccggccagttggcggtatacagcagcaaatccgtgtcctgagcatctcgactccagaccggaaagcgcaggtcgtagcaaatcaacggccgaatacgccagcccttcaattcgaactgcacctggcgctcacccggtgtgtagtggtcgtgctcacccgccatccggaacaggtggcgtttgtcgtaatgcaacacttcgccgtccggccgcgcccacagcaggcggttgcgatggctgccgtcggcggcctggatgatcacactgccggtgatcacggcgttgtatttcgccgcctgggcctgcagccactcatgggtggggccatgttcccgctcggcgagcagggccgattccatcgagaagccggtggtgaacatctccggcaatacaatcagatcggcgcccttggcttgctccagcagcagttcgaaatgctccaggttggcctgacggtcatgccacaccaggctggtctggaccagggcgatgctcaggtcgggcagtgcactcaaatcacgcatagtttctccgccgcttgttgcagcgtctcctcgcgtttggcaaagcacaggcgcaccaggcgctggccttggggtgggtgctggtagaacaccgagaccggtatcgtcgccacgccgtgttcgcgggtcatccacagtgacatggcgacgtcatccaggtccgggcgaatctgtgagtaatccaccagttggaagtaagtaccggtcacccgcgtaaagctgaaacgcgacggcgccagcaggtcgcagaacaggtcgcgcttggcctggtaaaaggccggcagttcttcgacgtgttccgggtgttcggccatgaagtccgccaaagcgtactgcaaaggggtcacaccgcagaagttgacatattgatgcaccttgcgcagttcagcggtgagcgccggtggtgcgaccacgtagccggttttccagccggtgacgtggtaggtcttgccgaaggagctgaccacgaacgcacgctgatacagctcttcgtgggctagcacgctgacatggggcacgccgtcgaacaccaggtgttcatagacctcgtcgctgaccaggtagatatcacggtcgcggatcagttcggccaattggtccagttcagcccgactgatcagtgcgccggtggggttatgcggcgagttgaggataatcatgcgcgtacgcggtgagagtgcggccttgagcttttcgaagtccaatgcaaagccttgcaggctcagttgcacgtgcacgcagcggccaccggccaggtcgaccgagggctcatagctgtcgtagctggggtcgaagacgatgacttcatcaccgttgcgaatcacggcctgaatcgcgcagaaaatcgcctcggtggcgccaggggtgatggtcacctcgctgtcgggattcaccgtggcgccataactgcgggcgatcttggccgccacttgttggcgcagcacgggcaagccagtcatcggcgcgtattggttatggccgagggcgatatgtttgcccaccgcatccagcaacgcctgcgggccattgaaatcgggaaagccctgggacaggttgagtgcgccggtctcggcagcgagttgcgacatggtggtgaaaatggtcgtgccgacattcggcagcttgctggtgatcatcggaggcccctgcaggtgagccccaagttttaagctgccggccgcgcggggtcaaggcacaaaccgtcgcgcacaaaaaagggctccaaaggagccctctcttacaacgtgcagcttacaacgtgaagcggcgattatttcttgtcgcggcgcttcttgtcggccttcttgtggtgagtcatcaaacgacgcttcttgttcacctgacggtcagtcaaggtgttcttgttgccttcgtacgggttctcgccacctttgaactcgatacggatcggcgtaccgaccagtttcaagacacggcggtaggtgttttccaggtaacgcacgtaggacttcggcaccttctcgatctggttaccgtggatcacgataatcggcgggttggcaccacccaagtgggcgtaacgcagtttgatccggcggttgttgaccatcggcggcgcgtgctcgccaacagcgtcttcgaggatctgggtcagacggttggtcggccagcgggtgaccgcagacttgaacgagttctgtacggacgcgtagaggttgcccacgccagtgccgtgcagtgccgagataaagtggatatcggcgaactcaacgaagaacagacgacgctgcagctcgatcttgacgaaatcgcgctcgctcggcgtcatgccgtcccacttgttgatcgcgatcaccagggcgcgaccggcttccagggcaaagcccagcaagttgaggtcgtggtccaccacgccttcgcgggcgtccatcacgaagatcaccacgttggcgtctttgatcgcttgcagggttttgaccaccgagaacttttcaacttcctcgtggatcttgccgcgcttgcgcacaccggcggtgtcgatcagcgtgtacttctcgtcgttacgctcgaacgggatgtagatgctgtcgcgggtggtgccgggttggtcatacacgatgacccggtcttcaccgagcatacggttaaccagggtcgacttgcccacgttcgggcggccgatgatggcgatcttgataccgtctttttcgctcgggccaggaatgcgcttggcttcctcaccttcggcaacgatctcctcttcgccctcttcttcctcgacgtcatccttggggaagtcgcgcagggcgatttccagcatctgggtgatgccgcgaccgtgagcaccggcgaccgggatcgcgtcgcccaggcccatcgggctgaattcggcacgggctgcctcaggatcgatgttatcgatcttgttggcgaccaagtaggaacgcttgttgcgcttgcgcaggtgctcgccaatcatctggtcggcagcggtgtagcccgcgcgggcgtccaccaggaacaacacgacatcggcttcttcgatagcgagcagcgactgctcggccatcttttcgtccatgccgtgctcgtcaccggagataccaccggtgtcgacaataatgtaggagcgcccttgccactttgcctcaccgtattggcgatcacgggtcagaccggacaagtcgccgacgatggcgtcgcgagtcctggtcaggcggttgaacaaggtggacttgccgacattaggtcggcccaccagggcgattacgggaaccatgcggctctccacttcgttatttcagaaaatacaaaagccgctgcaaggcagcggctggtgctcggggcagcatattcaaatgccgcatgccccgccgaagcggggccgcctgggttttaccccaagcatagttctttacttgatggtcagggcttccagcttgccgctgttgccatacacgtaaagcatgttacccacaaccagcggacgggcacgcaggccgtcactgtcgatacgctcgcggccgacaaaacgaccgtccacctggctcagcagatgcaggtaaccttcgaagtcacctaccgctacgtagctggagaacacttccggtgccgacagctgacggcgggccagggagtcgttgctccacagtgcagtggtggaacgctcgtcgacactttcaacggtgccggacgccaggcttacgtagacgctgccaaacccttgggcgacaccggcatagctggaagcatcacgctgccagttgatgcggccgctttgcaggtccagcgccgcaacgcggccctggtaggtggcgacgtagatagtctcgcccgacagcagcaagccgccgtcgatgtccacaacgcgatccagttcggaacgaccttgaggtatggccacacgggtttcccaggccggcacgccgttctgggtatccagggcgaccactttaccggtcgacaggcctgcaacggccaggttattggtcacaatcggaccactggtgccgcgcaaggtcagcaccgccggggtgctgtcgtacaaccagcgctggttgccggtagcggcgtccagaccgatcacacggtcatcctgggtctgcaccacaacgatgtcgccgttggtggcaggcgccgagagcacttcactggtcacgcgagagcgccatttctcttcacccgttgccgagtccagagcaactacgtcgcctttgagcgtaccgaccagcaccatgccgtagccgacacccacgccaccggaaaccggcagctcgaggtctttcttccacttcacgtcgccattcatgcgatccatggcaatgatcacgccggtggagtcagtggccacgatgttgtcgccgtcgatcgccggctgcaacaggttgtacaggtcgccctggccatcacccacggagcggctccactgcttttgcaggaccacttcttccttgaagctggtcagctcggcaggaggcagttcttttttactgttgctgctgcaacccgcggccagaacggccagagccagcaatgctgcatgtttccaacggatcacgtcacgcatcccctttggccaagtcgtccagcttgatttgtaagccaccgaccgccgcttcatcagacagcgccgccttggctttttggtacgcagcatgggcttcgtcggtacgacccaattggaccaacaggtcgcccttgagctcttcacgagtggccacaaatgctttgtcagcatcgccgtcgagcagtttgagtgcttcgtcagccttgttctgtgccgccaacacctgcgccaggcgctgacgtgcgatttcacccagggtcgggttggtcggcttgtcggcgatggccttcagttcggtcgcggcgtcatccagcttaccggtgtcgaccgcgactttcgcgacgaacaggctgccgtattgggcgtaggtgctaccgccgaattcgcttttcagcttgccggccaggtccgccacttgggcaggatcaggcttgccgtccggcgtcagcgtggtttccagcaattgctgatagaggatcgaggcgccttgggactggttggcctgatacttgtgccaggcttgccagccgaacaccaccactaaagccagcagaccgccggtaaccaggggcttgccgttacgctgccaccagtccttgaactcggccagctgctcatcatcagtactcgacaccccaatactccttaatcgctaaattcggctgttcgacagcttcaaccctgcacgacgcaggtggccaagtgcgcggcgagcgcatcaaaggcaatgttctgttgctcgccctggccacgcaggggtttgaaacctatcacttgctgggccagttcgtcatcgccgaggatcagcgcatacagcgcaccgctcttgtcggccttcttgaactggctcttgaagctgccggcgccggcattgatctgcaggcgcaggttcggcagttggtcgcggactttttcactcaaggccaaggcagccagttcggcggcctcgccaaaggcgcaaagatacacgtccacctgacgggagatctcttccgggacttgctcaagggtctccagcagcagaatcagccgctcgatgcccatggcaaaacccacgcccgtggtcggcttgccgcccatttgctcgaccaggccgtcgtaacggccaccagcacacacggtgccctgggcgccgagcttgtcggtgacccactcgaacacggtcttgctgtagtaatcaaggccgcggaccagcttcgggttgatcacgtacggaatgccggcagcatccagtcgagccttgaggccttcgaagtggatgcgcgattcgtcgtcaaggtagtcggccattttcggcgcgtcgaccagtacggcctgggtgtcggcgttcttggtatcaagcacgcgcaacgggttggtagtcagacggcgccgactgtcttcgtccaacttgtccacgtgggcaagcaagtactcgacgagcgcaacccggtagcggccccgcgattcgctggtgcccaggctgttgagctcgagtttgaccgcgtcgcggatgcccagcaggccccacaggcgccaggtcaacacgatcagctcggcgtcgatgtccggaccgtcgaggttgaacacttccaggccgatctggtggaactggcgataacgacctttctgcgggcgctcgtggcggaacatcgggccgatgtaccacagcttctgcggctggccaccaccggtgaggccatgctcgagcacggcgcgcacgcacgcggcagtgccttccggacgcagggtcagggagtcgccgttgcggtcttcgaaggtgtacatctctttttcgacgatgtcggtcacttcaccgatggagcgcttgaacagctcggtgaactcgacgatcggcatgcggatctgtttgtaaccgtagttatccaacaggcgcgcgaccgtgctctcgaagtagcgccacagtggcgtctgctccggcaggatgtcgttcatgccacgaatggcttgcagagacttgctcacatctaatccttaaattcgttcttagccgcgcgcgatcagcgctgcgtcagccgcgaccttctcggccgctttctcgcggatcagtctttcgagctcatccaccagattgtcattcgtcaacttctgcgacggcttgccgtcgatgtaaatcaggttcggtgtaccgccggtcaagccgatgtgcgcctctttggcttcacccgggccgttgaccacgcaaccgatcaccgcaacatccagcggcaccagcaggtcttcgaggcgcccttccagctcgttcatggttttcaccacgtcgaagttctgccgcgagcagctcgggcaggcaatgaaattgatgccacgggaacgcaaatgcagggatttgagaatgtcgtaaccgaccttcacttcctctaccgggtctgccgccagggagatgcggatagtatcgccaatcccttcggcgagcagcataccgagacccaccgcagatttcactgtgcctgagcgcaaaccgcccgcttcagtgatacccaagtgcagcggctgtacgatttccttggccagcaggcggtaggcttctaccgccatgaacacgtcggacgcctttacgctgaccttgaagtcctggaaattcaggcgttcaaggtgttcaacgtggcgcagcgccgattcaaccagcgcggccggggtcggttcgccgtatttcttttgcaggtctttttccagggaaccggcgttaacgccgatgcggattggaatgccgcgatcacgggccgcgtccaccaccgcgcgcacacggtcttcgcgaccgatgttgcccgggttgatgcgcaggcaatcgacgcccagttcggccacgcgcaaggcgatcttgtagtcgaagtggatgtctgcaaccagtggcaccttgaccagttgcttgatgcggccaaaggcttcggcagcgtccatgtccggcacggaaacccgcacgatgtccacgccggccgcttccagacggttgatctgggcgacagtggcggccacatcattggtgtcgctgttggtcatgctctgcactgcgatgggggcatcgccacccaccggcaccgagccgacccagatcttgcgcgatacgcgacgtttgattggagattcgccgtgcatgactattgtcccaacttgaggcgagcggtctcgccactggtgaacggcgctacgtccacaggctggccgttgtagaccacttgcgcgccacgggcaaagcccagacgcagcgtcaaaggaggcttgccgccttggtcaagcgtatctcccttacgcttcaaaccgctgaacagcactttgccgttgccatcggtgacttgcgtccagcagtcagcgatgaaagtaatctggatatgcccgtcaccggcgatcaacgcaggcgtggtcggtggcgaaaccgctggcgctgccggagcgactggcgcggtggtcgctggagcctgtgtcgcagttgcaggtgtatgggcctgggcagctggggcggccggagtagccggcgccggtacggcggcggtagcagcgggtgcagtggcagcttcgggcgctggctgctcggcagtggtcggcgcctcaggcgcggcctgaccttcagcaacggcctggtcttccggctcatccagcggatggatctgtgtggtgccgtcggcgctttcgacttcgacgtgctccatggcgttgctggtcaggtccttgctgcgctgggaggcctggtcttgccaccagacaaaaccaccgccgatcacggcgatcagcaataacaggctgacaattcgcaaaattgtgtgggaaacccgcaccggctcttcgatgcgccccaggccatgcacattgctgccctgggagtcggtgccggtgaattggtcgaattcctgtaccagtacggtctggtcaatgcccagcaacttggcataggcgcggatatagccgcgggcgaaggtatgcccaggcagcttgtcgaacgcgccggcttccaggttgcccagcgatgtagtggtcaaattgagcttgagggccacttctgccagcgaccagccattgctttcgcgggcctgacgcaaggtctcgcctgggtttacgcgattagctgctacaacttccgggtgcgccgctttcatcattgctccgacaggtattgctgatattccggcgtaccgggatagagtcgttcgagttgctggccaaatcgtgcggccgtgtcgcgttcttcatgaactgtcgccaggcgcacaccgagcaatagactacgtgcattttgcccgctgagcaggctaaaacgctcgtaatagtcacgtgccggcacataatgcctgtcttcgtaagacaactcagccatttcgagcaacgcgcgtggctgacgactgttcaaatgcagggctttttccaactgttggcgcgcgctgtcgcgctggccgaggcgcatcgaggtgaccccaaggttctcgaacacccgcgaccgctccgggtagagggcatcggcggaggcttgctggaaataacgggaagcctggttataacgtttctgctcgaacaggaagctgccgtaattgttcagcagccgagggtcggcaggacgcgcggccaaggccttgtggaaatattcatcggccaacgcaggctcggcctgcgcctggaacaccagggccagcgctgcattcgcgtcggcatcgtcgccgtccagctcaagggcctttttcaacggcaccttggcctgctcgctcatcccttggcgcaggtaacccaagcccagctgcacgtaggcaactcgcgcctcatcacggcctttatcagtgtgcaaagggctgtcgtggcccgatgaaacacaaccggccacgaggccggtaaacagtaaaagcagcgcaaggcgcaagggcatagaggtcctctctcagattcgattcacagcaatttgcggcaaatcttcggcggcgttaagttcgcgcacggcgatataacgttcgctgcggcgggtgcgatccatcacctgccctaccaattggccacacgcggcgtcgatgtcctcaccacgggtggtgcgtacggtgacgttgtagcccgcctggtggagttgatcctggaaacggcggatggcgttgttgctcggccgctcgtagccagaatgtggaaacgggttaaacggaatcaggttgatcttgcacggggtgttcttgagcagctcgatcatctcgacggcgtgctcaaccttgtcgttgatgtccttgagcatggtgtactcaatggtcaacacacgcttctcacccaaggtagccatgtaacgctggcaagattcgagcagcatcttaagcggatacttcttgttgatcggcaccaattggttacgcaatgcgtcattgggtgcgtgcagcgacaacgccagggagacgtcgatgtgcttggccagctcatcgatcatcggcaccacgccggaggtcgacagggtcacacggcgcttggagatgccgtagcccaggtcgtccatcatcaggtgcatggccgcaatcacgttgtcgaagttcagcagcggctcacccatgcccatcatcaccacgttggtgatggcacggtcgacggttgccgggacgctgccaaaggatttgttggcaatccacacctggccgatgacttcggcggcggtgaggttgctattgaagccttgcttgccggtggagcagaaactgcagtccagggcacagcctgcctgggacgaaacgcacaaggtgccgcgtttgccctggggaatgtacacggtctcgacgcagctgccggacgccacgcgcaccacccacttacgggtgccatcgctggagatgtcctcgctgaccacttcggggccacggacctcagcaatggccttgagcttgtcgcgcagggccttgctgacgttcgtcatggcgtcgaaatcgtcgacgccaaagtggtgaatccacttcattacctgaccggcacggaaacgcttctccccgattgagtcgaagaatttctccatttccggctgagtcagacccagcaggttggtttttacagtcgatgtagtcatggattcaccctcactctttaagccgatgcttagcgagcggttacttcagtagcagcgaaaaagtacgagatttcgcgagcagcagcggcttcggagtccgaaccgtgaacagcgttggcgtcgatggactcagcgaagtcagcacggatggtgccggcagccgcttctttagggttggtagcgcccatcagctcgcggttcagagcgatagcgttttcgccttccagaacctgaacaacaacaggaccggagatcatgaaggagaccaggtcgccgaagaagccacgtgcgctgtgctcagcgtagaagccttcagcttcagctttggacagttgcttgagtttcgaagctacaaccttcaggccggctttttcgaaacgagtggtgatctcgccgatgacgttttttgcaacagcgtcaggcttgatgatggagaaagtacgttgaacagccatggtgtaactccagaaacggtaatttacgaaaaattaaacccgcgaattatacgcgggttattgggtattgcctaactgcgtaaaaaggcggctcagtcgtctgcttcttcgatccacagaccctgaatcgcctccagaaccttttcgccaccccggtccgggatatcgtcgaattccggcagcgccactacgaggttgcgcagcttgacgaagttcacggtaagaggattgacctcaggatgagcttcagcaagttgtatagcgatttcttgtacatcaacccatttcaggctcatgacatttccttgaatcaatgcggcgcttcggctgcatggttgagggaatatttcggaatttcgacggtgatgtcttcagtcccaaccttggcctgacagcttaggcgagaagtcgcttccaggccccaggcgcgatccagaaagtcctcttccagctcatcggcgtcttccagagagttgaaaccctcacgaatcacgcaatggcaggtggtgcaggcgcagacaccgccgcaggcactttcgatctcgatgtggttgtcatgggcaacttcgaggatggacttgccggtctcagcctccacgaccataccgtccgggcaatgctcggcgtgtggcagaaaaatgacctgcggcattaattattcctcgatttcattcagattgcgcccggccagggcggcttttaccgactggtccatgcgacgggcggcaaaagcatcggtcacttgcgacagacgcttggtctgttgctcgatggcgtagccatcggtgcctttcgtcagttcggccagttcctgcatctgcagatcaatgaccatgcgctcttcggcgtccaacaggcgctcgccgtcagcatccagggcgccctgcacggcttcaagcaggcgctgggcgtcgacttgctgctcgcgcaatacgcgggcgactttgtcgtcaccggcatattggaacgaatccttgagcatcttggcgatttcgccgtcggtcaggccgtaggacggcttgacctgaatgctggcttcaacgcccgaggccagttcacgcgcagccacgctgagcaggccatcggcgtctacctgataggtcacgcgaatcttcgctgcaccggcaaccatcgctggaataccgcgcaattcgaagcgtgccagagagcggcagtcgctgatcagctcgcgctcaccttgcagcacatgaatcatcatggccgtctggccatctttataagtggtgaagtcctgggcgcgggcgacggggatggtggtgttgcgcggaatcaccttctccatcaggccgcccatggtttccagccccagggacagcgggatcacgtcgagcagcagcaattcgccgccgtcgcgcttgttgccggccaaggtgtcggcctggatcgcagcgccgatggcgaccacttgatccgggtcgatttcagtcagcggctggcgaccaaaggcttcaccaacggcttcgcgaacccgtgggacgcgcgtcgaaccgccgaccatgaccacggcggccacgtcttccagctctacgccggaatcgcgcacggcacggcggcaggctttcaggctgcgggcaaccattggctcgatcagcgcatcgaaggcttcacgggtcagttgagccgaccaggaaccgtaggaaacatcgacagaattggcatcagtcagcgcttctttggccgcacaggcggtttgcagcaggttgcgctgctcgcccgggtccaaatcagcagacaaaccggcgctggtgataatccagccggcaatcgcgtgatcgaagtcatcaccacccaaggcggtatcaccaccggtggccagcacttcgaacacaccgccggtcaggcgcaggatcgaaatatcgaaggtgccgccgcccaggtcataaatagcaaccaggccttcagcgtgttgatccagcccgtaagccactgcggccgccgtcggttcgttgagcaggcgcagcacgttcagaccggcgagcttcgccgcgtctttggtggcctggcgctgtgcgtcgtcgaaatacgcaggaacagtaatcaccgcgccaaccagttcgccgcccaaggtcttttctgcacgctggcgcagcaccttgaggatatcggccgacacttccaccgggcttttagggccttggacggtgtcgatgaacggcatatgggattcgccgccgacgaagcggtacggcagctggtcgcccaattgcttgacgtcggacagaccacgacccatcaagcgcttgaccgacagcacggtattcaaaggatcggtagacgccgccagcttggccgactcaccgacttcggtgcgatcagcgtgatagcgcacggcggacggcaggataacctggccatcggcgtcgggcagcggctcggacaggccgctgcgcaaggcagcaaccagggaattggtggtgcccaggtcaatcccgaccgccaggcgacgctggtgcggttgagggctttggccgggttcggcgatctgcagtagagccatggtaatcaggtcttatctgtctatcaggcgtgcacgggcagcactgggttaatcgtcgaggcgctcttctaactggcgcacttcgtaggtgagcttgtcgaggaactgcatgcgccgcatcaggcgctcggcctgttcacgttgcgctgcatcatcccaacaggctgcgaagctttcgttgagctcatcctgggccactttcagacggcgcttgaagactgcgacaccggccacatcggcctcgtcctgcaaatcttcgagttcttcgcgccactgcatctgctgcatcaggaagtccgggtcgtgcaccgtgacttcaatcggcaactcgccaccgttcatcgcgagcaggtagcgcgcgcgtttgggcgggtttttcagcgtctgataggcttcgttgaggctggctgatcgctccagcgccaagcgttgctcacgctcggaagcgtcagcaaagcggtccggatgcaccccacgcgccaactctcggtagcgcgtggcaagctgttcgaggtccagccgaaagctcggctgcagctcgaataaagcgaaatgacaaggagtacccacgaatagcctcagatgttgaagctttcgccgcagccacattcaccgcgcacgttggggttgttgaacttgaagccttcgttcaacccttccttgacgaaatcgagctcggtgccgtccaggtaggtcaggcttttagggtcgatgatcactttctcgccgtgactttcgaacacctggtcttccgcaaccacctcgtcgacaaactccagcacgtaggcaaggccggaacagcccgtggtgcgaacacccagacgaatcccctcacctttaccgcgcccattcagggagcggcgaatgtgctgcgcagccgcttctgtcatgctgatagccatcgttgactccttactcgtcgccaaatgcttagatcaagcctttcttctgcttatagtcgcgaacggccgccttgatggcgtcttctgcgagtaccgagcaatggattttcactggcggcagggccagttcttcagccagctgggtgttgctgatggtgacagcctcatccagggtcttgcctttcatccactcggtggcgagggagctggaggcaatggcggaaccgcagccgtaagtcttgaacttggcgtcttcgataacgccagcgtcgttgaccttgatctgcaggcgcataacgtcgccgcacgccggagcgccgaccatgccagtgccgacatcagggtcttccgcgttcatcttgccgacgttgcgcgggttttcgtagtggtcgatgaccttttcgctgtaagccatggtactgaatcctcactcatcagggccgctctggaaccctgtaaaaacgcctgcgttttccgccacgttcttacagagcttgggtggcggcttctatatttagtgtgccgcccactcgatcttggaaatatcgacaccgtctttgtacatgtcccacagcggcgacagaacgcgcagcttgttgacggcttcgcagactttctgcgcggcgtagtcgacttgctcttcggtggtgaagcggccgaacgtaaagcggatcgagctgtgtgccagttcgtcgttgcggcccagggcgcgcagcacgtacgaaggctcaagcgaggccgaggtgcaggccgaaccggacgaaactgccaggtccttgagtgccatgatcagcgactcgccttcgacatagttgaagctcaaattcaggttgtgcggtacacgggcggtcatgctgccgttgatgtacagctcttcaaggttctcgacctgcttgtagaagcgatcgctgagggccttgatgcggatgttttcggcggccatgtcttccttggctacacggaaggcttcgcccatgccaacgatctggtgggtcgccagggtgccggaacgcatgccacgctcatgaccgccgccgtgcatggtggcttcgatacgtacacgcggcttgcggctgacgtacagggcaccaatgcctttagggccataggtcttgtgggccgagaacgacatcaggtcgactttcagcttcgacaggtcgatgtcgaccttgccggtggactgcgccgcgtcaacatgcagcaggatgcccttggaacgggtcaactcgccgatggccgcgatgtcgttgatggtgccgatttcgttgttcacgtgaataacggaaaccaggatggtgtcttcacgcagtgcggcttcgatcatggccggggtgacgataccgtcggtggttggctcgaggtaggtgacctcgaaaccttcacgctccagttggcgcatggtgtcgaggacagccttgtgctcaatcttggtggtgatcaggtgtttgcctttggtcgcgtagaaatgcgccgcgcccttgattgccaggttgtcggactcggtagcaccagaggtccagacgatttcacgcgggtctgcgcccaccaggtcagcgacttggcgacgagcgttctcgaccgcttcctcggctttccagccgaacacgtgagaacgggaggctgggttgccgaagtttccgtcaaccagcaggcattcgctcatcttttgcgcgacacgcggatcaaccggggtggtcgctgagtaatcaaggtaaatcggcaatttcatggactttctcctaaatcaggctggctggcgtgccgttagctctgcggctgtcactcgacggcggacgcttcaatcttgtccagacgcggcgccttggtattgcaacggcgctggtcctgacgctgggctacttcttgcacctcacggcgagtcacaagatcagccaagctgataccactcaaaaactcatggatctgcaggctcaagtcacaccacaagtggtgtgtcaggcaggtgtcgccggcgtggcaatcacccaaaccctggcatttggtggcatcgacggattcgttcaccgcgtcgatcacctgggctacctggatgccctgcatgtcgcgggacagttggtagccgccacccggccctcggacgctggaaaccaggttgctgcggcgcaacttggcgaacagctgttcgaggtaggacagggaaatgccttggcgctcggagatatcggccagggacaccggcccagtttgcgcgtgcaaggccagatccagcatggcggttaccgcgtatcggccttttgtagtcagtctcatggacaagtaccaaggtgtttcagaatgggagcaagtatgcgattcccgagtatttaagtcaactataagacctagtactttagtcaggattacccgtaaaaagggcgcgcgaatcatagcagggtggggtgggatcgaacagcaggaacaaggccacgactcaatctcaagaccaatggagatcaaatgtgggagctggcttgcctgcgattgcggcgggtcagccattcaaagggtagctggcagaccgctatcgcaggcaagccagctcccacaggggatttgcagcgaatgcgagacctcagccagccttggtggcggtttcgttcttgatctcggcgaagtcttcttcgcgcagctcaggcagatctttcgcacagtagctgctgcccagttctttcagcgcaccacacatgccatccagcttgccgtcgaccgcttgcaagtggtcaagcaactgcccaatggcacgcgccacggggtcgggcatgtcttcgctgacgccgtaggcatcaaagccgatcttttcggccatggccttgcgcttggcttcctgctcgtcgcccgcttccggcttcacgatgatgcgccccggaatacctacaacagtggcgccaggcggcacagccttggtcactacagcattcgagccgactttggcaccggcgccgacagtaaatggaccgagcaccttggcgcccgcccccaccaccacgccgtcacccagggttggatggcgtttgcctttgttccagctggtgccgcccagggtcacgccctgatacagcgtcacatcgtcaccgatttcagcggtctcgccgatcacgatgcccatgccatggtcgataaaaaagcgacgccccaccttggcccccggatgaatctcgatcccggtcagccagcggccaaagttcgacaccagccgcgccagccatttccagcccatgccccataaggcgccggacagacgatggatccagatcgcgtgcatgccggggtagcaggtcagcacttcaaaggcgttgcgcgccgccgggtcacggtggaaaacactctggatatcttctcgcaaacgctcgaacatttttaatccttccgcttaagaagctcgccacgggccgctttttgggtttccgtgaggatgccacgcaatatattcatttccgctcggctcaccgagctgcgcccgaacaggcgacgcaggcgcgccatcaagtgccgtggtttttccggatcgaggaattcaatggccaccagggtttgctccaggtgttcatagaatcgctcgagctcgtccatggtggccaactcgccacttttggtcgaggcaacttcatccttttccactttgctcggctgaccttcagcggccagccaggccatgcgcacttcatagctcaacacctgcaccgccgccccgagattcagcgagctgaactcagggtctgatggaatgtgcacgtggtaatgacatcgctgcagctcttcattggtcaggccggagtcttcacgaccaaataccaaggcaatttcagcaccgccggcggcctcttccaccaccttggtgccgcactcgcgcgggtccagcagtggccagggaatgcgacggtcacgggcgctggtgccgagcaccagattgcaaccgaccagggcgtcttccagagtggcgacgacctgggctttttccaggatgtcattggcgccggatgcgcgggcatcggcctcgtggtgcgggaacacgcgcggttcgaccagcaccaggcgcgtcagccccatgtttttcatggctcgcgccaccccgccgatgttgccgggatgactggtattgaccaagacgacacgaatgttttgcagcaagggaggcgctctcggacacgggaaaggggagcaaatcttacagaacagcctaaggttatgccatgaaagctaacgtcgtccttcacctgaagaaagtttctgctagaatgctcggctttctttaacaaccttaggtgacacatccatgcagcccatgctgaatatcgcgctgcgcgccgcccgcagcgccagtgaattgatcttccgctccatcgagcgcctggataccatcaaggtcgacgaaaaagacgccaaggattatgtatccgaggtggatcgcgccgccgaacagaaaatcatcgacgctctgcgcaaggcctaccctacccacggcatcctcggtgaagaaaccggtttgcacaaaggcagcggcgaaggcgaagactacctgtggatcatcgacccactggacggtaccaccaacttcctgcgcggcatcccacacttcgctgtgagcattgcctgcaaataccgtggccgtctggaacacgctgttgtgctggacccggttcgccaggaagaattcaccgccagccgtggccgtggcgcccagctgaacggtcgtcgcctgcgtgtaagcggccgcaccagcctcgacggcgccctgctgggcactggcttcccgttccgtgacgaccagatggacaacctggaaaactacctgggcatgttccgcgccctggttggtcagaccgccggcatccgtcgcgctggcgcggcaagcctggacctggcttacgtagctgccggtcgtttcgatgcgttctgggagtcgggcctgtcggagtgggacatggctgcaggcgccctgctgatccaggaagcgggcggcctggtgagcgacttcaccggtggtcacgacttccttgagaaaggccatgtggttgccggcaacaccaaatgcttcaaggcagtactgacggcgatccagccgcacctgccggcttcgctgaagcgttaagcgagcgagcacaaaaaagcaccccgaggggtgctttttttatgcctgggatttgggtaaacccaatcccactgactcaaacacaatgtaatgtgggagctggcttgcctgcgatagcggcctgccagccagctgattagctgctgacccaccgctatcgccggcaagccagctcccacatttagaccgaagccaggctttggaattactgctggttctggcccagaatcaaacgaccttctttgtcgactggaatctggccacctggatcacggtccatacgcaccgaaccttctttaccatccagggtgtaccgcacgtcataaccgacaaccttgtcgctgatgtcgttgacggtgttacaacgggtttgcgtggtggtgtaggtatcgcggttctgcatgccttcctgaaccttgttaccggcgtaaccgccaccgaccgcaccggctaccgtagccagcttcttgccattaccgccaccgacctggttgcccaacagaccaccagccagcgcaccgaccacagtaccaacgatttgatgctgatcctgcaccggcttctggcgggttacggcgacgtctttgcagacttcgcgcggggttttaatctgggttttcaccggctgtaccgccagcacttgcgcatactcagggccgctttttaccaggctgtaggtggcaacagcacccccggcagtcacaccgacagcacccaataccgcaccaaccagcaacgacttgttcacgttgaacctcctgaccatcacaaacggaccgaacgatccgcgctatacccagccttggagcaaaaaaaaaggcgcgagttcaatactcgcgccttctttgtaacagcgtgtcaacaaacgcccatcaagggcggtcgtcgacctccttgccggtagtggcaggagggatcaagtcttcgctgttgaggttcagccagatcagcaccacgttggcgatgtagatcgacgagtaggtgcccgccagaacgccgatgaacagcgccagggagaagccccacaggttgtcgccaccgaagatcatcagcgccgcaatcgccagcaacgtggagatcgacgtcgccatggtccgcagcagggtctgggtcgtggaaacgttgatgttctcgatcagcgacgccttgcgcagtacgcggaagttctcacgaacccggtcgaataccacgatggtgtcgttgagcgagtaaccaatgatcgccagcaccgccgccaacaccgtcaggtcgaaggtgatctggaagtacgcgaggatacccacggtcacgatcacgtcgtggatcagcgacacaatggcgccgacgccgaacttccactgaaagcggaacgccaggtagatcatgatgccgaccagcgccatcagcatgccgaggccgccctggtcgcgcagctcttcacctacctgcgggcctacgaactcaacgcgcttgaccgacgccgggttgtcgccgccgaccttctgcaaggcctcggctacctggtgacccagttgcgggtcttcgccaggcatacgcaccagcaggtcggtagtcgcaccaaagctctgcacgatggcttcgtgatagccggccttgaccagctcattgcgcaccagcgtgacgtcggcgggcttctcgtaggtcagctcgatgagcgtaccgccggtgaagtccagaccgtagttcaggcccttatggaaccagctgaacagcgccagaacggtaaggagcatggtgaagccgaacgcaacgttgcgaacgcccatgaagttgattgtacgtaacatggcagccccttaaatccacaacttcttgaagtcacgtccgccaaagatcaggttgaccattgcgcgggtcaccatgatggccgtgaacatcgaggtaaagataccgagggacatggtcaccgcaaaacctttgacggggcctgtgcccatggcaaagagaatcccgccgaccagcaaagtggtcaagttggagtcgagaatcgcggtaaatgcccggccgaagccttcgttgattgcacgctgtacggtcatgcccgccgcgatctcttcacgaatacgcgagaagatcagtacgttggcgtctaccgccatacccatggtgagcacgataccggcgatacctggcagggtcagcgtagcgcccagcagcgacatcaaggccagcagcatcaccatgttgcccgccagggccacggtggcgatgatgccgaagaagcggtagatggcgatgatgaacagcgacacgaacagcatgccccacaaggctgcgtcgatacctttggtgatgttgtcggcacccaggctcgggccaatggtgcgttcttcagcgaagtacatcggcgccgccaggccaccagcacgcagcagcagtgccagctcggacgattcgccctggccgttcaggccagtgatgcggaattgagcacccagcggcgactggatggtcgccaggctgatgatcttcttctcttccttgaaggtttgcaccggcacatctttctcgacgccgtcgaccacttgcttggtgtaagtggtaaccggacgttgctcgatgaagatcaccgccatgctgcggccgacgttgctgcgcgtggcgcggctcatcaagtcgccgccgtggccatccagacggatgttcacttcaggcgtgccgtgctgcgagtcaaaacccgccttggcgtcggtcacctggtcaccggtgatgatcaagccacgttcgatcaacgctggaggacggttaccttcacggaactcgaattcttcggcagtcgcgcgggaagcacccggctcagcagccagacggaattccaggttggcggttttacccaggatacgcttggcttcagcggtgtcctgtacgcccggcagctcaaccacgatgcggttggcaccctgacgctgaacgatcggctcggccacacccagctcgttgacgcggttacgtaccgtggtcaagttctgcttgatggagtattcgcggatttccgccagcttggccggggtcatcgccagacgcagtacaggttggccgttcaggtcagccggtacgatgtcgaaatcgttgaagttcttgcgcaccagcgcacgggcctgttcgcgggtagcttcatcagagaagcccagctggatggcaccgttgagctgcggcaggctgcgataacgcaacttctctttacgcagcaggctcttcacgtcaccttcgtagaccttcaggcgtgcgtccagggctttgtccatgtcgacttccagcaggaagtgcacaccaccggacaagtccaggcccagcttcatcgggtgcgcgccaatgctgcgcagccattttggcgtggtctgtgccaggttcagtgcaacaacgtagtcgtcacccatggccttgcgcacaacgtctttggccggcaattggtcttctgccttggtcaggcgcaacaagccgcccttcgcatcagatgccagtgttgccgctttaacctggatgcccgcgtcggtgagcgctttgctcgcgcgttccaggtcagcctgattgacttgcagcgaagtgctggcgccagtgatctggatcgcagggtcatcaggataaagattgggagcggaataaataaaaccgatcgccagcaccgccaggatcagtacgtatttccacagagggtatttgttcagcatcacgccgcccgcttataacgcggggcgccttgcgcgccccgtcgattggtaaaggttgttactcagatcgctttgagcgtgccttttggcagcgtggcggcgatggcgcccttctggaacttcatttctacggtgtcggagacttccagaaccacgaaagcatcggaaaccttggtgatcttgccggcgatgccgccagtggtcacaacttcgtcgcctttttgcaggctgcccagcaggtttttctgctctttggcgcgcttggcctgtggacgccagatcatcaggtagaagatgaccaggaagccgaccaggaaaatccactcaaaaccaccggccatagggccggcagcggcaggcgcagcggcgtcagccatggcattagagataaaaaagctcatttagcactccagttgcaaatagtgaatcttagggtcggaaaactcagtccaagggcggcacagggagcccgcgcttggcatagaaggcatcgacgaaggcggccaatgtaccctgttgaatagcctcgcgcaaaccagccatcaggacttggtagtgacgcaaattgtggatggtattcaacatgctacccagcatttccccgcatttgtccagatggtgcagataagcacgcgagaagttctggcaggtgtagcagtcacaggtgggatccagcggcgaatcatcatggcgatggaacgcgttacggatcttcagcacgcctgtatcgatgaacagatgcccattgcgggcattacgggttggcatcacgcaatcgaacatgtccacaccgcggcgcacaccctctacgagatcttccggtttgccaacgcccataaggtaacgaggtttgtcagccggcatcaggcctggcaggtaatccagcaccttgatcatttcgtgcttgggctcgcccaccgacaaaccgccgatggccaggccgtcaaagccgatcttgtccaagccttccagcgagcgcttgcgcaggctttcgtgcatgccgccctggacgataccgaacagcgccgcggtgttgtcgccgtgggcgttcttcgaacgctgggcccaacgcagcgacagctccatggagatacgcgcgacgtcttcgtccgccgggtacggcgtgcattcgtcgaagatcatcacgatgtcggaacccaggtcgcgctgcacctgcatcgattcttccgggcccatgaacaccttggaaccgtcgaccggcgaggcgaaggtcacgccctcctccttgatcttgcgcatggcgcccaggctgaacacctggaaaccaccggagtcggtgaggatcgggccttgccacttcatgaagtcatgcaggtcgccatgcttcttgatcacttccgtgcccgggcgcagccacaggtggaaggtgttgccgaggatgatctcggcgccggtggcgacgatgtcacgcggcagcatgcctttaacggtgccgtaggtgcccaccggcatgaaggccggggtttccacggtgccgcgcgggaaagtgaggcgaccacgacgagccttgccgtccgtggccaacagttcaaacgacatacgactcatgattgttcctcagggcccgcttctttaggagcagtcggcgcagggtttcgggtgataaacatcgcatcaccgtagctgaaaaaacggtactcgttggcgatggcggcttgataagcggccatggtttccgggtaaccggcaaatgccgacaccagcatcaacagcgtggattcgggcaaatggaagttggtgaccaggcaatcgaccacatggaacggccggcctgggaagataaagatatcggtgtcgccgctgaacggcttgagcacgccatcacgcgccgcactctccagcgaacgcacgctggtggtgcccaccgccaccacgcgcccgccgcgcgccttgcacgcggccactgcatccacgacttcctggctgacttccagccactcgctgtgcatatggtggtcttcgatgttatccacacgcaccggctgaaacgtgccggcccccacgtgcagggtcacataggcgctttcgacgcccttggcggcaatcgcgtccagcagcggctggtcgaaatgcaggcccgcagtcggcgcggccacggcgccaaggcgctgcgagtacaccgtctgatagcgctcgcggtccgcgtcttcgtcggggcggtctatataaggaggcaacggcatatggccgacgcgctccagcagcggcaacacctcttcggcgaacctgagctcgaacaacgcgtcatggcgcgcgaccatctcggcctcgccaccgccatcgatcaagatgctcgaacccggtttcggcgacttgctggagcgcacatgggccagcacgcgatggctgtccagcacccgctccaccagaatttccagcttgccgccagaggctttctggccaaacagccgtgccggaatcacccgggtattgttaaacaccatcaaatcgcctgggcgcaaatgctcaagcaaatcagtgaattgacggtgtgcgagggcaccgctcaccccgtccagggtcagcagtcgactggcgcgacgctcggccaaagggtggcgagcgatcagcgaatcagggagctcaaaagtaaagtcagcaacgcgcatgatggggttcgtctagcagggccgggaagtctagcggaaatagtgaaaattgaccatgaaacgtgattgaccaacggtaatctcatctctatacttcgccgccattgagccctgatggcggaattggtagacgcggcggattcaaaatccgttttcgaaaggagtgggagttcgagtctccctcggggcaccatcttaaagaaagaccttgaaattcaaggtcttttttttcgcctgtagaaaagtgagtaaacacaggcgaacgcagacgttgaggagccgggaccatggaattgacgctggaagctgttgcgctttttgctctcaagctggtgcatgagaccgaaggcgcgagcccgattctgcgggacgatctggtcatggatgggtatgagcgggaggtgttcgggttgttggtgcgccaaggggatttggccacgattcaacgcaagcttgatgagtgcatcacccaggcattggatactttaggcggcgccgacaccgtactcgggcgcgagctgcacaaactggccgccgctgtgcagcaggtccgcagccttgatgagctaagcccgccgctgaccaccctccagggctatctgaaagatatccagtgaatcaacgatcaacatgccggccaggtaaaccatcaacactgcaacgccagcgtccaggcatcgccacaccacgggggcgcgaaacagccaggtcaaacgctggcatcccagcgccaacagcacaaaccacaccaacgacgccgtcatcgcgcctgtcgcgaacagggcttgctggcctgcgggtttggccgcgccgatagagccgatcagcaccaccgtatccagccaggcataagggttggcgaagccgagcaccatcgccgtgcgtaacagcccccgttgcgagttaccgccttgagtgtccggcatggactggttacggatgcaggccagcaagcgctgaccaccgaaccacaacagataggccgcgccagacaagagcaatagcgccatcaccgccggccaactttccagtacagaccctaaccccgtgacgccaatagcgatcaggaggacatcggccagcacacaaatagcgaccacccaccagatcggaccacggccgacaccttggcggatcaccaaggtgtcttttgggccgggggccgcgaacagtccgatgcccaggagcaagccttcgaggtacagggcgttgaagtgtggaaacatggaatgttcgaacccgcacggcgattaaagaagttggataggctgattgccgaaaccggtatgacgcgcgttgacggcgccgttcaggtcaatgggtttgcggcggaaaaagctggttggcagctgctccgggctcggatttgcgaagtaaatcaacgagcttctggcgaccggctgtttaggtgccagcacagcatgataggcagccggaatggactgatcggaaagctcggtgagcaaggagcctgccagcactgcaatctcgccttccaggagcctgaccggctctaacgaaccgcccttgaccaagaccagcccttcgcgggtaggcttgataaacgacagcatgtgcccatcttcatgagggtcctgagcaaattgacgcgcgccgtttgtggtctgagcaccgtatacacagagctggatataagacgccaaccgcaggggtgctaatggcgcaacgccaaactctgcacaaatgccgtccattaatccttgggcgagctcgctgatctggcgctcaaaactatctaccgcagtaaagaacgggctttgggtgaattccagatccattcgcttcgacgcatgcgcgggccagtaacagaagcgctcacacaagtcggggtggtcttcgatactcgaatattcagcgccaaaagggaaaaaaccgtcagtgtcttcgacaaaggaaaatgattgcttggtggtttgggaaatagccgagtacccatcaataatctttctgtagtcctgctgcatcgcatctgaaatctgcagggtgccaaagcctgatcgagcaatggattcacagcacgcttttatctgtttcatagctatatccagaaatagttgtaaaggaatgcaacaaacacgaggtcgcaagcatgcgagaaaccgcgacactggatatagccaatcaaaacgcggactatccatgtccttcacaacgtcgctagcagggtgcgagtgtgcatgggccactacccgttgcggcgagcagattgtcctttttggctaacaacgtaacgaccttcaccaaggactggggatgagtaatcgactatgagcatcaagacgcgcgacaccctccgagcgctggtcgtacgacgcagccgggaactgggtaaatccatgaccattctggccaaggaagccggcatatccagaacctacctctacggattggcaggcggtgcgtcccaagacccctcggtacgcacgctgatcaaactcgccaaggcgctgcaggtttctccgctgttgctgttccgctatttcgccgacctcgcaggcgctccggctgacgccaactcactggccaccaccaaccgcgctatcagcctgaatgacccgagtgatatcgccgtcttcaatgcagacgtcaccacgcccgatcaaaccgtggtgctgcccggcgaagtttttcagaaaacctgggagctccagaacctcggcactcgcccctggcgcggccgcaagctggtgcgggtggacggcgaatacgtcatcgcccggcgcaccgccacgggcgcgccattggaagtggtgatggacacacacctgcgcagcctgaacaacgaaattgccattgcagaaaccctgcccggccagccggtgcacatcaccgtggaattcgccgcccccaaggaaacctgcaccgtcacgtcgatctggcggatcgaggatgaacacggccagccctgttacggccctgccttcatcctccatgtgatcgtcaacgtcatggcccgctgagcacggaaccaaacgcagcgttgcgaccacccactcaccgccgcccttcaaccgccatacgcaccgccaaccccatcaacaccgagcccatgacccaacgctgcaccacctgccaactcggccgggtgacaaagaacaccgcgatggagcctgccatgatggcaatcaccgagttaacgctcacgctgatagcaatctgcgtaaagcccaggatcagcgactgcgtcagcacactgccatggccgttcgggtcaatgaactgcggcaacaatgacaaatacatcaccgccactttggggttcagcaggttggtcacaaagcccatcatgaacagcttgcgcgggctgtcctggggcaaatcgcgaacctgaaagggcgaacggccacccggcttgaccgcctgccaggccaggtacaccagatacaacgcaccaccgaggcgcagcgcgtcgtacgcaaagggcaccgccatcaccaacgcggtaatgcccaatgccgcgcaaaacatataaacaaggaaacccaacgcaacaccgcccagcgaaatcaacccggccgtgcggccctggcaaatcgagcgggaaatgaggtaaatcatgttcggcccgggcgtgagcaccatgccgagtgagatcaggccataagcaagccagctggacagttcgggcatggtgtcgctccttgaatagtgtgctgggcgccatggtaaggcgccgaacagcagcccgttagatacagatccacgagcaaaacgtcatacacacacgccggcggacaccgccccattcacccaaggacaggcacatgatcgacttcaacaacaaaggcttcttcaaactcaaacaaaacaacgaatacgccgaacgcgtctcggccctgctgctcgacggcgaagaagtgatcgacgcctacaaagccatgcgcgacggcgtggtcttcaccaccaaacgcatcatcgccgtgaacgtgcaggggataaccggcagcaagaaggacttcacctcgctgccgtacaaaaacatcgtcgcgtactcagtggaaacgtccgggacgtttgatctggattcggaactggagatttacttttcgtcgctggggaaagtgaagtttgagttcaccgggaagacttcgattgtggaaatctcgcggatcatttccaagcacctgctggcctgaattgcaggcaaaaaaaagaccttggcgtcccaaggtctcttttactgctaaacgatttacacggatgtaccaagatcaaaatgtgggagctggcttgtcgggtcgccgcatcgctgcgaagacgccagcccaaacaccatcacctcacccgcctacacacccacagcctccccctcctccatcaccccattcggcaacatcccattcgccaaatcatccaccaccgccttcgccatctcccccaaataatgcgctgcccaggcataacggtccgcgcttttgtccatggcggcatccaacgcgagcattttggaacagtgaagtagttcggaagcatgttccagggcatcgcggatgggtacgccggagttgacgcggaataggcggtggaggtcgggctgttggccgcaggtggagaaggtgatgatgccgagggttttgttgaggggtgggttgatcattgggcacctccggaccgtgtggagatggtgacgacggtgctacgttggtacgacctatcagaaacgctcattgcttaagctcctaatgtagtgagccgccacgttcgtttctcatgcgaatgggtggcagctatgcgcgggctgagaaaccgggacaataggaacccggcagacccgaaggtctcccacgcatagccgccatgacacagacatacgagcacaaaaaagcgccaacagtctaatggatggtggcgcctatgcgcctattgtctctcggattctcaagtccggacgctggttggaagcgacatcacaaaggtagctcgcaaagatataagtttggaagagacagcttgtagcgaaaggtttcgtaagcgccgtccagatcaatagtcgtaaaaaagcaactgctgctcgctcaactcctcttcatttgactcgaaaatacaggcaggatatggcctaaaaaatcaggcctgcctcctctttcctaagcaacaacggttacaaagggtggaccgatagtgctcacagccgtgactaccttcgtgctctcattgctcgaacgggtgacgacgcagaaatgccatagtgtcaaaaaacccaaatggaactacaattcggcaggaagggaacgaaaacaatgcctcaaaattacgaacaatcagcgctgagacatttttctgatgcagaaaaattagcaaatttggggagtttaggtggtgcaggccatttgattggattctccgcagagtgcgctattaagtattgcgttgctaacctaaggccggataacgaagtgccacacgttcacttcccccagattattgaggctgcaaaaaagcaacttcatggcagaagacaaagcgtaatgcacaacacactaaaacgtccagagcttatgtcgggatggaaaattgagcagcgttattcggccgacaatactataactcaagacacttacaacaaatggcgcgaacacgcatcaacgatcatcttcgcttcaggactaaagcgctaaggagcaattatgaaaaccaaattactacaaccgctccgctatgatgatgtactaccagaacttgtatctttgattataaacgagttcggagataccgccctagacaaaaatctaatccttagagatgcggacgggtttgttacgtttgtactaagagaagatcttgacacaaaaaaaatacaaaagctttccaactccatctccaccagacttaaaaaatacgcaacaagccagcctgtatcaaccccatctgaaatgtatagcagcgaactttcgtcttttgatcacgatcagtgggaactagtgagactaggtaaggaaaccgacctgcatgtacgctatatagagcgaagaattgtcggcggtgactgggtcagaggcatgctcgaaccgttaaacgatatcccccctgtagttgttttttcaagtcacaagggtggggtaggacgctcaacagcgctgtctgtagcagcctcagacttagcacgcacaggcaaatctgtacttgcgatagacctagacttggaggcaccggggattggaggtatgtttcactccaatgactcactccctgaattcggagcaattgattattacgtcgagtttgggcgaagtgaaatcgatgactcatttttaaatgatatgaccgcaacgactacaagccctgacagtggaggatcattaaccattgtgcctgccgccggaaaagtttgcaaacgcaatcctgagaacgtaattgggaaaatctcgagagcatacttagaatctatagatgacactggtgaaactttatcttttctagataaaaccaggcgtatgttagtggacctttgcagggtcaaaaaatacgatgtgatattcatagacgctcgggccgggctcaacgagtcaacagcaaccacaattcaaggattaggtgccgacgtactattttttggcattgacacacctcaaacctgggaaggttataattattttctgtctcatttatctcgctacaagagcgacacaagcctcgataatgattggcgctataaaataaagatgattcatgcgaaagccgcgaacaactccactgctctagcaaaatttcgcgatgaaagcttcgagttatttgcgtcttacttgtacgatgaaatcgacggaaatgaagtagcagaaggactacctaatgctttcagctttgatctagacgatccaacagcaccccacttcgcctggccaatctacatctcatcagactttcatgagtttgatccagtagcaaacaaactccaattaagcgctgaaaatacaacccctgtttttggggaattcattaatgcgctcaaagacaggcttggattccaatgaaactcgccgaatatgaaatcgatatcttaagaaaggttctttccgacttagatccgaagtcttcatctacagctgcaaagccacttccggtagatcaaatttacacaccgaagactcacagagatgctcttgatattgaccgaccgttgattgttggcaacagaggtacgggtaaaagcgtgtggtcgggtgcacttgcagacaagatgacacgtacagctatcgcgttacaatatcaatatccagagctcaacagtacagaagtaatattaggctttcacgagagtgctggcaaggtcggcgggggtattgcaccgtccgcaagaacgttaagtgcacttttaaaaagcggtgctgaaccagaagtaatatggacagcggtattgctacaggcggtatcgagcatcacaaaatcgagactgtcaaagtcgttaccagacctagttaactggatagaaaaaaatcctgaaaagtgtgaagaccgactacgaaaagcggacgatcacttcaccaagagcggaaaaaaattccttttggtgtttgatgcactagatcgtttaggaagtagctggcacgatatcagaccgcttacaaatggagttctacgccttacattagggatgcagggtttcgaaagcatgagagccaaagttttcatgcgaacagaccaattcaaagacaatataattttcaactttcctgacgcatcaaaagtaaaagcggcaagagtggatctttcttggcactccacagaattatatggactactattcaaactactgataaaaaatgacaaatcctttccagtacttgaccgcttatatagagagctaacgtcaaaatctatccgagcgtacacggacatttcaactccagaagaacaaaagccaatattcaacgcgatagcaggcgaatacatgggctccgatcataggcgaggacgcacgtatacttggataattgaccacttggctgatgcttttcgcgaaactacacctcgaagctttctcgttacgttacaaagggccgctaatgtccgccaaaaacctatcgatacagttatcgatcatcacggaattagagaaggagtccaatctgcttcaggcatacgagtcgatcaattactcgaagattatacttggatttcctgtgcccttgacgatctcgaagggctagaagtgccctgccctccggactcatttgttaaacgctggaaagaaagatctacaataaaaataatttccaacctaacaaaaaccaccaaccttccaggaccagtagagctagaaagcaaaaccgcatctaaagaaaacttattgcttgaatccttagttaatatcggcgtcgtagaaattagatccgagctaaaaatcaatatgccggatatcttcagggtggctgcaaaaataaaacgccgaggcggagtaaagcctccaacatcaggtagagcccgataaaatcagtgtatattccaaaatcaggggtttgaatttttcactcccctcttattgatatgttggctcccctttatgaaacctattactccattgcgctcggtacaacccagaccgaccaaaccaaatcaatgaatcgcagagtgccgctgggtaaagaacacacgcgtcgtatacagcggtaaaaggcgaacacctcatccgtcataccccattcccaactcctgggcctgctgcaccagcgcttccattgcctgttggcgttcttcgtcgcggcgcaacttgaacgccatcaaatccgaaaaccggattcgccgatgccgacccgtttttgtgaatggaatggcgccctcctccagcatcttgaccaggtgcgggcgagaaacgttaagcaggtcggcggcttcctgcgaggtcaactcggcatgcaccggcacgaccttgacggcattgccgagagccaactcacccaagatatcgaccagcaggcgcaatgccgaggttggaagtacgagggtatggggtttgtcctctttgtcgaagatgtcgatgcgctgggtttcaaatttggtcgacagcagggacgccaattcgcgctggccttgcacggccgcttcgacttccttttccagcggaaggatcgtttttggaagttgattagtgatcatgatgcagctccagcggtacgcaactcagttgagctcaacgccaaacgaaacaaacgaaaatcgcaataatcgaaacaagtgtgtcgaatcagatagcagtccactcttcccacactcaccatcgaacaaagccgacatcaacctctgagtccccctcgtacgctcactccctcgcacaaggaagtgagcccgtcatgccagaacgctcgtaccccatcaccgaagaagaacaactcaaacggcgcatcctgaccccgcagcctaagcgggagccctattcgccgccgatagacttattcgacccaatacccgccccagcgcctacgcccgcaacgcttcccggctgcaccttcaccaaaccttgccaactccccgacggcatcattcgctacaacacccccaccggttacgtaccgttggagctgatcaaggactacggccatttcagcctgttgggtggccgcgaggtggacagccgaggcgcggttgccctgcgtaagatcagcggcagtgccttgcccgctggcttggggcagttggcgttgcgttcggcggtagtggagtctgcagttgccgccgctggctctttagccggtggcctgttggcggggttggtggcgttggcttggccgtctgagttgggcgacagcgcgctttacagcgaggagcaattgcgttcgctgcaacgggcgcggtcgcagatgcgtttgcatgtggagcagcgtgaggacggcacgctcaaggggtatgggttttacacaggcaaccatgccgactggcagatgattgatgtggtgcagttccaaagccgtggcgatcagtttgtggcggatttgggtgagggcgtggagctgatctggacgcctgcggttgatccaggcgacacgctgggtattccggcgttggaggctgcgccgcaagcgccggtgatttggatttacccgccgacggagaaggcggcgcagattctggtgaacccggtttacccgccggagtatcgggattttattctggtgttcccggtggagtcgggggttcggccgctgtatgtggtggtcaatgagcctcggaaggggctgagaaatcctgattacgactactttccagcccccagaaccgaggacatcactggcttcccaggtttgatagaactaaagaaaaagacccgaaaacggaacggcggcggccttcgtgaacgctggaaagacgccaaaggaaggaagcttttcgagtgggactcagaaaaaggtgagcttgaagtctatcgttacagcgatatcagccacctcggctcatttgatccctatacaggtgagcaacggggtccggcaaaagacgaacggcgcataaaaaaataaatggagatttgatcatggtgatgaaggtacggctggaatggttcgacaaacaaaccgaaaccttggaggcagatgaatactcgaccaacattgaggaagacagcgttctcaaagcactcgatttacacaatgaacctcaaatttttgctgggggtttcaacgtaatgccgagttggatcgcgattctccagccacatttccagcatgtgatagagcccagccttttcgactaccaaatttccttccgctatcaaggcgcttggccgccacctccaaagcagcccaagaaggcgttctgatgcaatgaaaaagcccgtcctctaccgctcagtcaacacccgaacacatggcgtgcgccacggtagctgtcgcgcttaccgccatgaacgacacaccaaaagtgaaaaaaacacactgtccactcgcggctcaatgcacagccatcaacgacacggttttgactacacaccgctattccgctttctcctgtccaaagtcggtcagccgtgggacaaggttttcagcgaagccaacgcccggctggatcggccggagccggtgttctggatggtcgcgttacatgaagtcgacaaggacgagtatgtggcaatcggtgaatctacctactacagcggtttgttcgtcgacgccgctggcatgcttcaaaaggtcaacccgcagttaacgcccgaacagatgacgccattttgcagctgctgcacccacaccttcaacggtgtggtattcccgcaggctccaccacataaaagctaaacctcaccccgccttcccctcactc

SEQ ID NO: 67 - DNA, 52060 bp, Pseudomonas poae FL10F
cggtagttcagtcggttagaataccggcctgtcacgccgggggtcgcgggttcgagtcccgtccgctgcgccatattttccaggctcgacatgtcgggcttgagattgaacagccaaggctgattgatcagatgtttaaagacggttgagggtttacgctcaaccggtcaagcgatacgcagcggtagttcagtcggttagaataccggcctgtcacgccgggggtcgcgggttcgagtcccgtccgctgcgccatatctgcctcaaggcccactgaacgccttgaagcacaaagaaagccttaggtttactttgatccgatagcaaagaccctggtcgaaagaccggggttttttgtttctgcgatttggctttatgtgggagcgagcaagcccgctcctacaattagattgagtcagaaccccaacttatcccgcaacccgtaataccacgcgcccagcgcggcaaatggcgtgcgcaacagttgcccgcccgggaacgggtagtgcggcaggtcggcaaacgcatcaaaacgctctgcctggcctcttaacgcctccgccagtaccttgcctgccaggtgcgtgtacgtcacgccgtggccgctgcagccttgcgagtaatagatgttatcgcccaggcgcccgacctgcggcaggcgcgacagggtcagcaggaaattgccggtccaggcgtaatcgattttcacatccttgagctgcgggaaggccttgagcatcttcggacggatgatcgcctcaatgttcgccgggtcgcgcgcgccgtataccacgccgccgccgaaaatcaggcgcttgtcgctggtgagacggtagtagtcgagcaagtagttgcagtcttcgacgcagtaatcctgcggcagcagcgtcttggccagctcatcgcccagcggtgccgtggtgatgacctgtgtgccgcacggcatcgatttggctgcgagctccggcaccaggttgcccaggtaggcattccccgcgacgatgatgaacttggccctgaccttgccttcggcagtgtgcaccaccggattggcgccgcgctcaatgcgcactgctgcggattgctcgtagatcgtgccgcccagggattccacggcagccgcttcgcccagcgccaggttgagcggatgaatgtgcccgccgctcatgtccagcaggccaccgacgtagttgtcacaggccaccacttcgcggatgcgacgctcatccagtaactcaagctgcgtatggccatagcgttcccacaggcgcttctgcgactccaggtgggccatgtgcttgctgttgagagcggcgaacacaccgccgtccttcaaatcgcactggatctgatacttggccacccgctcgcgaatgatcttgccgccctcaaatgccatttgccccagcaactgcgcctgcctgggaccgacactgcgctcgatcacgtctatatcgcggctgtagctgttgacgatctgcccaccattacggcctgatgcgccaaaccccaccttggcagcttccagcacggtgacgcgaaaaccgttttccagcagaaacagcgcgctggaaaggccggtgtagccggcgccaatcacgcacacatcggtttcgacttcgccttgcagtaccggacgaggcggaaccgcattcgcggacgcggcgtaatacgactgggggtagggggtgttcgccatcctggaacctctgttttatattttttacgagtgcccagatcctacctgagttaaaaattgcctgccagccacccgaaaatcccgggtgtacccgtcgcaaataaataattcgcatattcatagggttagctgcaaaaaagatgttgacacccctccggaattccgtagaatgccgcctcacagcaggcacgtagctcagttggttagagcaccaccttgacatggtgggggtcgttggttcgagtccaatcgcgcctaccaaacaaaatccgctctgctgggcggtctagaagggctcaccgaaaggtgggcccttttttgttgcctgcgatttgcaaaacttttgcaaaactcccacctcagaacgccaattcggcgcctgtgtgtttaaacacccggcaaactgggtgtccgccgggactgacgagctattaaggcattaagaccgaatctacaacgtggatcacgccgttggactgcatcacgtctgcgatgctgatgccagccttaccgcctttggcatctaccacccacagcttgccgtcatgcagcttgatatttagcgattcaccttgaactgttttcaacaccacggtgccgccgttctttttggcatctgccatcagttgcgccgatgtgtgagtgccaggcacgacgtggtaggtcagaattttagtcagatcggctttgtgttcaggcttgaccagtgtatcgacggtccctgctggcagcttggcaaaggcttcgttcgttggggcgaatacagtgaaagggcctttgctgttaagcgtatcgaccaatccggcagccttgactgcagctaccagcgtcgtgtggtccttcgaattgacggcgttctcgacaatggttttgcttgggtacatcgctgcacctccgacgatcactgtatcggcggcaaagctgagcgtggcagtgacggagaggatcgcgaagcaggctgcagcagcaaattttttgtaaaaagcgtgcatggtgtatctccttggctcttatgccctccgagtgagggtattgaatctacgagccagaaaccaaaccggatgcaccaattcacgaaataatttttacgggcgacttgcgcctgctcacgcctgttgtttgatgccgctggcattccaaccacgctggatgcctggacaggtccgaggttcagtcccttctttcctggggaggacaactatgaaaatttggctgatggctctgcctgctgcgatgctcgccgccgcccttgaggcggttttttattgcctggaggaaagtatgggcgcagtacagaagctcggcatctacggcgccaagtgcggctccaaaaagcccaaaacacctactgaagccccagacagcttgcgctttgtcgctatcgcgaaaatgctgtgttgtctggaattcgggcaatagctcatccagccactgtgtggcttgctctgaaggaggcgcgcgggtcagcagaacagcgtagccaccgataacaggcagatgatctgaacaaccatctggcagcgtatttcaccattggttgtcgccatattcatttgtccggcatacatagttgctaccctcttcgtcggcaattgtgccgtgagccatgcgcaagaatgcgcaccgcttcgttgagtataggtctggaacaggattcttcacggtcaagccgctccggtgcgattgagcacgctttccccggcccccgccggcaaccgatacacatcgatcagccccagcacgccaagcactgccacgcctgcgaacgctacccgaaaatccccggcgctggcgtgtgcctcatgcccttgcgcagccatggacgcgcgcagcagcagtgctgcaatcgacacgcccaagcccatcgccagttgaaacgccatgctgaacagggcggatgcttcactcatgcgtgccttgggtacatcggcgaagccaatcgagttgtagcaggtgaactgcatcgaccgcgatagcccgcccacaaacagcactgccgcaatcagcgtcagcggcgtttgcgccgtaaacaaggcgcaggcggcaacgaggctgacgccgatcacgccgttgacgagcaacacctgacgaaacccaaagcgctgcatgatggctgtcgtgaagggtttcattgccaggttgccggcaaataccgccagcaccaacaaccccgcatccactggcgacaaaccaaagcccacctgaaacaacagcggcagcaaaaacggcagggcgctgatggccaggcggaatagtgaaccacccaaaatgctgacccggaacgtcgcgatggacaacgtctgcagcggcaataacggttcggcatgccgacggcaatgctgcacggcccataccgcaagcgctgcacctgccgccgcgagcgcgaaaccgggcagcagtgtttcactggtctggttgcccagccactccagcccgccgagcaatgccacgcaggcgctcgccaacagcacaaagcctttgccatcgaattgacgcacgctcgcctcacggcccttgggcacgagccacagcgcggcaaccagggccagcgcgcccagcggcacgttcacgtagaaaatccacggccacgatgcatgggtcacgatcaagccacccaccaatggtccaagaatcggtgccaccaaaccgggccaggtgatcaccgcaatcatgttcaccaggtctttcttgtcggtattgcgcagcactgccaggcgccccacgggcaccatcagcgcgccgccgatgccttgcagcacccgcgcgatcacgaacatctcaaggctctggctcaacccgcagagcagcgacgccagggtaaacacgatgatcgcgccagcgaacacccggcgtgcgccaaagcggtcagcaatccagctggacgccgggatgaaaatcgccacggccagaatgtaggccgtgatgccgatgttcatgtccaccggcgttaccccaaaggcggctgccagggtcggcagagcggtggcgattaccgtggcgtcgaggttctccatgaaaaaagtcacggcgaccaccagagcgatcaaacgcatttgcacgcctgagatgggtgtagcggaagaagtcaccagtgccacctctttttcaatgaaaatcgattgctgtccacaataccggctcagtcctgtgctcgcacgtttgagtcgacgcgcctaagccaggttcttccaagacgtcggattatgccgctgcgcaagccagagtgagcgagtcatactgatgggtcattgagttcagcctgggagcttgaagtggaatgtgaaatggaagtgtcgttcgacgtgacggcgcaggagcgtgaggacatcctcaaaccgttgagggcttacaacacccgccatatcggtgacatcaagtttgaatcggtcggcattttgttacgtgattcgaccagtcgagccgtggtaggcgggctctatgggagcatttctttaggatggctgttcgttgaactcttgagcgttccgcaagagatgcgcgcccaaggtaccggtaagcgtttgatgcacgccgccgaggcgttagctcggcaaaagggctgcatcgggatctggctggacacgttcagcttccaggcaccggggttttatcgaaagcagggcttcagcgaggtgggccatatcgctgactaccctgcgggccaccaacgctattttttccaaaagcgcctggcttgaatccccgcacggcgccggatcacctggcgccaatcacccacaaaatttattggtttgcagcaacaatttttcttgttggacaccccccggccccaagcagcaaagttgccgccactgacgctcgaccttacaggtcaacaataaaaaccgcgccgggctgcacgctattttcatgctgtgaacccgttgttcacatcctgccgtaatggcgccgcagcgcgcattcaaggacctcatcgtcatgcaaactgttgtgaacctatggccgttgatcggcgtacttgtcatcgtggttggcttcgtcttgcgcttcaatccgctgttggtggtgactgctgccgccatcgctaccgggctcgccgcccacttcccgttggaaaaaatcctcgccagtatgggtgatggtttccttcagacccgcgcgctgcaactgatcctgttattgcccctggcggtcatcggcctgctcgagcgccatggcctgcgtctgcatgcgcaaaactggatcgcgcgtttcgagcgcgccacggtcgggcgtttgttgatcatctacctgtttgtgcgcgagtccacggcggccatggggctgaccagcctgggcgggcacccgcaaatggtgcggccgctgctggcgccgatggccgaaggggcggcggaaaaacgctacggcaagctgccggacaaactgcgccacaaagtattggccatgtgcgcggcgaccgataacgtcgggctgtttttcggtgaagacatctttgtcgcctttggtgcgattgcgctgatgcacaccttcctgctgggctcgggcattgacgtggaaccgttgcacattgcggtgtggggcatcccgacggcgatctgcgcgtttatcatccatgcgattcgcctgcatcggtttgaccgaagactcacgcgtgaaatgacatccgccgccacgcctgtggaggctgcgcaatgatcatctcgattcaatacctgtattggcttgccggtgttttgctgctgattactgcgggcatgatcctgctcgatcgaacccacccgaagcgctggtcgaccgcgctgttctggctgctgttcgctattccgttcctgatcggggagcgcttgccgtcggaggtcatcggcgccggcgtggtggtgatggcattgattgcaggcgtgggcggcgtcggccgtggcaagcatgccgaattgcatgacaaggcgtcccgcgcgagtgccggtcgtttggggcacaagttgttcatcccggcgctggccattcccctgaccacggtgattggttcggtactgctcaaacacaccgaaatcggcggcgtgccgctgctggacccgaaaaacaccacctttgtgtcgttgggcattggttgcctgatcgccctcggcctggcgtgctggctgacccgcgacacaccggtacaagccttgcgcgagtctcggcgcctgaccgaggccctgggttgggccatggtgttgccgcaaatgctggcgatgctcgggctgctgttcaatgaagctggagtcggcacggctgtcgctcatgtcaccaccacctatatcaacctggatttcaagttggtggcggtaatggtctatgtgctgggcatggccttgtttacggtgatcatgggtaacggttttgcggcattcccggttatgaccgggggtgtcggcgtgccggtgctggtgggcatctatggcggtaacccggcggtgatggcggcgatcggcatgttctccggctattgcggtacgctgatgacgccgatggcggccaacttcaatatcgtcccggcggcgttgctggagttgccggacaaaaatgcggtgatcaaggcgcaaatgccgacggcgttgatgatgctggtggtgaatattgtcctgctttatctgttgatgtgaggcgcagatgcaaacagtactgctgacgggcttcgagccctttgaccaagacttgatcaacccatcctgggaggctgcgcgccagttggatggcgtgcaactggccgaggatgtgcagattgtggcgcgtcgcctgccctgcgcgtttgccacggcgggggagtgcctggccgagctgatcgccgagctgcgcccggtgatggtcatcgccacggggctcgggcctgggcgcagtgatttatccatggagcgggtggcgatcaacgtgaatgatgcacgtatccccgacaacctcggcgcgcaaccggtagacacggcggtggtggccggcgggccggcagcctatttcagcacgttgccgatcaaggccatggtcaaggccgtgcgcgaggcgggggttgcagcgtcggtttcgcagacggcgggaacgttcgtgtgtaaccaggtgttttacctgttgcagcacgcacttgccggtacggcgatacgcagtggttttatccatgtgccccctatgccggaacaagtcactgtcgcgctgcagccttcgatggcattggagacattggttaaaggtttacgggttgcggttcaggcggcttgggatacgcaggtggacatcgcgcaaaccggtgggcaggtcagctgacctcgcctgggaaggaagaacagagggaaagcggtccacgggtgacagacaaacttttgcaaaataacgcccaggttcgggccgggcgctctcagtgttcccgccgaggaaagaacaactcgaaacatgtcacgccgtcttcactggtgacgctgtagcgaccgttatgcaactgcatgatggttgcgacaatcgacaggcccaatccattggactgtgccgatcgttcccgcgactcatccacccggtaaaaccgctcgaacagcctcggcagatgctcggcgggaatcgtctcgccgcggttgctgacactcaggctgatgccttcagcagtgggcgtcgccaggatcaacagctctgaactcggcgcgccgtacttgatggcgttggcacacaggtttgccagcgcccggcgcaacagcatcggctcggcccagatcacgccttcgccctgcgcaagaatgctgatctgcacatcgctcgccaacccttcaaagtagtcagccatacgttccacttcatccgccgcactcagttcctggcgttggcgcagcgcactggccgggtcggtgcgggcgaggaacagcatgttgtcgagcatccgcgccaggcgttcgagctcttcaacattggaggcgagtaattgctggtaactctcgatgctgcggtgctgttgcagggcgacttgggtttcgcccagcaggttgttgatcggcgtacgcagttcgtgagccatgtcggtagacacctggcccagttgcacaaaacctttggccaggcgctcgagcatggtgttgaacgagtcgatcattggcagcagttctttgggcgtaccgtggctgtcgaggcgttcggccagattgcctacgccgatgccctgggcgtgcctggccaggcgccgcagcggcagcagcccacggtgcaccagcaggtaaccgaccatggcgaggatgatcgccgcgatactggccagcacaaacacactcaagcgatagctggcgagcatggccgtgcgctcggtcatcaagcgcccggtggtgacttgcaggctgcccaggtcgccagtatcgatggacgcggcgacagtggcgaagggcacgccatttacgccgggtaaatggtgcacatcggaaaatcccaacgcttggttttttggcacgggcgtcacgttcggcatgtcaatgttgcccgggttgaccagcagcaacggcttttgccccggcgccgcaatgctcagcaccgactcgctgttgcccagcatgttctggaacagctccggcttggtcttgatcaggtccagggtgttgctgtcattgagcaggttgcgcaactggtcggcgcgatagatcagtgccgcgtcgtcacgcttgatcagttcccgctcaagctcgcgatacagcgcgacccccaacgtggccagcagggcgaaagcgagcaaggcgaagatcagcgccaggcgcagggtcagtgagtaatgccggcgattgttcatggctgggtatcgaagcggtagccaatgccgcgcacgctgtggatcagcttgagctggaacggatcgtcgatcttcaggcgcaggcgccttacggccacgtcgaccacattggtgtcgctgtcgaagttcatgtcccagacccgcgaagcgatcatcgagcgtgacaacacttggtcttgatgagtcgcaaacaagtgcagcagcgcgaactctttattggtcagggtgatgcgcgtaccggcgcgggtgacgcggcgcttgagcacgtcgatttgcaggtcggcgatgtgcagctgttcttcttcgcggctcgggccgcggcgggtcagggtgcgcaagcgcgcgaccagctcggcgaaggagaacggtttgatcaggtaatcatcggcgcccagctccaggcccttgatgcgatcagcaatgtcgtcgcgagcggtcaggaacagcaccggcgtatcggcttctttgcgcaggcggcgcagcacctcccagccgtccattttcggcatcatcacatccagcacaatgacgtcgaatggcgtttccagcgcctggtgcaaaccgtccacgccgtcgcgggcaaggctcacggagtaacccaattcctgcagaccgttgagcaggtaattgccggccttgggttcgtcttcgactacgaggatgttcatgggaggtgccctgatgctaggtgtggcgcaagtgtagcccgatcaattgtcactggcgcagccgatgccttgcacttggtagtccagcacgtgttcgcggccctggtggtccaggtagtcgaggcgtgcggggacgatgccgcattggccgtaggtgtcggtgctcgacagcactttgtcgacatccaggtgcacgaagaagccggttttgtcgtgaatcacgttagtggcagttgaggtgtcggcggcaaacgcagaaccggtagccagcaaagcggcaaagcccaggataaacagtttcatggcagtagctctctttaagggttggctgccaggtcctggcagtgagttcacagtaaccaggcgccccaaacagccaaccaacaggatcatgacaagttcgtaatgaaagaattaaggctggcgaccggacgcttcgaggatcaggtcggtgatttccttggcgtgggacaccagcgacaagtggctcgatggcagctcgatggtgctggcattcatacgcttggcgagaaagcgttccaggtccgggttgatggtctggtcattgcccgacaccgcgtaccaggacggtttggtgtgccaggcggcgttcaccgtacggccgctgaacagggtcttggtgatcggttgttgcacggcgtacagctcaagggccttggcgcgcggcacatcggcggcaaagtacttgaggaaggcgtcctggctcagggtcaggtagccgtcgtgatcttccacgccggcacgcaccggcatggttgggtacttggcggaaagtgcgacgaagtcttcgttggcgtccggcgcacgggcggccacgtacaccagggcgctgactttcgggttgaccccggcgtcgctgaccacggtgccggcgtaggaatggccgaccagcaccgtaggaccgtcctgttgatccagcacgcgattggtcgcggcgacgtcatcggctaccgacgtcagtgggttctgcacagcggtgacgtgcaggccggcggcctggagccgggtgatcacctcggaccagctcgaaccatcagcccaggaaccgtggaccagcacaacgttattggctttgaccggtgcgacggtgccggccatcgcggtgccggtgcccagcatcagcaggctggcggcgatcaggcagagtttgcttgcaggtttcattgggtggacccttttcatctgtgggaagtggcgtcaaccgctgtgggtgactgacgactccactgtatgaagtgagggtgctgacaagacttacagcttgattacaaggttgtaatgcaagcgcatggggatcggtgcgcagcgtttacaactgggaaggggatccgtagattgcatcggggtcagcatttgttaccgatcaaaaggaaagccaagccgtgtccatttcaggccccgccgcatttactcaacgcttccgcgcctttctattcgacatggacgggaccttgctcaactctatcgccgctgccgagcgggtgtggagtatctgggctgaacgccatggcctggatgtgccggcctttctgagcacaattcatggcgcgcgggccatcgacaccatcacccgtcaggcgctccccggcgtcgatcctgaggttgaagcgcagtggattaccgaggctgagttgaatgatgtcgagggtgtggttgcgattcccggtgcggttgaattcctgaaccggttgcccggcagtcaatgggcgttagtgacgtctgcacccaaggagctggcattgcgccggttgcaagcggcaggtatttcgccgccgcaggtgctggttacggccgaggatgtcgctatcggcaaaccggaccccgcctgttacgtgctgggtgcacaacgcctgggtgtacccgtgcaggactgcctggtgttcgaggatgcgacggtgggaattcgggccggggaggcggcgggagcagcggtggtggtggtgacctcgacgcacctgaagcccatggctacggcacatgcatcgatcgatggctatgagcagctgcaagtcgagcgcgatgatgacggcctgctgagtttgcaccgcgtggcggactgaaacgaaaaagccgagcgcgttaacggtctcggccttcttccctggcggcgtgatcgggtgaggcttgctgtcggttactgcgcatgccctggcgggacatcaccatttccctgaggatctcattggccagccgggcaatcgcttcggcgccgcgataatgcgcgcgcacgatgccggtaatcgcgaaatggtcggtttcggggccgctcaggatggctgaaagggtgccgtcagcatgcagcgtgcaggtgatcttgtagctgggcagacgggccgccagtgcagattcgatgtcggatttgctgagggtatccatctgcttactgcctttcattgatcgtacaagcccaagcatagatcttgctgtgaggctgtaaataccggcgatcagatagtgtattgccgcccattaacccgcagatttgcgatgcgtgaggtgaccggctcgctggcacattttgcgttggatgatcgtctgtatgggcttgaggcagaacacaaacaggtaaccgcacaacagcagcaccaggtccagccaggagggcgcatcccaggcggcggcaccttcaagttcgtatctcaagccatattccacgccggcaaaggccagcccgatcagcagggcgatcatccaggaataggcgacaaagtgttgcatagaggtgcgcctcatcgacgtactcctgaatgcgctcagttgtcggcagaatggctcacccgttttggctgtgcaccatgcgacaagttccgaatatgaagacagtttcatcttgcgtggaagatgaagagagcgacgctctggacgcaaaagagcgaacaggcctaaagggtcttcgccagccgttacagtgaacgaaaaggctggctactgagggcgcttcaaggagtctggtttttgtccggagcagtcaggccggcctggatgcgctggtaaatctcctcgcgatgcacggcaacgtccttgggtgcgttgatgccgattcgtacttgctggccgctaacgcccagaatggtgatcgtgatgtcatcaccgatgtttatgctttcaccgactttgcgggtgagtataagcatggacttctccttgattacttttaaggacacatgtttcagacagggcagatgtcggatgtgtgtagcttactgctaagcgcttccctgtgactgcctcttttaggacgcatagaggcgacattaattcccatgacggcatcatacaggtctgcggtacatcattcgcattgtttaagccaacgtttatgacggccagaatagacagtgaatgataaagttgcctctttatccttaaaggagcagggcagtgcgtaaagtagcgatggcaatggcggtgttggcattggccggttgcggtgaaggcaaacctgtcgaagcgcccaaggccaagcctgccgtgactgaaagccagccacaaaccggtgcaattgccgctcaggaatgggatgtgtgggttgggccgccggaccacaagctgcaggcgatcaccgacctgaccgcctggttgctggagcatggtttcaatttttatatcgtgaaggaagacggcaaggatcaggtattgctggggccgttcgccagtaaggccgaagctgaagccaagcaggcgttgttgaccgaaaaactggcacgcgccaagaaaaacgacaccgagtcgcaggtcatcgagcacaagactgcgcagtaagcggcaagttgggcgggtgtcccgcccagtttcaaccgcaggccttaaggttcaccgggccgacaaactcattcccgcgccccatcacgcacgctacggtctggttgcgctggcgctcccaggcttgcaccgggtaagtcttgttccaggcttcatacagttgccggtcctgttttgacaggcgcaagccgtactgtttgctcatatagaaatacgtgcgggcgatcatcccgcgaatcgatgggcgcggcatgaccttcttggccttgaagtccacctgggtcaggcacgaaccgtactgcccacgttgaaccggcagccagccaaaactgaagttgttacggtcgccattgacctcgccgatactcggcaccaggttgtgcaggtctgcttcggcgcgcttgaacacgtcgtcgtggcgtgtacagtttttgcgcccgccgttctgccagcattggcgctgatggccgatctgccaggccggaacgatgtgttcccattcgatgcgtgcggcacgactggcatttttgcgcgggatataaccgcatgctttcaagttcacacgattgccggtgtatttgcagccgcagtaaaactccgtggattgtggggcgtatagcgtccaggcgactttcttggcttcgctgaaggttcgcggtgcctgggcgtgggcggtgatggaaaacagtaaacacatcacagcgataaagcggacactcattgaatcagtcttccttcggcacaacccagaaaatttgcacgccgccgtcgtcccgataggcaagggtgacgttgtcgttttcagcaatttcttccagtaagcgtgcccattcctcttccggctcttccggcaaacgaaagatcaaggccgccttggctttctgggcgttggttgaattgatgattttttgcacgcgaacggccaggcgttggtaggcgtcaggtggggttggcgctgcggaagaagactttgccacggagcattccttagtgtgctgtatgtgtatacagtatttaactgtaaacaatttcgcaactgcttaaaactcaagatgttcgtgtaaaagcgattgcgggcaaagcgggagtttgtagcgagggtatttgatgggtggtagaggcgggttaacccgcctctacgcaggtgttaccaggaatcaatattcccagaacatccgttgcagctctttgctgtcctgggtcttggtcagcgcaaccattgccaggatccgcgctttctgcgggttcaggtcgtgggcagcgacccaatcgtacttgtcgtcaggctgttcggcgttacgcagcacgaaaccgccggcgtttacgtgggaggagcgaatgatctgcacgccttgcttgcgcagttcctgcagggcagggaccaccttggacgacaccgagccattgccggtgccagcgtggatgatggctttggcgccagcctgggccagggccttgactgcggtgtcgcttacgttgccgtaaccgtaggcaatttccacatccggcaggcttttgatggtcttgatgtcgaactcggaatccatggtgtggcgcttggcaggcaggcggaaccagtaggatttgccttcaaccaccatgcccaatggcccccacgggctcttgaacgcttcggtcttgatgttgatcatcttgctcacgtcgcgacccgattgtatctcgtcgttcatggtgaccaacacgcccttgccacgtgcgtctttgctaccggctacggccacggcgttgtacaggttgagcatgccgtccgccgacatggcggtgcctgggcgcatggagccgacgaccacgataggcttgtcggttttttccaccaggttcaggaagtaagcggtttcttccagggtgtcggtgccgtgggtgatcacgatgccgtcgacgtctttgctgtcggccagctcagcaacgcggcgacccaattgcagcaggttttcgttattgatgctttccgaagcaatttgcatcacttgctcgccgcgcacattggcgatctggctaagctcaggaacaccggcaatcaattgctcgataccgactttggccgcctggtaggtggcactgttggcagcgctggcgccggcaccggcaatggtgccgccggtggcgaggatcaccacgttggagagtttggtcttggtttcagcttcctttgcctgggcggcaacggggaacagcagcagtagggcgagggcgcccggaacaaaggttttcagtgcagatttcattatttttctctctggtttttgatgagtgcggtagcaggttcatctagaacacccgggcggttctgaacgccgcgtggtgctgagaaagagcaggatttgtaccaagctgattgtgtctggccagataaattaacgtcttgatttaaaacaacttatgttgagtttttcggcgggttggaaacgtatgcgtccggctttccgaacgtcgaggtagtattgcgttcggttgtccgaaaagcaggttggaatatcgaccggatgtgtatgacaagcacatcgctgcctgtcgttttagagaacgactgaaggacggcgatgtttaatctcgtcaacaccctggcttaaaaggcggaggggtggagggcttggatgaaagaccacggtcacccgttgacaaatctcgacaaggttctcatagtttgaataacgcaaacgtttgcgagatgtttcacagcgcgagcgttgctcacaataatcataagatcggagtgaacccatgaagctgccattcgccggacgtcttcttgctgtcgctgtgcttgctgccgcatccgctgctctacctctctcttctgcctttgctgatgacgccgccgccaaacccaaggtcggcctggtgatgaagtcccttgccaacgaatttttcgtgaccatgcaggacggcgccaagaagtatcagaaagaccattctgctgactttgacatgatcaccaacggtatcaagaacgaaaccgataccagcgcgcagatcgacatcgtcaaccagatgatcctcgccaaagtaaacgccatcgtgatcgcccctgccgactccaaggcactggtcactgtgctgaaaaaggcctccgatgccggcatcaaggtcgtcaacatcgacaaccgccttgacccggacgtgctgaaaagcaaaaacctcgatatcccgtttgtaggcccggacaaccgcaaaggctccaagctggtgggtgactacctggccaagcaactggctgcgggtgacaaggtcggcatcatcgaaggtgtgccgaccaccaccaacgcccaacagcgcaccgcaggctacaaggatgcgatggacgccgccggtatgaaaattgtctccacccaatcgggtaactgggagatcgaccagggccagaaagtcgcctccgccatgttgagcgaatacccggacctcaaggcactgctggccggtaacgacaacatggcgctgggtgctgtgtctgccgtacgtgcagctggcaaggccggcaaagtgctggttgtgggctacgacaacatcgaagccatcaagccgatgctgcaggacggccgcgtgttggcgactgccgaccaggccgccgcccagcaagctgtgtttggtatccagaacgcgctcaagctggtcaagggtgagaaagtcgatgccaaagacggcgtgatcgaaaccccggtcgaactcgtcctcaagaagtaatcctggcagtacccaacagcgtccgctcgtcctgagcgggcgcctggagattttcctatgtcatcttccgccccgaacgttgtcctctcggtcagcggtatcggcaagacctatgcgcaaccggttctgtccgacatcaccctgacgctcaatcgcggagaagtgctggcactgaccggtgaaaacggcgcaggtaaaagcaccttgtcgaaaattatcggcgggctggtcacgccgaccaccggcaacatgcagttcaatggtcaggattaccgccccggcagccgcacccaggccgaagagctgggcgtgcgcatggtcatgcaggagctcaacctgctgccgacgctgaccgtggctgaaaacctgttcctggacaacctgcccagaaattgcgggtggatcaaccgcaaggaactgcgcaaagctgcgatcgaagccatggcccaagtcggcctggatgcgatcgacccggataccctggttggcaccctgggcatcggccatcaacaaatggtcgaaatcgcccgtaacctgatcggcgactgccatgtgctgatcctcgacgaacccacggccatgctcaccgcccgtgaagtcgagatgctctttgaacaaatcacccgcctgcaggctcggggcgtggcgatcatttatatttcgcaccggctggaagagctggcccgtgttgcccagcgcattgcagtgttgcgcgacggcaagctggtctgcgtcgagccgatggccaactacaacagtgagcaactggtgaccttgatggtcggtcgcgaactgggtgaacagatcgacctgggcccgcgcaccatcggcggcccggccctgacggtcaaagggctgacgcgctcggacaaggtccgcgacgtgtcctttgaagtacgtgccggtgagatctacggcatctcaggcctgatcggcgccggtcgcactgaactgctgcgcctgatcttcggcgcggacctggcagacagcggcaccgtcgccctgggctcgccagccaaggtcgtgagcattcgttcgccggtcgacgcggtgggccacggcatcgccctgatcaccgaggaccgcaaaggcgaaggcctgctgctgacccaatcgatcagcgccaatattgccttgggcaacatgccggaaatctccggcggcggtgtggtgaatagccgtgacgaaaccgcgttggccaagcgccagatcgacgccatgcgcattcgcagctccagtccggcgcaattagtctcggagctgtcgggcggcaaccagcaaaaggtcgtgatcggccgttggctggagcgtgattgtgcggtgatgctgttcgatgagccgacgcggggcattgacgtcggcgccaagttcgatatctatgccttgctcggcgaattgacgcgccagggcaaagcgctggtggtggtgtccagcgacctgcgagagctgatgctgatctgtgaccgcatcggcgtgctctccgccgggcgcctgatcgaaaccttcgagcgcgacagttggacccaggacgaattgctcgccgccgcctttgccggctatcaaaaacgtgatgcgctgctcaacgacgcagcgcttagggataccccatgaaaaccactacttccccgggtaaaaccggcggcaacttctacggcctgggcacctacttgggcctggccggtgccttgctggcgatgattgcgctgttctcggtgctgagcgatcacttcctgtcctatgacaccttcagcaccctggccaaccagatcccggacctgatggtgctggcggtgggcatgacctttatcctgatcatcggcggcatcgacctgtcggtgggctcggtgctggcactggccgcgtcggccgtcagtgtggcgattctcggctggggctggagcgtgctgccggccgccgtgctcggcatgggctgcgcggcgttggccggcaccatcaccggttcgatcaccgtggcttggcgtatcccgtcgtttatcgtgtccctcggcgtgctggaaatggctcgcggcgtggcttaccaaatgaccggttcgcgcaccgcctatatcggtgactcgtttgcctggctctcgaacccggtggccttcgggatttcgccctcgttcatcattgccttgctggtcatcatcgcggctcagttggtgttgacgcgtacggtgtttggtcgctacctgatcggtatcggcactaacgaagaagccgtgcgcctggccggcatcaaccccaagccttacaagattctggttttcagcctgatgggcttgctggcaggcgtggcggctctgttccagatctcgcgcctggaagcggcggacccgaacgcgggctccggcctggaactgcaggtgattgcggcggtagtgatcggcggcaccagcctgatgggcgggcgcggctcggtgatcagtaccttcttcggtgtgttgattatttcggtactggccgcaggcctggcgcagatcggtgccaccgagcccaccaagcgcatcatcaccggtgccgtaatcgtgattgccgtggtcctcgacacctaccgcagccagcgcgccagtcggcggggctaaaccatggcaacgatcaaggatgtggcagcgcttgcggggatttcctacaccaccgtgtcccatgtggtgaacaagacacggccggtcagtgaacctgtgcggatcaaggttgaggccgcaatcaagcagctcgactacgtgccgagtgcggtagcgcgttcgctcaaggccaagacaaccgccaccatcggcctgctggtgcccaacagcctcaacccgtattttgccgagttggcccgcgggatcgaggattactgcgagcgaaatggctactgtgtgatcctctgcaactccgacgacaacgctgagaagcagcgcagttacttgcgtgtgttgctggagaagcgcatcgacggcttgatcgtgacctcagtcggtggcgacgacagtggcctggctgccggcttgagcgcggtgcgcacgcccatggtgattgtcgaccgtgcgttggacggtattgatgtcgacctggtgcgcatcgatcacgaggagggcgcctatctggcgacccggcacttgcttgaactcggtcatcgcgacatcgcctgtatcggtggccccggccacactcgcgtggcgcaaatgcgactggcgggctaccaccgcgcgctgcgagaggcgggcgttgaggtggcggctgagcgcacgcgggaaagtgacttcaccagtacgggcggttatgccgcagcggtgcaactgctgtcggacaacccgcccagcgcgattttcgccagcaacgacatgattggtttcggcgtattgcgtgctgcggccgagcgcaatattcgcgtgcccggcgagctgtcggtaattggcttcgatgatattcaaatgggccgttacgtgtacccggcgctgacaacggtcggccagtcgatcgtgcagttgggcgagacggcggccgagcttttactgcgacgaattgcaacaccccaactgccgatcgatcaacgcatcgtgacgccgagtattgttttgcgtgagtcgacggcgccgtttgccggtgtgttcgcccaataccgctgaaccgaattgatgagtactgatgtatgccagcaaaagtagtggtaataggcagcttgaacatggacctggtcacccgcgccagtcgcttgccgcgcgccggtgaaaccctgatcggccagacgttctcgaccgtccccggcggcaagggcgccaaccaggccgtggcctcggcgcgtcttggggcggatgtggcaatgatcggctgcgtcggcaccgacgcctatggcactcaactgcgcgatgcgttgttggttgaaggcattgattgccaggccgtcagcaccgtggacggctccagcggcgtggcgttgattgtggtggatgacagcagccagaacgcgattgtgatcgtggccggcagcaacggtgagctgacgcccgcttcgttgcaaacggctgattcagtgttgcagggcgccgaggttatcgtctgtcagctggaaacgccgatggacaccgtaggccgtgctctgaaacgcggtcgtgagctgggcaagacggtgatcctcaacccggcgcccgccagcggcccattgccggtggagtggttcgcttcgattgattacctgattcccaacgaaagtgaagcccatgccttgaccggcgtgaccgtcgattccatcgacagcgccaaggtcgccgcgacgcaactgatcaaggcgggcgccggcaaagtcatcattacccttggcgcccagggcgccctgtttgccgatggccaaggctttgagcacttggtagcgcccaaggtcaaggcggtggacaccactgccgcgggtgacaccttcgtcggaggtttcgccgccgcactcgccaatggcaaaagcgaagccgaggccatccggtttggccaggtagccgctgcgttgtcggtgacccgcgccggtgcgcaaccctctattcctacgctgcacgacgttcaaggttttgtgccctcatgaaaaagacacctttgctcaatattgccctgtcgcgcgtgatcgcgtccctcggccatggcgacatcctggtcatcggcgatgccggcctgccggtgccgcctggcgtcgagttgattgacctggcgctgacccagggcattcccgatttcatcagcaccctgcgcatcgtgctcagtgaaatgcaggtggaaagccatgtattggccgaagaaatcctgctcaagcagccgccagcgctctctgaactcaacagcctgaccgaacaggccgcactcggcgaacgacgcctggtcagtcacgaagaattcaaacaattgagccgcaaggcccgcgccgtggtgcgcacgggtgaatgccagccttattgcaatatcgcgctggtgtccggcgtaaccttctagagttccctacgacaaggagtgtttcatgcaacgtagtctcccttccctgaaaaacctgtttcggagtgtcctgcttttgtccgcgctcaccgcagccagcgcccacgcggcggaaaaaatcgacctgatcatcgacaccgacccaggcgctgatgatgtggtggccttgctgtttgccatggcctcgccgcaggaattgaatattcgtgcactgaccactgtcgccggcaatgtgcgcctcgacaaaacctcgcgcaacgcgcgcctggcccgcgagtgggcagggcgcgaagacattccggtgtatgccggttcgccaaagccgctgctgcgcacgccgatctacgctgagaatatccacggtaaggaaggtatttccggcgttgccgtgcacgagccgaaaaaaggcttggccgaaggcaacgccgttgactacctgatcaagaccctcagcaccgccaagccgcatagcatcactatcgccatgcttggcccgcagaccaacctggcactggcgctgacccaggcgccggaaatcacccaaggcatcaaggaagtggtggtgatgggcggtgcgcacttcaacggcggcaacatcacgccggtggccgagttcaacctgttcgccgacccggcggccgccgaaatcgtgctcaaaagtggggtcaagctgacctatctgccactggacgtaacccataaggtactgaccagtgacgcgcgcctgaaacagatcgccgacatcaagaacaacgccagcaaaatcgttggcgatattctcaacgagtacgtcaaaggcgacatggagcactacggcattccaggcggcccggtccacgatgccacggttattgcctacctgctcaagcctgagctgttcagcggccgtgaagtcaacgtggtagtagacagccgtgaaggccctaccttcggccagaccgtcgtcgattggtacgacggcctgaagcaaccgaagaacgccttttgggttgaaaatggcgatgcacagggcttcttcgatctgctgaccgaacgcctggcgcgtctgaagtaatgaggttgccggtcggcgttcgccggccggttcttacacgcgctcggggtcgtgagcgcccatatgatcggccgggtatttctcgaatatcttgccgatgaaagttttcgcggcttgcgtgcccagttccttgaccagcaggtcgattccgatgattgccaactcctccgggcttccggggctgtaggaactttgtccttggggccacttggctttgatgtcggcttggagggtcacagtggtcatggggggctcacggttgaaagtactgggcagtgcgctaaaacgcggttcttaccagggcagttaaccatttttggctggggtttggcactgctacttaggcatgaggcatgcgctgtgcgacactgtgcccctgtctaattgccggggaacaccaggtgcagatcgatttgaacaaccccgataacctgacgctggaggctgttcgccagctgctggccagtgccagtgacgacgaacacactcagttgcgggtgaccaaagccggaatcgcctatatctcttctggcagggcagtaggcggtgtggatatcgatggtctgctgtttcgcctcgaaacctgggccaaaggctccggttacgtcggtaacgtcgcggccagtgatgaagtctgggtcacgcaaatctacaacgcgctgaagcaaaactggccaacgccgccgtttgactacatcgacatctactgagtgtgttcatatctggtcacgattgactgggcgaatgcttgccctgagtcaggcagacttgcctgtgggcgatttacgtcttgaaaccaatccgccggatcgctgtcgcacgatctctgttcatttttatcataggaggcttcatgccttggaagctcgcttcattcggtactttgttggcagcactcgcgttggcgggttgcagcaccccaggtgcctctgagccagccaaagacgctgccgtggctgatgccggtcatagtcgctgtgagtcaaaagccgccgacttcgcgattggccagaaagcctcacctcaattgctggagcaggcgcgtacccgtgccggtgcgcagaacgcgcggatcctcaagcctaacgatatgatcaccctggaataccgctctgaccgcctgaacctgaacaccgatgacaacctggtgatcacgcgggtcaactgcggctgataacctgccggcttttgtagcgcgcacaaaaaaccccgtcacatggacggggttttttttagctcagcggagaattactcgccgcgaacctgtgcagcttgcatacccttttggcctttctcagccacgaaggaaacggtttggccttctttcaggcttttgaaaccgtcgctttcgatagctttgaagtgtacgaacaggtcgtcaccgccaccttgaggagtgatgaagccgaagcctttttcatcgttgaaccatttaacggtgccggtttggcgattagacatggtgtatctccaagaaacatatattttcagtagtgctgtgctgctcaggccaactgggcacacagggctatcatagtcgaaatgttcgacttgggagcccccccaaggcattgtttgctaatcaatagcgttgcgtttagtgctttggtcggctgaaagccccgatttacggggctttggcgcgaaatatcagctgttaaaaaaagccgtaaaagctgcgtaatttgtgagaaatggcagttttcgggctgttttttcagctcgatggccgtctgatcagtgatcgttctgactatttcttcacgactttgcaggacgaaatggccgcgacagctttgttcttgagcacgggatcggcgttctggttggtcatgagctctttgatttctgcagtgctcaattcggcgttgatcttgtcggcgccgcattcgcaatggtctttggcggttttggcgtcaacgctctgctgggctgccgcgctgcaatctttgacgaagctgtcgcgggcaccggctggccagttggaaggggcggctgcctgggcgccgagagacaggaaagccagggaagcggcgagagcgagggtcgaggtgaaacgcatcatgtggatgctcctttgagtcgaggacgaacggcgattctcggtgggtttgaggcatgtcgtacagctcaagttcacttttgcggctataaaaaagccgtgaatttgcctttacacaaggtggcgccaccgcgatgaccgttcatctgtgctaggatccttcgcttggctatttccaggcgcgccgtttgccgccatgccatgtttctttttagctcactccagtcactctggttcgattatcggttggccgaaaggctcctgccgctgtaaggcaggcgttcatcattgaacggcctggtattggatcttgtactggctcatcccaacccacgtgacctttggtaggggtcaccactaggagaggaggcgccatgccaactattactctacccgacggcagtcaacgttcattcgatcactcggtttccgtagccgaggtcgccgcatccattggtgccggcctggccaaggccactgtggccggcaaggtcgacggcaagctggttgacgccagcgacctgatcaccggcgatgccagcctgcaaatcattacgcccaaggatcaagaggggctggagatcattcgccactcttgcgcgcacttgattggccatgcggtcaagcaactgtacccgacggcgaaaatggtcatcggcccggtcatcgacgaaggtttctattacgatatcgcctacgagcgtcctttcactccggacgacctggctgctatcgaagcgcgcatgcacgcgctgatcgaaaaagattacgacgtgatcaagaaagtcacgccgcgcgccgaagtgatcgacgtgttcactgcccgtggcgaagactacaagctgcgtctggtggaagacatgccggacgaacaggccatgggcctgtattaccacgaagaatacgtcgacatgtgccgtggcccgcacgtgccgaacacgcgcttcctcaagtcgttcaagctgaccaaactgtccggtgcctactggcgcggcgatgcgaagaacgaacagctgcaacggatctacggcactgcctgggctgacaagaagcagctggcagcctacatccagcgcatcgaagaagccgaaaaacgcgaccaccgcaagatcggcaagcgcctgaacctgttccacctccaggaagaagcgccgggcatggtgttctggcacccgaacggctggaccctgtaccaggtgctcgagcagtacatgcgcaaggttcaacgcgacaacggctacctggagatcaagactccacaggtcgttgatcgcagcctgtgggagaaatccgggcactgggccaactacgccgacaacatgttcaccacgcagtcggaaaaccgcgactacgccatcaagccgatgaactgcccgtgccacgtgcaggtgttcaaccagggcctgaagagctaccgcgagttgccgatgcgcctggccgagttcggtgcctgccaccgcaacgagccatcgggtgcgctgcacggcatcatgcgcgtgcgcggctttactcaggatgacgcccacatcttctgcaccgaagagcagatgcaggctgaatccgctgcgttcatcaagctgaccatggacgtttatcgcgatttcggtttcaccgaagtcgaaatgaagctgtccactcgtccggaaaagcgcgtgggttccgatgagctgtgggatcgcgccgaggcggcactggccgctgcgcttgacagtgcgggccttgcatacgatctgcagccgggtgagggcgccttctacggtcccaagatcgagttctcgctgaaagattgccttggtcgcgtctggcagtgtggtaccctgcagctcgattttaacctgccgatccgtttgggagccgaatacgtctccgaagataacagccgtaagcacccggttatgctgcaccgggcgatcctcggctcgttcgaacggttcgtcggtatcctgatcgagcactacgagggtgcattccctgcgtggctggctccgacccaggcagtgatcatgaatatcactgataaacaggccgattttgccgccgaagttgaaaaaactctcaacgaaagcggatttcgtgccaagtccgacttgagaaatgaaaagatcggctttaaaatccgcgagcatactttgctcaaggttccctatcttttggttatcggagatcgggaagtcgagatgcagactgtcgctgtgcgtactcgtgaaggtgctgacctgggctcgatgcccgtcgcccagttcgctgagttcctcgcgcaagcggtttcccggcgtggtcgcccagattcggagtaattattattaagcgtgaaatgagacaagataaacgagctgcaccgaaagccccgatcaacgagaatatctcggcacgcgaggttcggttaattggcgctgacggcgagcagattggcatcgtctcgattgatgaagcgcttcgtattgctgaagagtccaaattggacctggtggaaatttccgccgatgcaatcccacccgtttgccgggtgatggactacggcaaatcgatcttcgagaagaagaaacaggttgccgcagcgaagaagaaccagaagcagattcaagtaaaagaaatcaagtttcgtccagggacggaggaaggggattaccaggtaaaactgcgcaacctggtacgtttcctgagtgatggggacagggccaaggtatccttgcgattccgcggccgtgagatggcccaccaggagctggggatggaactcctcaagcgggttgaagctgacctgctcgagtacggttcggtcgaacagcatcctaagatggaaggacgccaactgatcatggtcatcgccccgaaaaagaagaagtaatcaacagggcacggcaggccttctgattatgtttatcaactgaatgcggagtatccgaacatgccaaagatgaagactaaaagtggtgctgctaagcggtttctgaaaactgctaacggtatcaagcacaagcacgctttcaagagccacatcctgaccaaaatgtcgaccaagcgtaagcgtcaactgcgcggtagcagcttgctgcatccgtctgacgtggcaaaagtcgagcgcatgctgcgccttcgttaatttttggatcaagactagaggaagtaactcatggctcgtgtaaagcgtggcgtcattgcccgtaaacgtcacaaaaaaattctgaaactcgctaaaggctactacggcgcacgctcacgcgtattccgtgttgccaagcaagcggtaatcaaggcaggccaatacgcctaccgtgaccgtcgtcagaaaaaacgtcagttccgcgctctgtggatcgctcgtatcaacgctggtgcacgtgttaacggtctgtcctacagccgtttcatcgctggcctgaaaaaagcgtccatcgaaatcgaccgtaaggttctggctgaactggccgtgaacgataaagcggtgtttgctgcgattgtcgagaaagctaaagccaccttggcttaagtacccccgacagtcaccctgggttgctcctgcagcccaaggtggtaaacgtcataaataggggaagagccttcaagctcttcccctattttgtatctggagtctgtacatggaaaacctggacgcgctcgtcgctcaagcccttgaggctgtgcaaagcgctgaagatgtaaatgccctggagcaaatccgggttcactaccttggcaaaaaaggtgaattgactcaggtgatgaagaccctggggaatttgccggctgaagagcgtccgcaagtcggtgcgctgatcaacgtcgccaaggagcgtgtcacagaggttctcaatgcgcgcaaggcgtcgctcgaggaggccgatcttgcggccaagctcgccgccgagtccattgacgtgaccctgcctggccgtggccaggcctcgggcggtctgcatccgattacccggactctggaacgtatcgagcagttcttcacccacatcggctacggcattgccgaaggccctgaggtcgaagacgactatcacaacttcgaggcgctcaacatcccaggccatcacccggcccggtcgatgcacgacaccttctatttcaacgccaacatgctgttgcgcacccatacctcgccggtacaggtccgcaccatggaagcgaacaagccgccgatccgcatcgtctgcccaggccgtgtgtaccgtagcgactcggatatcacccactcgccaatgttccaccaggtcgaaggcctgctggtagatcgcgacatcaatttcgccgacctcaaaggcaccatcgaagagttcctgcgggtgttcttcgagaaagagctggcggtacgtttccgtccatcgttcttcccgttcaccgagccgtccgctgaagtcgacatggaatgcgtgatgtgcagcggtaaaggctgccgcgtctgcaaacagaccggctggctggaagtgatgggctgcggcatggttcaccctaacgtgctgcgcatgtccgggatcgacccggaagaattctcgggctttgccttcggcatgggcgtggagcgtctggccatgctgcgttacggcgtgaacgacttgcgtctgttcttcgacaacgacttgcggttcctcgcgcaatttcgctagtcgtaacgaatctttaggagagcaggatgaaattcagtgaacaatggctgcgtggctgggtaagcccgcaggtagatcgcgacgagctggttgctcgtctgtcgatggccggccttgaggtcgatagcgtaacgccggccgccggtgttttcagtggtgtggtcgtgggcgaagtgctgagcactgagcaacaccccgacgccgacaaattgcgtgtgtgccaggtcagcaatggcgcggaaaccttccaggtcgtgtgcggagcgccaaacgtgcgcccgggcctgaagattccgttcgccatgatcggcgcagaactgcccggcgacttcaagatcaagaaggccaagctgcgcggcgtcgagtccaacggcatgctgtgctcccaggctgaattgcaagtgggcgagggcaacgatggcctgatggaactgccggctgacgcgccagtgggccaggacattcgtgtttatctggaactggaagacgccagcatcgaggtcgacctgaccccgaaccgtggggattgcctgtctttggcgggcttggcccgtgaagtcggcgcgctgtacaacgcccccgtcacccgcccggttgttgccgccgtgtctgccgtgcacgacgaagtgcgcccgatcgaggtgctggctccaaacgcttgcccgcgttacctgggccgcgtcatccgtaatgtcgacctgtccaagccgactccgctgtggatggttgagcgcctgcgtcgcgccgacgtgcgcagcatcgacgctgctgtcgatatcaccaactacgtgatgctcgaactgggccagccgctgcacgctttcgatcttgccgaaatcaacggcggcattcgcgtacgcatggctgaagaaggcgagaagctggtactgctcgatggccaggaagtcagcctgcgtgccgataccctggtgatcgccgaccattcccgcgccctggccattgccggcgtgatgggtggcgagcacagcggtgtgtccgcgaccacccgcgatattttccttgaaagtgcgttcttcgatcagatcgccattgctggcaaggcccgttcctatggcctgcacaccgatgcttcgcaccgctatgagcgtggcgtggactggaaactggcccgtgaagccatggagcgcgccactggcctgctgctggaaatcaccgggggcgaagctggcccgatcaccgaaaccgtgagcgagcagcacctgccgtccgttgcacccatcaccctgcgtgccaagagcgtcgagcaaatgctcggcctggtgatcgagccggctcacatcgagcaactgctgtcggcgctgggcctgggcatttccgctggcggggaagggcagtggcacgttgaagtgccaagccatcgcttcgacatcagcctggaagtcgacctgatcgaagagctggcgcgcctgtatggctataaccgcctgccggttcgttacccgcaagcacgcctggccccgcagcccaaggctgaagcccgtgcgcacctgcctgaattgcgtcgcctgctggttgcccgtggctaccaggaagcggtgacctacagcttcatcgatccaaagcagttcgagctgttcaatccgggtgtcgagccgttgctgttggctaatccgatctcgaacgacatggcggccatgcgttcgtcgctgtggccgggcctggtaaaagcactgtcccacaacctgaaccgtcagcaagaccgcgtgcgcatgttcgaaagcggcctgcgttttgtcggccagctcgacggcttgaagcaagagccaatgctggcgggcgtggtgtgcggtagccgcctgccggaaggttgggcgcagggtcgcgacgccgtagacttcttcgacgttaaagctgacgtggaagcggtgttgggctttgccggcgcactcgacgctttcacctttgtgcccggcagccacccggcgttgcacccaggccaaaccgcacgtattgagcgcgaagggcgcctggtgggtttcgtcggcgccattcacccagagctgtcgaaaaccctgggtctggaccgtccggtgtttgttttcgagctggtcctggcggaagttgcctcgggcaaaatgcctaaattcagcgagttgtcgcgcttccctgaagtgcgtcgcgacctggccctgatcgccgatcgtgaagtcgccgccactgccgttctggatgtaatccgtgaaaatgcaggggaatggctgacagacctcaggctatttgacgtctatcagggtaaaggtattgatccgcatagaaaaagcctcgcagttggcttgacctggcagcatccatcgcgcactcttaatgacgatgaggtgaataccacgacacaaaatatcctcacctcgctcgaacaaaggttgaacgccacgttaaggaagtgacgtatgggggctttgacgaaagctgagatggcggaacgtctgtacgaagagctgggtctgaacaaacgcgaagccaaggaattggtcgagctgttttttgaagaaatcaggcacgctctggaagacaatgagcaggtcaaattgtccggtttcggcaattttgacctgcgggacaaacgccagcggcctggccgcaatccaaaaacgggagaagaaatcccgatcacggctcgccgtgtggtcacctttcgtccagggcagaagttgaaggcccgagttgaggcttatgctggaaccaagtcataacgacgagctacccgtcatcccaggcaaacgctacttcaccattggtgaagtcagcgagctctgtgcggtcaaaccgcacgtgctgcgctattgggagcaggagtttcctcaactcaaccccgtcaaacgcaccgggaaccgtcggtattatcagcgccaggatgtgctgatgatccgacagatccgcgcgttgctgtacgaccaggggttcaccatcagtggcgcgcgccagcgtatgtccggtgatgaagccaaagacgacaccacccaatacaagcaactgatccgccagatgatctccgaactcgaagacgtgctggtggttttgaagaagtgattcaagcttttaaaatacttccacatttcaaaagcttgcggtatattccggatcgcttcgtagcgaagcaaacccagtaacacgcctagtcggggcgtagcgcagtccggtagcgcactagcatggggtgctaggggtcgagtgttcgaatcactccgtcccgaccatattcttgatcaagcccaacctgaaaaggttgggctttttcatgcctgcgcaaaacctcacagctcgaaaaacatcaacggtcgtagctcagtcgtgcgtctttgcttgaaaaactgccgaagcctgtccctttttttcacctcgcctgtcattcaaggcaagtgaattaaatcgagagcctccgcccatgcccgccgcctcacccttgcgcctgcgcccgttgctgaacttgagcctgatgctgagcctcagcgccagccccttattcatccccgtcagctatgccgaagacaacggtgcccgtcgcagctatcaagtgccggccggtagcctgagcgcggcgttgactcggtttgccgggctttgcggtgtcaatttatcgatcgacccggcgctggtcagcggtcgcaacagcaatggcttggccggtgaatacggggtggaggagggctttgcccgtttgctgcaaggctctggcctgcaactgcagccgatgggtgatcaggcctacatgctggtgccggtgccggaaggcagcagcctgcaattggcgccgacttctatcgtcgccaccaacgcgctcgagggcggcgatacctacgccggaggccaggtggcgcgccggggttcgcaaggcctgctcggctcgcgggacttcatggaaacgccgttcagcatgaccacctacaccgaggaggcggtgaagaaccagcaggcgcgcacccttggcgacctgatcgccagcgacccatccgtgcgcgccaccaacccggccggtgggcgttatgagcagttcaccattcgcggcttcagcctgttcaacagtgatgtggcctacaacgggctgtacggtgtgttgccgacatacaccatcgacatggaaatggccgagcgcgtcgacatcctcaaaggcccgagccagttgatcaacggcatctcaccgcgcggcagcgtcggtggcggcatcaatgtggtgcccaagcgcgccaccgacaaagacatcaactcgtttaccggcacctgggcctccggcagccaggcgggtggggcggtggatgtgggccggcgttttggtgaggacaacaaattcggcatccgtttcaacggtgtgaagcagtccggcgacaccgaatgggaccaccagagcgtcgaccgcgagatggccgtgctgggcctggattttcgtggcgagcgcctgcgcctttccaccgacatcggccacaccgaacgtgacaccgatgccccgcaggagcgcgtccaagtcggcccgaatgccagggtgccgagtgccaatgacgtgcgccgcaattacgcgcaatcctggagtaaggccagcaccaacgacacgttcggcaccgtaaacggcgagttcgacctcagtgacagcgtgatgctctacggcggtgtcggcgcgcgtaaaagcaatcacgatttcctgcgccacgcggtgtccgtcaccaacaacgccggggacttcagcgtgcagccgcgtgatttcacccgcgacgaaaacgtgcgcaccgccacggccggcttgcgcagctggttccacaccgggcccgtcagccatgaactcaacctggcggccagctacttctatatggactttgaaaatggcggcgcgcgctatgcggcggcgccgagtaacctctacaacccggtgcaaacgccgacgccgtcgcggcccacgcgcttcgactccaaggtctatacagagaacaagttcagcggcgtggcactgtccgacaccctgggtttcttcgacgaccgcctgctgctgacccttggtgcgcgctggcagcgagtcaaagtggatgactggaccgacaacgtcaaaggcgacaccgcctacgatgaggagaaaatctcgccatcgggcggcatcctcttcaaagccaccgacacgttgtcgctgtacgccaactacatggaaggcttgagccagggcaaaatcgcgccttccacgtcgatcaacgaagatgaaatcttcccgccgtttatcagccgtcaggtcgaagtgggcgccaaatatgacgccggcgccttcgccgtgaccgctgccgtgttccgtatcaagcagcccgcctatgaaaccaacgctaccacgcgggtgttcgggcccaatggcaaacgccagaacgacggggttgagctgagtgtgtttggcgaaccgctcaagggctaccgcttgctcggtggcgtgatgtacatcgacagcgaactgacccataccaccaacggcacctacgacggcaaccgcgcaccggccacgcccaagtacaacgtcaacctgggcgccgagtgggacgtgccgacgctggaaggcttgaccctgaccagccgcggtatctactccagctcgcagtacctggaccagtccaacgtcaagcaaatcgacgcctggaaccgtatcgacgtcggtgcacgctacgccttcaaggtcgacgacaagcacatcaccctgcgcgccaatgtcgagaacgtcgccgataaacgctactggagctcggccggggcctcggatgacagcgaaccggggttgaccctgtcgacaccgcgcacctacttgctctcagccaccgtcgacttttagctgcgcgatttgagggcgagcgagcttgttgtggcgagcgggcttgccccgcgttggggtgcgaagcgcccccaaaacctgccaatgacttctgactgaaaaacgcggtgactgcatcagggccgctacgccccccaacgcggggcaagcccgctcgccacaagaaagctacttgccacagcaaccgctgtaaatgaaacagcgttaataagaatgttttttgattgcatcgccccgatatggaatagtacccgccgttttccccagcctgtctagccggggtgttccaacgccgaggtccttgtcatgcgaatgctgcgctccatcccgacccttgccgcctgcctcctggcattttcttcaagcgtactaagcgctgctcctatcgacctgaatgacggccagcatgcggtgcacttgccggatgcgcccaagcgcgtggtcgtgctggagttctcctttctcgacagccttgccgctgtggacgtaaccccggtcggcgccgccgacgatggcgacgccaaccgtgtactgccgcgcgtacgccaggccatcggcaagtggaaatccgtgggcctgcgctcacaaccgagcatcgaggaaatcgcccggctcaagccggacctgatcgtcgccgacctcaatcgccaccaggccttgtacggcgacctgtcgagcatcgcgccgaccttgctgttgccgtcacgcggcgaggattaccagggcagcctgaaatccgccgagctgatcggcaaggccctgggcaaaagcccgcagatggaggcgcgtatcgcgcagaaccgcgaacacttgcaggcgattgccaaacagattccgacgggcgccagcgtgttgttcggcgtcgcgcgcgaagacagtttttccgtacacggcccggactcctacgccggcagcgtgctcgaagccatcggcttgaaagtgccgtcggtacgcgccaaggccgcgcccaccgaattcgtcagcctggaacaactgctcgcgctggacccgggctggttgctggtggggcattaccgccgcccgagcatcgtcgacacctggagcaagcagccgttgtggcaagtactcggtgcggtgcgcaaccaccacgtggctgaagttgacggcgacagctgggcgcgcaaccgtggcgtattggcctcggagcaaatcgctgaagacgccctggccattctcaagggcggcaaagccgtactgagccaataagcatggggcgcagtcttgcggcggcaagcattgtgctgctgggcgccgtgttgttctggctctcgttgtacagctggtcaccgttcactatcacggcaaccgatgcctggaatggcttggttcaccagggcagcgtaggcggcaacatggcctatatcgtcgcccagttgcgggtgccgcgtgcggtgtgcgcggcgttggtcggtgcctgcctgggcttggccggggcgttgatgcagggcattacccgcaaccgcctggcatcgccgtcgctgtttggcgtgacggcgggcgcggcgttgggcttggccttgttctcgactggcttggtcgcgccaccgtttgccggtggtgcattgctgatgacctgcgtgggcggcgcattggcctgggtcaccgtgttcagccttggcggcgcgtggtcgccgaccaccgcccaaggtcggctggtattggccggcgtagccgttgccgccttgtgcgcagcactgacccggctcacggtgattctggtcgaagcccaggcccaaagcgtgctgaactggctggccggttccctggccaatgtcggcgcagcccaagtgcaattgctctggccgtgcaccctgatcggcggcctgtgggcgctgtggtgcgcgccgcgcctgaacctgatcaacctcggcgaagacgccgcccgctcgttgggcgtgggcattgccagcctgcgcctgcaggtgtttatcgccagcctgctgctggtgggcgcgagtgtctgcgcggtcggccccatcgggtttgtcgggctgatcgcaccgaatatccttcggcagtttcttggcaatgactaccgctggctgatcccgctgagcgcggcgttgggcgcagtgatcgtgctgggcgccgacttgctcagccgcgtcgtagcctttccggtggaaaccccggcgggtgtggtcaccgcactgatcggcgcaccgttctttctctttctcgccaggcgcgcgttatgactcagccacgattacgcctatggctgctgctcggtttgctgctggttgcaaccttcgtcagcctcagcgccggcacgctgtggctcacgccggatacggtgctgcagcgtctgctggcccacaacgccctcgacttcgaagtctggaaccaccgcttgccacgcagcctgatcgcgatcctcgccggctgcgcgtttggtcttgccggagcgattgtccaaggtgtgattcgcaaccctttggcctcgccggaaattctcggcgtcactcaaggcgccgggttggcgctgacggtggcgatcatcagttggccgcacctgccgattgcctggctgccactggtggcgtgcctgggcggtgcgggaggcgccttgctgctggcgctgtataacaccggcgtgagtttttccggggtgcggtttgcgctgtcgggtgtggcgattgcggtgaccttgtccagcgtcaccgagtttctgatcctgtcccatccgctggacatcaacaccgccttgctcgccctgaccggcagtttgtggagccgtaactggcaccatgtcgcgctggtgctgccgttcctattgctgatcccgctgggcctgtgcctggccaaaccgctgaacctgatcgccctcggcgacgaagccgcccacagcctgggcaccgcgctgagccgcacgcgctggttggcgatggcctgcgcggtggtgctcaccagcctgggcgtcggggtaatcgggccaattggctttatcggcctggttgcgccgcacatggcgcggcggctggtcggcgggcatcaccagtacctgctgccggcggcgatgctgatcggcgcgctgttgctggtgctggccgataccctcgggcgcacattgatcgcgcccagcgaaatacctgcaggggttctgacggcggtgattggcgcgccgtattttctttggttgctggcacggttcaagggctgatgacatgagcattctaaacgcacatcaactcgacatcggctacggcgccacgcgcatcgtgcaagggttgtcgtttgcgccacccgcaggcaaggtcactgcgttgatcgggccgaacggttgcggcaagtccaccttgctcaaggccttcgcgcgcatcctcaagcccagccagggcatattgaccctggacggccaggcctacgccagcctgtccgcgcgcgaactggcgcggcagatcgcgtttctgccccaggtgctgccggtgccggaaggcgtcagcgtgcgccaattggtcgcctatggccgcagcccgcataactcgctgtgggggcgcctgagcggcaacgaccaggctcacgtgactcaagccatgcagcgcctggaactggacgccctggccgaccgtgccttggcggacctgtccggtggccagcgccaacgcgcctggctggccatggtgctggcgcagaacgcgccggtggtactgctcgacgaacccaccacctacctcgacatcagccaccaggtcgaactgctcgacctgatgggcgagcttgccgccgaaggcaagaccgtgatcaccgtgctgcacgacatcaaccaggcctgccgctacgccgaccacctggcggtgatgcatgccggcaagctcgtcgccgacggcgcgcctgcccacgtgatcagcgccgaactgatgcgccaggtgtttgatgtgcaagtgcagatcatgcaggaaccggtggccggcacacccatgtgcctggtcgagaaaagcacccgacctcacgcctgacgccattcaaaatgtgggcgctggcttgcctgcgaaagcggtatcccagtgacaaataggctggctgactcaccgccatcgcaggcaagccagctcccacaggttgcccgctattgatcgccataccctgcatgacttgacgtgaaatgcaggcaaaaatgtgggagcgggcttgctcgcgaagagggcgtgtcagttaatgcatcctgtgactgacacaccgctttcgcgagcaagcctgctcccacacttttgatctcagtggttttcaacactccacacggccttcttgacctcaatcggcagggccgtcgaaggcgggcggttatccataaaccttgtcagcatcttcaagctgtcttcatgctggctgcgggtgagggcttcagcggcgctgagttcatccagcaggtcgtgaataaacgcgcggttcgcctgggcatagtcgcgccgcgcggtgtacaccggccccgacaaacccaggccttcgccattggccagtacatggctcgggctctggctcagggcaagggacgaattgggctcccagatcgcccaggcatccacactgccttgctcgaacgccgcacgcacatcggtcggtggtttgctggcggggcagcgcgccgggctgaagattccgcaagactgcgccgtgctcggctttggtgattacccgtttgctgaaatgctcttgccgagtctcagcacgataaaaccgcccgccctggaaataggtgtattagccgccacgcgcgtacttgaaagtttgggtgtgttgccggttgaagatgaagttgtacgcctgaatcttttggactgccgtttgattaagcgtgagagcacttgaataactagcgaagtggctaattgcgactagtcaaatccgacctgcttgccgagaaggctttaaatcaagggttgtaccggaattccgggacagccagtggctattcatttcagtttgtttcccgttttcaggaactagatttacaacttccagtcgattaacccagttaactccgactgcggcgtggcgaactaatggcactgttatccccgtgttcagtagttccaaatggccatacttactcgcaactagacacctcacattatgtcgtcaacgcccatcgatgcctgccatctgcagatcccgcacaccgactccgtgtgcgcgtggctgatgcggcacgccgggctcaaaccggtcgacctggagcgcgcccggcgcttgagcaccgacggcagcgacctgcttggcctgctcacgcgcctgggcctggtctcggaaatcgaactggcccgtgcctgggctgagctgctcggcgcgccgctgctgcaggccgatgcggcgccgccgttgctcgacccgttgcccgttctcaccgagcgctttatgcggcactaccaagtggtgccgatgggctgggcccaaggtggcctgcgcgtattggcggccaaccccgcgcagctttatcccttccaggccctggcctacgcctgccaggtgccggtgtggttggccatcggcccgcgcactgaagtcgacacgctgatcgagcgctattacggccagggccgctccgccatgggcaccctgatcgaaaacctcgatgagcagggcggcgcgctggaagatatcgaacacctcaaggacatggcttccgaagcgccggtgattcgcctggtcaacctgatcctgcagcgcgcagtggaacagcgtgcgtcggacatccatatcgaacccttcgaaaaccagctcaaggtgcgctaccgcgtcgacggcgtgctgcacgacgccgaagcaccaccggccagttcctcggcggcagtcatctcacgggtgaagatcatggcgcgcctggacattgccgaacggcgcttgccccaggacgggcggatcatgctgcgcatccagggcaaggaactcgatttgcgcgtgtccaccgtaccgaccagcttcggcgagtcggtggtcatgcgcctgctcgaccggcaaaccgtgcagttcgacttcccgagcctgggcttcgacggccagcgcctggccgcgttccttgacctgctcgaacgcccgcacggcattctgctggtcaccgggcccaccggctcgggcaaaaccaccacgctctacaccgcgttgtcgcggctcaataccgccgagcgcaagatcatcaccgttgaagacccggtggaataccagctcgaaggcatcaaccagatccaagtcaaacctgcgatcggcctggacttcgccggcgcgctgcgctccatcgtgcgccaggacccggacgtgatcatggtcggcgaaatccgcgacctggaaacctgccgcatcgcgatccaatcctcactcaccggccacctcgtgctctccaccctgcacaccaacagcgccgccgccagcatcacgcggctgctggacatgggcgtggaaagctacctgatcgcctcgacggtcagcggtattctcgcccagcgcctggtgcggcgcctggacccggcgacgcgcgtggcgtttgcagcgccagcggagttgatcgaggaacatggcctggatcgcttgaccgaccagcgcccgatcctgctctacaccggcagttaccacggccgcagtgcaatcaccgaactactggtgatgaacgacgaactgcgcagcctgctgatgcgccacgccgatgctgccacgttggaacaggccgcgcgccgcgccggtttgcgcaccctgcatgaagagggcttgcgccaggcgctggcgggcgttacctcattggaagaagtgctgcgcgtcacccgtggagacggcgcgtgagcctgttcaagtatcgcgcactggacagccagggcgtggcccacaacggcacgctgcaagcccaggaccaggtcgccgccattgcagcgctgcagcaacgcggctggctgttgttgcacatcgatacggcggccagccctttgttgcgcaacgcgcgcgggcagttgaagggcgcggcgctggtgagttttacccagcagctggccaccttgctgggcgccggccagccgctggagcgcgcgctgggcctgctgctcaagcaacccggccagccacaggtgcgggcgctgatcgagcgcatccgcgaccacgtcaaggcgggcaagccgttatccgccgcgctggaggaggagggcgacaacttctcgccgctgtacctgagcatggtgcgtgccggtgaggccggtggcgcgctggaaagcacgttgcgccaactcagcgactacctggaacgcagtcaattactgcgcggtgaagtgatcaatgcactgatctacccggcgtttctggtggttggcgtacttggctcgttggcgctgttgctcgcgtacgtggtgccgcaattcttgccgattttccaggacttgggtgtgccgatcccgctgatcaccgaagtgattctcgcactgggccagttcctcggcgcctatgggctggtggtgttggccgtactgatcgcagccatctggatggccgcggtgcgcctgcgcgacccgctgcgtcggcagcgatatgaccgccgcctgctcggcattcgtgtgatcggcccgctgctgcaacgggtcgaagcggcgcgcctgacgcgcaccctcggcaccttgctcagcaacggcgtggcactcctgccagcgctggtcatcgcccgccaggtctgcaccaaccgcgcgctgcaagcccaagtggcggacgcggcggaggcagtcaaaggcggcggcaccctcgccagcgcgtttggcgcgcaaccgctgctgccggatttggccctgcaaatgattgaagtcggcgaacaggccggtgaactcgacagcatgttgctcaaggtcgccgacgtgtttgacgtcgaagccaagcgcggcatcgagcgcctgctcgccgcgctggtgccgtccctgaccgtggtcatggccgtgctggtggcggtgatcatgctggcgatcatgctgccgctgatgagcctgaccagcaatatttgaacctccaaggagccacacagatgagacgctttaattcccgatcagcaggccgccaacgcggtttcaccctgctggaaatgctcgcggtaatcgtgctgctgggcattgtcgcaaccatcgtggtgcgccaggtcggcggcaatgtggacaagggcaaatacggcgcaggcaaggcgcagctggccggcctgagcatgaaaatcgacagctatgcgctcgacgtcggcgcgccgcccaacagcttgcagcaactggtggacaaacccgccaacgcgtccagctgggctggcccgtatgccaaaccctcagaccttaaagacccgttcggccacgcgttcggctatcgctacccaggagaacacggcgcctttgacttgattttctacggccaggacggccaaccgggcggcgatggctacagcgccgacctgggcaattgggaataactggcgcatgagccagcgcggcttcaccttgctggaaatgctggtggtcatcctgttgatcggcgttgccgccgggttactcggcctgggcgtgcgccaaggcttgcaggtggccaaagagcgtcgcgcggtcgggcaactggtcgacgcgctgcgcaccacacgggccggggcggtgatcaatggcgcggcggcgcgaactgaatttgatctcaacacgatgacgttccaggcaccgggccgcgcgccgcaaagctggccgcccgagctgcacgtgacgttgcacactgccgaacagtccggttctgccatcgagttctaccccgacggcagctccaccggcggcaacctgctgttggccaatggcacgcggcgttggcgcattgacgtcggctggttgaccggcagcgtgcagtccaaggcgttgccatgaagcgccaggcggggtttaccttgctcgaaatgctcgccgcgctgacgttgatggcggtgtgcagcacggtgttgctggtggctttcggccaaagcgcacgctcactgtcgcaagtggcccatagcgaccgcctcacccatgcggcgctgaccgtgctggatcaggaagcggcggggccgctggccgagggtgtcagcgagggcaatctggacggcatccactggcaactgaccagcacccggcaacaggctcaagtgtttcggcttgacctgaccgtcagcgaagggccgcaccaggcccatttcagtaccttgaaggcccggctgtgaagcgccgcgagcagggcttcaccttgctggaaatccttgtggtgttgagcttgctgtcggtgttgctggtgctggtgggcggcgcattgctcggcgccaatcgcgcggtggccaaggcccagcggtataccgcgagcctggatgaaatgcgcgccgcgcagcagtttttgcgcacggcgatcagcgaagcgctgccgttggatgtcactgaggacgacagccaaaccgagggtttttttgtcggcacacccgagcgcttgcagttcgtggcgaccttgccgggtgtgctcggtggcgggattcagcggttcaccctgcaacgccgcgagcaggcgttgcaggtggcgttttcgcagttggaatcccacaccaatgtcgcccgcagtgagccgcaagtactgctgaaaaacgtcagggatttacacttcagttatcgcggcgtctcgccgctcggccaagctacaggctggatggatgaatggccgtggcctcggcgactgccgtcagcggtgcgcatcgctgcggccctcgacggccctgtgccctgggtcacccaggtgatcgccctgcgcctgaaccttgccagcggagcgcaagaagaatgaagcgccaacgcggcgcggccctgttgctggtgctgtgggcactggcgttgctcagcgtgttgcttggcggcctggccgcttgggtacagctggaaagccgccaggcgctgtggctgcgccagcacacccagaccgtgctggccgccgaagccggcattgccctggccatggccgatcggcactggatcgccgacggccgtgacataccgctgaccttcgacgacgcgcaattgcacgtcagcctgcgcagcgagcgcggcaagctgtacctgatcaacgccgaggcggatgacttcatgcgcctggccctggcctgtggcgccacccagggccaggccgaccaattggtcaaagcgcttgaggcgcgccgcaagcagggcctgccgccgtttcgggtgctggaagaagtgcgccaattgcccggcatgacgcaagcgctgtacagccagttgctgccggaaatcaccttgtggagtgaccttgaccgccctgatccggccttcgccagcccactgatgcgcaaggcgctgaacctgccgcgccagaacaccgaaggcgccgacccaggcgttgtgctggtggtcgacagccgcgcacaacgccccggcggctatcacgcccgcctgcaaatcaccgttttactgagccccacggaggacagcgcgcaaccctaccgggtgctgcgttggcaagaatgaatcgactcgaacccatcgcccggcactggcgcggcagcctgctgcaacaaggctggcgcctgtggctcgcggaattgcgcgcctgtgtgccgacttggctggcgctgcacgagccgcctgagcaggtctttcactggcctttgacagcgcccgtcgcacccggcagcacgcgccaggtgctgatgctcgcgcccgatgccgtgctgctgcaaaccgtgcaattgccgctggccgctgcacgcaacctgaccgccgtggtcggttacgagctggatcgctacacgcctttcgaggcggaccagctgtatttcgtcgcgcgccagcagcagcgcacggccacgcatgtgcaggtcacactggtggcgatcctgcgcgaacagctggaccagatcctcatcgactgcgccgccctcggcgtgcatccccatcgcgtggatgtgaaccacctgggcatcgacttgctccccgcgcccctgcgcccgcgccaacgcccgaccggcaaaggcctgcaacgcagcctgccgtggctgtgcggcgccttgctgattgcggcgatgttgctgtggctcaacgaccgccagcgcgtgctcgacgccatgcacgccagcgtgcagcagcaaaaggctcaggtcgccgaggttcacgcgctgcgccagcaactgctcaacacccgtggcgcagcgcagtatttaacccggcgcaaactcgcgcaaccgcccctggccgcattgctcaacgacctcaccacgtgcctgcccgccgacacctggctggaccagttggacgtcaaggacggcgagatttctttcgccgggcaaagcgccaaggccagtgcgctgatcactcgcatcaagggctgccacagcctggaaaacgcccagttcgaaggggtgattcagcccgatgcacgcaccggcaaggaccagtttgccctgcgtgcccatctacgccaggaggccgccgatgcgccgacccctcacaccccgtgaacgtcgcggggcggccttgctgttgctggccgtggtcgtcggcgctgcttactggctgttgatcgacagctggttcgccggccctttgcgtgacatgggcgagcaggccgagcaattgcgcgagcagcagcaacgctacgccggtgtggtgcgccagggcgatgcgctgcgccagcaactgctgctggcgcaacaagacccggccagcagcaccagcctgttgcccggcgatgaccctgacgtggtggccgccgacctgatgcagcgcctcgccgacctgatcaacagccacgccaacctgggcggtggctgcagcctgacccagcgcaagccgatcaccccggaacaggacgagggcgagccgtatcgccaggtcaaggtcagcctcacgctcgactgcgccatcgagcctctggaggcggtgctgcatgagctggaataccagccgccgtttctgtttgtcgatgagctgcgcatccgccgtggccagcaggcaccggccacgggcggtgcgggaaaactgcaggtgcacctgctggtgcgcggctatctgcaaccgcaggtggcgcgatgatcagtgcattgcgccccttggaatggggcttgctgagcctcgccgggttactcggtgtgttgatggcgttcatcctcagcagcctcggcgacgaaccgcagtggctgcccgcaccggtcactcgcgcgcagccgtcggccagcgtacgcgcagcgccgaacgtgacgttggaaagcctcgccgccacttggcaggcaccgctgttcagcccggatcgcagccccgatagcgtggtcggcaaagcccgggtcacggggctggccaacctcaccctgagcggcatcatgatcaccggcaacctgcaaatggccatgctcaagcaggccgatggtcgccccttgaccgtgcgcctcggccagacgctgcccaacggctggcgcctggagcacctcacgccgcaatacgcccgtttcgccctggacggccgcacgcagaccttgagcctttacgccaagcgcctgccgccgccgtccacccggcccacgattcctcttccccgcgagcccctcccttgatcgatatgcgcacctcaacgttttgcctggccaccgccctcgcactgggcggctgtggcgtcttccccgatcgcctcgacccggacgacgatctgctgcacgaagcgatgcaaggcaccggttcgcagcgcccgccgagtgaggcgcctgcgtctgaaaacccccagcctgcagccacatcggcgccgcaacgccaggtgattcgtggcaatcagcagttcgtgcgccaggccgccgcagcgccgagcacgaaagaggcgggcggcgacatcgtgttcaacttcgccgaccagcccatcgaggcggtgatcaacagcgtgatgggcgacctgctgcacgaaaactacagcatcgcccagggcgtgaagggcaacgtcagcttctccacctccaaaccggtggacaaacagcaagcgctgtcgattctggaaaccctgttgtcgtggaccgacaacgcgatgatccgccagggccagcgctacgtcatcctgccggccgaccaggcggtggcgggcaagctggtgccgcagatgcacgtggccgcgccgtccagcggcctgtcggcgcggctgtttccactgcgctatatctccgccaccgagatgcaaaaactgctcaagccgtttgcccgcgagaacgcatttttgctggtcgacccggcgcgcaatatcctcagcctggccggcactccggaggaactggccaactatcaggagaccatcgacacctttgatgtggactggctcaagggcatgtcggtcggcgtattcggcctgcaacgcgcgtcggtggccgagttgatgcccgagctgcaaggcatgttcggcccggacagtggcatgccgttggccgggatgctgcggtttttgcctatcgaacggactaactcggtggtggcgatttcttcacagccgcagtacctcagcgaagttggtgactggatccgcaccatcgacgagggcggcggtaatgagccgcaaatgtacgtctacgacgtgcgcaacatgaaggcttcggacctggccaagtacctgcggcagatctatggcaatgaggcgatcaaggatgacgagccggccaaggtcgcgccggggttgcgcactgctacgttgtcgtcgcccaaccacaattccggcgggttgcaagatgcgccgccgccctccgatgaacctgagcaggcgccagaagataggtcgaccgtgccggataatagccttgaggccgggacacgtattacagcgcagaaaagcagtaaccaactgctggtgcgcacacgtccggcgcagtggaaggagatcgaggcggcgatcaagcgcctggataatccgccgcttcaggtgcagatcgagacgcgcattctggaggtcaagctgaccggcgagctggaccttggggtgcagtggtacctggggcgtctggcggggaattccggcagcaagacggtggcgaatgcgtccggcagccagggcgcgttgggcggtggcggggcggggttgggggcgtcggattcgttgttttattcgtttgtcagcgccaatttgcaggtcgcgttgcatgcgttggagaccaatgggcggactcaggtgttgtcggcgccgtcgttggtggtgatgaataatcagccggcgcagattcaggtgggggataacattcccatcagtcagaccacggtgaataccggggtttcggataccacgttgagcagtgttgagtatgtgcagacgggggtgattctggatgtggtgccgcgcattaatccgggggggctggtgtatatggatattcagcagcaggtcagtgatgccgagaaccaaactggcacgagtgatacgccggtgaatccgcggatttcgacgcggtcggtgtcgacgcaggtggcggtgcagagtgggcagactgttttgttgggtgggttgatcaagcaggacaatgttgagagtgtcagtgcggtgccgtatttgggcaagattccggggttgcggtggttgtttggcagcaccagcaagtccaaggatcgcacggagttgattgtgttgattacgcctcgggtgattaccagcagcagccaggcgcggcaggtgacggatgattatcggcagcagatgcagttgctgcggccggcgagatgaagtggaggaatggggtaggaaatgtgggagctggcttgcctgcgatggcggtctttgggcttgcgcgtctttaggttgattgagtacatatccgttgctgcggtaacggccgcttagggtttcgctcttacagcgagtcactttttgagggaccaaaaagtaaccaaaaagtcctcgccccaccactcggcacctcgcctaggctcggtgtgccctcactccggctttggagcgggggccgccgcgatgggccatccttggcccagcgcggctaaaccggcgtcctgccggtttacccccgctccaaagcctgcgttcggccagcgtggttgacggggcgcctcagatcaaaatcaagatcaaaatctacagcacggcggcctagtagccgacctgagtggtagaagcaaaagcagagcaacacacctttgtctgatgcaatgcgatccaaatgtgggagcgggcttgctcgcgaatacggtgtgtcagtcaattcatctgttactgacccaccgcattcgcgagcaagcccgctcccacaattttaccgagttcggccaccagcgggctgtgctctgttttcctgtgggggctggcttgcctgcgatgcaggcacattggtctctcaggtacaccgagttgatgccatcgcaggcaagccagctcccacatttggttgagatcagcttccaagaccaggtcggctgccaggccgcctcccacaatttacggagttcggccaccagaccagtgcgctctgcttttctgtgggagctggcttgcctgcgatgtaggcaactcggtacatcaggcataaccagtttatgccatcgcaggcaagccagctcccacatttgattgagttcagcctccaagatcaggtcggctgccaggccgcctcggctgtgcttttgatccaaccactcaggtcggctactaggccgccgtgctctgcttttgatcttgatctgcttttgatcttgatcttaggcgccccgttaaaccacgctggccgaacgcaggcttgaatccgtgggtaacccggcaggacgccgggttagccgcactgggccaaggatggcccattgcggcggcccacggattcaagccggagtgagggcatgccgagcctaggcgaggcaccgagtggtggggcaagagccctttgcttactttggggctttttgtatggaccggacacatggttgacgggtgtgcggggacatggtggacactttgcggcgagccaacttcgtcggaaagccat

SEQ ID NO: 68 - DNA, 47939 bp, Pseudomonas poae FL10F
atccccacccgcccaaaactggccatcaaccacccactcaccgtcgccccaaccgccccacccacaaacgtcgcggtcatatacaaactattgatgcgcccctgcgccttcgggtccaccgcaaacgcccgcgtctggttcgccaccaaccccgcctgcacgccgatatccaacacaatcacgccaatcaccagcaagatcagcgaggtctgcgccccagccagcaacagaaacgccaccgtcacaatccccacgctggctccaatcaccttgcgacaacccaccttatccgccgcccggccgccatacgacgctgcaaacgcacccaccgcgccaataatcccaaacccaccggcccaggcgctgcccaactgccacggcccattcgccagcaaccccgccagattcacccagaacgcgttaaagcacgcccacaacaatgcctgcaccagcatcgattgccgaatcgggctgttgtcgcgcatcaatggccacagcgaagccagcaggcgagggtaggacaggttgctgctcggcacgcccgacggcagcagcttggccgcgataaaccacaccggcagcatgaacgccgcctccagtgcatacaccgcgcgccagccatacgcctcaccgaccacaccgctgatggtgcgcccgagcaagatccccagcatgatcccgctgaccaccgtgcccacattgcgcccgcgctcgtggggctgcgacatcaccgctgcaaatggcaccaattgctgcggcacgcaacacacgatgcccaagccaaacgaggcgccgatcaacgcccagatactcggcgcaaacgctgccgccaaggcaaaacagaacgccagggcgatctgccccagcaccagcttgcgccggtcaaagcggtcgcccatcggcagcaacaacgccaacccggtggcaaaccccagcaaggccgcccccgccaccagattgactgtcgacactgccacgcccaggtccgaggcaatcaacggcagcaccggctgcgtgcagtagatattggtgaccaccgcaccggcgatcaccgccatcatgatgatcttgcctcgcggcggggaattctcggctgtgctcatggcgcgctcctgttgttgctgggggatgagtggccaaccttacgcagtcgcgtttatgtcgataatcccctagaatcgggaatcatccttccagaatttgatagggcgctatgaaccgtcttgagtcgatgtcggtgtttgttgcggtggtcgaggcgggcagcctgtcggcggcggcgcgccagttgggcatgccgttggccacggtcagccgcaaagtcgcggagctggaagcccacctgaaatcgcggctgctgcaccgcaccacgcggcaactgtcgctgaccgacgtgggcgcgtcctatctggcggcgtgtcggcgcattcttgaagagattggcgaagcggagcgggcggccaccggcgagtacgccgtgcccaaaggtgagctggtggtgaccgcgcccatcgtgttcgggcgcctgcacatcgtgccggtggtggcggaatttctggcgcagtaccccgagatcagcatcaacctgatgctcaccgaccgcgtggtgcatctgatggaagagcagtgcgacgtggccgtgcgtatcggtgatctgccggacagctcgctcaaggcggtgcaggtcggcacggtgcggcgggtggtgtgcgccagtccccggtatctgcaaacccatggcgtgccggccacgccgcaggcgctgacggaccacagttgcatcacctttgaagtgctgtcctcggtgggcgcctgggtgtttggggcggggaaagcgcaacaaagcgtgccagtgcattcgcggctgtcggtgaacacggcggaagcggcgatctcggcggcaacattggatgttggcgtaattcgggtgctgtcctatcaagtcgcggatgcggtgcacaagggtgaattgcaggtggtgctgcagccctatgaatcagcggcattgcccatcagcctggtgcataaagggcaggcgccattgccgttgaaagtgcgcgccttcctggatttcgtcacgccacggctgcgtgcgcgcgacgcaaacatcccctgatgcacacggagcaaatgtgggagctggcttgcctgcgatagcagtgtgtcagccatacagctgccaactgaccctccgccatcgcaggcaagccagctcccacagggatcctgtggcttatcagggagcagcttgcaaaaaaagggtgagccgtacgcagattggtcgaccgggaaatgggaaacccggcagggcctggccctcctgcgtatggctcggtccacatcatgcagagcgatcaaatgaatgggcgtagggaaagtctcgttcagcgagcgtagatcgttcccacgctctgcgtggtaatgcataccgtgacgctctgcgtcacccttgcgcagggttcgggacgcggagcgtcccaggcggcattcctttgctgcgcgtgggaatgatcattgcgctggctttgcaacctttcacaaaaccttcatcaaagcgccgcccgccagtcatgtgcaagtaatagcactgacacctggcgcgcctactgtcgtttgaactcaaccgcagccctgttgtggctgttcaaacaagacagagaagcccatgactcacgctatccatgtcgatcacttgaacaagacctttgcgaagaaatccgcattggtcgacctcgaactcaccattgcatccggtgagatggtcgcgctgattggcgcttccggttccggcaagtccacgttgctgcgccacctggcgggcctggcctgttgcgacaaaagcaacggcggcagcgtcaaggtgctgggccgggaggtgcaggccagtggacgcttgaatggcaaggtgcggcggttgcgcgcagacatcggctacatcttccagcaattcaacctggtcaaccgcctgagcgtgctcgacaacgtgctgctcggttgcctgggccgcatgccgcgctggcgtggcaacctcggcttgttcaatgccgaggagaaggcctttgccatggaatccctggcccgcgtcggcctggccgatctggctgcgcaacgtgcgtcgaccttgtccggcggccagcagcaacgcgtggcgattgcccgcgccttgacccagcgcgccgaggtgatcctcgccgacgaacctatcgcctcgctggacccggagtcggcacgcaaggtcatggagatcctcgccgacatcaaccgccgcgacggcaagaccgtggtggtgaccctgcatcaagtcgattacgccatgcgttattgcccccgagccgtggcgctcaaaggcgggcggattcattttgacgggcagggcagcgccatgagcagccagttcctcaacgatttgtacggtgccgacgtcgacaccagcctgatgttttccgaccagacccgccaccccgaaaccacccctcggctggccctggcgcgcgcttgaaaccctactcacgacccacaggaatcctttccatgttgaaccgtatcggccacgtgtttctgtctgcggtgttgctggccggcgtcgccttgggcaatgcccaggccgccgacaaagccatcaacttcggcatcatgtccaccgagtcttcgcagaatctcaagagcatctggcagccatttctggatgacatgcacaagaagaccggcctgaccatcaacgccaccttcgcctccgactacgccggcctgatccagggcatgcgcttcaacaaggtcgacgtggcctggctcggcaacaaggcggcgatggaagccgtggaccgttccaacggcgagatcttcgcccagaccgccgccgccaacggcgccgccggttactggagcgtgctgatcgtgcgcaaggacagcccgatcaacaacgtcgacgacatgctcaagaacgccaagaacctgaccttcggcaacggtgacccgaactccacttccggctacctggtgccgggctactacgtgttcgccaagaaccatgtcgacgccgccaccgcgttcaaacgcacgctgaactccagccatgaagttaacgccttgagcgtggccaaggggcagttggacgtggccaccttcaacaccgaaagctgggaccgcctggaagtcacccagccggacaaggccgccatgctcaaggtgatctggaagtcgccgctgatcccggctgacccgatggtctggagcaaagcgctgagcgacagcgagaagaccaagattcgcgatttcttcgcccactacggtgacaccgacgaagagaaggccgtgctgaagaacatgcagctgggcaagttcctcgcttcgaatgacgaccaactgctgccgatccgccagctggagctgttcaagcagcgcaccaccatcagtgccgacgacaagctggaagcggctgacaaagccaagaagctcgccgacatcgacgccgacctggccaagctgcaacagcgcatcagcgagctcgacaaaaagactgcggcaaacggctaaccccctgtaggaaccgggctttatgtgggagcgggcttgctgtggcgagggagcttgctcccgttcgacagcgcagctggagtcggcttttttggggctgcttcgcaccccagcgcaagcaagcttgctcgccacagcaagcccgctcccacagagatccagttcccacagctatcgagagtgatccatgacgactttgcacgctgaagctgtaggcaaaagaacctggccgcaatacctcggctggggcctgttcctggtcttgctggcctgggcctggcacggcgcggaaatgaacccgctggcgctgtaccgcgattccggaaacatggcgaccttcgccgccgacttcttcccgcccgacttccacgaatggcgctcctacctcaaggagatgatcgtcaccgtgcaaatcgccctctggggcacggtgctggcgattgtttgctcggtgccgctgggcatcttgtgcgccgacaacatcaccccgtggtgggtgcaccagccgctgcgccgagtgatggacgcgttccgctccatcaatgaaatggtcttcgccatgttgttcgtggtcgcggtcggcctcggtcctttcgccggtgttctggcgctgtggatcagcaccaccggcgtgctcgccaagctgtttgccgaagccgtcgaggccatcgaccccggtccggtcgaaggtgtgcgggccactggcgcgagtgccttgcaggaagtgatctacggggtgatcccgcaagtcatgccgctgtgggtgagttacgcgctgtaccgcttcgaagcgaatgtgcgttcggccacggtggtcggcatggtcggcgccggcggtatcggcgtgatcctctgggaaaacatccgcgccttccagttcgtacaaacctgcgcggtgctgctggtgatcatcgtagtggtgagctgtatcgacgtgctgtcccaacgcctgcgcaagcagttcatctgaagcctgaggggtgcccgcgcggcgctttttttaagcatgcagttgtctagacaagatgagccggtgtaccgcgaactcgcggacatcctgcgccgtgaactgagcagctacagcgccggcgacttcctgcccggcgaggtgcacatggccgagcgcttcggcgtcaaccgccacaccttgcgccgtgccatcgacgagctggtgttcgaaggcagcctgctgcgccgccagggcaagggcacccaggtactcgaccgcccgctgatttactcgatgggcgccgagacttcctacagccagtcactgtcggcccagggcgtcggcgtgcaggcggtgttgctcaagcgccgctattgctacgccagccgcgaagaagccctgcacttaggcattgccgagatggcgccgatgatcgagctgcaaaccctgcgcaagctcgatcaccagccggtcagcctgatccgccatcgctactgcgccagccgggcgccgttgctggccgactacaacggcggttcgctgcgccagtacttgcgcgagcgtgacctgccgctgacccgcacccaaagcctgatcggtgcgcgtttgcccaaccgtgatgaagccgcgctgctgatgatgcctcggcacttgccggcgctcacggtttttaccctttcctgcgatcgcgacggccgcccggtggagctggcgcagtccaccagccgttcggatcgcttccagtaccaagtggtgacttgaatgatgagtgtgtccccgcgacaacattggatcggcgtattagcccgcgcccagctcaatgaactgcaaccccacgaagccgccttgaaggacgccgactaccaactgatccgcgccccggaaatcggcatgaccctggtgcgcgggcgcatgggcggtgacggcgccgccttcaacgtcggcgaaatgagcgtgacccgctgcgtggtgcgcctggctgacggccgcaccggctacagctacctggccgggcgcgacaagctgcacgccgagttggccgcgctggccgacgcccatttgcaaggcagccagccgagcctgtggctcagcgatttgatcaccgcgctggccactgcccaagccaaacgccgcgcgcaaaaagaagccgataccgctgccaccaaggtcgagttcttcaccctggtgcgaggagaaaactgatgaacgctcacctgttacagccggcgtttgtcgacccggtattggacgcccagcgcggttttcgcgcggcgctcaaggcgctcgccgaacctggcctgctccagcacttgccctcggccccacgcctcgacggcctggcacctgccacctacgcgctgtgcctggcgctgctggatatggacacgccgctgtggctggcgccgagcttcgatacgccgctgatccgcgccaacctggcctttcactgtggctgcccgttgacggataagcgtgaagaagcggcattcgcgctgctcggcgaacacgacctgctcgacctcagcggtttcgaccacggcaacgaccgttaccccgaccagtcctgcaccttgcttgtgcaactcaccgacctggaatccggacgcggcctgcaatggcgcggccccggcatcaagacgcaacgcctggtcaatgtgccggtgccgcaagccttctggctcgaacgccaacgccgtgaagccttcccgcgtggcctggacgtggtgttcagcgcaggtcatcacctgatcggcctgccacgcagcagccgactgttagaggagcgtgcctgatgtacgtagccgttaaaggtggcgaacaggccatcgacaatgcccaccgcctgctggcgaaaaagcgccggggcgatacccgcgtgcctgaactgagcgtgacgcaaatccgcgagcaactgccgctggccgtggcgcgggtaatgaccgaaggctcgctgttcgacgaagaactggctgcgctggcgatcaagcaagcggcgggggatttggttgaggcgatcttcctgctgcgcgcctaccgcaccacgctgccgcgcttcagcccgagcttgccgattgatacgtcgcagatgtcgctgagccggcgtttgtcggccacgttcaaggacgttcccggcggtcaattgctcggcccgaccttcgactacacccaccgcctgctggatttttccctgctcgccgaaggtcaacacccaggcccgcagaccacgcccgaggcgcgcatcgacgcctgcccacgggtgctcggtttgctcgccaaagaaggcctgatcaaaaacgaaaccgacgacaacgccagcgtcgccgacatcacccgcgacccgctggaatatccggccagccgcgccgagcgcttgcaggccttggcccgtggcgatgaaggtttcctgttggcgctgggctattcgacccagcgcggctacggccgcaaccacccgtttgccggtgagatccgcattggcgacgtggaagtgtggatcgaccccgaagagctgggcttcccgatctgcctgggcagcatcgaagtgaccgagtgcgagatggtcaaccagttcgtcggttcggccactgagccggcgcagttcacgcgcggttacggcctggcgttcgggcatgccgagcgcaaggccatgggcatggcgctggtcgaccgctcgctgcgcgccggggaatacaacgaagaagtcgtctcaccggcccaacgcgaagagtttgtgttggcccactgcgacaacgtcgaggcggcggggtttgtctcgcacctcaaattgcctcactacgtggacttccaggccgaactggaactgatccgcaaactgcgccaaccggccgagggcacacgccatgaatgacttgacgcaaaccccggcgcgcgacccggcgtacaacttcgcctacctcgacgagcagaccaaacgcatgatccgccgcgccttgctcaaggctgtggcgattcccggttaccaggtgccgttcggtggccgcgaaatgccgttgccgtatggctggggcacgggcggcatgcaattgaccgccgcgatcctcggtgatgacgacgtgctcaaggtgatcgaccaaggcgccgacgacaccaccaacgccgtgtcgatccggcgctttttcgcgcgcacggcgggcgtcgccaccaccgaagccacaccgcgcgcctcggtgatccagacccgccaccgcatcccggaaaccccattgcaggccggccagatcatggtttaccaagtgccgatccccgagccgctgcgctttatcgaaccgtcggaaaccgagacccgcaccatgcacgccctcaacgattacggggtgatgcacgtgaaactctacgaagacatcgccaccttcggccacatcgccaccgcctacgcctacccggtgatggtcgacgaacgctacgtgatggacccgtcgccgattcccaaattcgacaacccgaaactcgacatgagcccggcgctgatgctgttcggcgccggtcgtgaaaagcgcttgtacgcggtgccgccttacacccaggtcaccagcctggactttgaagaccacccgtttgaagtacagaagtgggcgcacaactgcgccatctgcggcagccacgattccttccttgatgagctgattctcgacgatgcgggaacccagagttttgtgtgttccgacacctggtattgcgcccaacgcgtgaaggagaacaaccagtgagccagccgttattgcaagtgcgtgacttgtcgttgctttacggcccggagaagggttgccagggcgtcagcttcgacctgtaccccggcgaagtgctggggattgtcggcgagtccggctcgggtaaatccaccttgctctcgctgttgagcgggcgtttgccaccgcaagccggcaccatcggctaccgcagcaaggacggcgaatggctggatttgtacagcgccagcgaagccgagcgccgcaccttgctgcgcaccgagtggggctttgtcgagcagaacccacgggacggcctgcgcatgggcgtgtcggccggggcgaatatcggcgagcgcctgatggcccaaggcgtgcgcaactatgcgcagctgcgtggcgccggcctcgactggctcggccaggtggaaatcgacccgcagcgcatcgacgacctgccgcgcaccttctcgggcggcatgcagcaacgcctgcaaatcgcccgcaacctcgtctccagcccacgcctggtgtttatggacgaacccaccggcggcctcgacgtgtcggtgcaagcgcgcctgctcgacctgttgcgcggcctggtgcgtgagctggacctggcggtggtgatcgtcacccacgacctggcggtggcgcgtttgctggctgaccgcctgatggtgatgcgccgctcgcacgtggtggaaaccgggctcaccgaccagatccttgatgatccacagcacccttactctcaactgctggtgtcttcggtattgcagccatgatgaacgccttgatcgaggtccgtgacctctcgaaaaccttcaccctgcaccagcagaacggcgtggtgctcaacgtgctgcgcggtgtggaattcagtgtgcagggcggcgaatgcctggtgctgcacggccagtccggcgcgggtaaaagcaccttgctgcgcacgctgtacggtaactatctaccggcaggcggcagcattcgcgtcaggcatgccggtgagtggctggagctggtcggcgccgagccgcgtgacattttgcaggtgcgtcagcacaccctgggctacgtcagccaattcctgcgggtgattccgcgcgtggcctgcctggacgtggtgatggagccggcgctggcccgtggttggtcgaaggccaatgcgcagtcacgcgccgagcacctgctgacgcgtctgaatattcctctgcgcctgtggcaactggcgcccggcaccttctccggtggcgagcaacagcgcgtcaatatcgcccggggcttcatggtcgagtggccggtgatgctgctcgacgagcccaccgcgtccctggacgacaacaaccgccaggtggtgctggaactgatgaacgaagccaagacggcgggtgccgcgctgatcggcatcttccacgaccgcgccgcccgtgaagcggtggctgaccgccatttcgacatgacccccacgcccgttgccgaagaggaatacgaacatgcccgctgaacagatcctcagtaatgcccaggtcgtcacggctgagcgtgtgttcctcggttcggtggtgctgcgtgatggcaagatcgtcgacatcgccgaaggccgcagccagttgcccaaggcccaggacctgggcggtgattgcctgctgccggggctggtggagttgcacaccgacaacctggaaaaacacatgaccccgcgccccggcgtggactggccgtcgacctcggcggtgctcagccacgatgcgcagatcatcgcggcgggcatcaccacggtgttcgatgcggtgtccatcggcgatgtgaaccccaagggcaaccgcatgaaaaaactgccggcgatgcttgatgccatcgcccaggcagaaggcgccgggctgactcgcgccgagcaccacctgcacctgcgctgcgagctgtgccacccggacaccctcagcgtgttccgcgatctggtggaaaacccgctggtgcgcctggtgtcggtgatggaccattcgccgggtcagcgccagttcgtgctcgaatccaagtaccgtgagtactacatgggcaagtaccacctcaacgatgaaaccatggacgcgtttatcgtgctgcaaatggccaactcccgcgagtacagcgaccgctatcgcgcggccatcgtcgagcattgcctggggcgtggcctgtcggtggccagccatgacgacgcgacgcttgcacatgtcgaggaatcggcgcgctatggcatgaccatcgccgaattcccgaccacgctggaagcggcgaagggctgccaggcgctgaacatgaaagtgctgatgggcgcgccgaacgtggtgcgcggtggttcgcactcgggtaatgtggccgccgccggcctggcggccgagggcttgctggatatactttccagcgactactacccggccagcctgttgcaggccgcgttcgtgctggccgaccaacaggacggcggcgacctggcgcgcgcggtgaagatgatcagcctggcaccggcgcaagcggcgggcctgaacgatcgcggtgaaattgccattggcctgcgcgccgacctggtccaggccaggcgccgcgaagggctgcccgtggtgcaacaagtgtggcgacaagcgaagagggtgttttgatggcaggcaggttgatctatctcatcgggccatcgggttcgggcaaggacagcctgctggatgccgcgcgcccgcgcttggccgagcgcggctgccgcattgtgcgccgggtgatcacccgttcggccgaggcggtgggcgaggcggcccaaggtgtgagccccgagcagtttgccgcgatggacgccgagggcgcgtttgcgctcagctggcacgccaacggcttgtcgtatggcattcccaaggcaatcgatgcatggctggcggcgggggacgatgtgctggtcaacggctcacgcgcgcacctggcgcagacgcgcgtgcgttatccgacggtgttggtgctgttgctgacggtggaccaggccgttttgcgccagcgtcttatcgcgcgcgggcgtgagtcgctggcccagatcgaagagcgcctggcgcgcaatgcgcagttcaccgccgagctgatcagcggcaatagcgcggggttgtttgtgctggataattccggcccattgggcaacaccgtcgagcgcttgctgtgctgcctcgatcaagggcactcggcatgcgcctgaccttgctgggcaccggcgacgcgcggcaagtgccggtgtatggctgcgaatgtgcggcctgtggcctggcgcgcagcgatgcaagcctgcgccgcctgccgtgcagcgcgttgatcgaatgcggcgaccagcgctggttgatcgacagcggcttgcccgacctctgcgaacgcttcccgccgcgcagcttcaacgggattttgcagactcactaccacgcggatcatgcccaaggtttgctgcatttgcgttggggccagggcttgatcattccggtgcatggcccggcggatccagaggggttgtccgacctttacaaacaccccggcattctggatttcagccagccgttcgcggcgttcgagacccggcagttcggcgagctgagcgtcaccgcgttgccgttgcagcattccaaactgaccctgggttatttgctcgaagggcaagggcggcgcatcgcctacctcaccgacactgtcggcctgccgcccgacacgctggcctggttgcagcgtgagccattggatgtattggtgctcgattgctccatgccgccgcagccgcaagcaccgcgtaatcacaatgacctgacgctggcgttgcagagcattgaggacaccggcgcgcaattgggcgtgttgacccatgtggggcatacgctggatgcgtggttgctggaacattggcgcgagctgcccaggcatgtaacggtggcatgggatggccgaattctctaagcaccgcataaccctgtgggagctggcttgcctgcgatagcagcaccttggttcccccagtcataccgagtcgtctgcatcgcaggcaagccagctcccacacaagccagctccaacctgtctgtattccaagtcgggacgtgagtttcctgcgcttcttgacgctgtgatgtttgcgcaatgtttaattgtagaattttatgtgcggtcctttattctccaagcctgtatttgcgggcgggtgaagcgttttaagatgttttaaggtttgaacatgaaatactatcgggttggcgttagtgagttgtctatgggactttattgttgcggtaagttggaattgccgttatcacagccttttggtagggctgaatataaagtttttcaaaggatgttttatgcgtgttgctcattcgtttgttaatcagcctcttcccgataatgaacttcctacgctgaatgctcccgctttctcaccgtactcgacgttatccactcgcgcaacgcaacaacgttcctttaacacggacgaggctgcccagcagattctgcgaggaggctatcggcattatgatcgcaatggtgatgggaaaatcgagctgtctttcacgcttgatccagccttctccgccccccagaaagtggctattcgcaaagcgctgcaggcttggcaggacgtggccaatattgcgttcaaggaaggctcaacgcagttggacggctctataacgtttaaagccgcccccaataccagtgggggaaagtcacatttgcctgattgggatcacgctgacatgaccaccactatcggaacgaagggcgcttctgaaacgccccaaaatggcgactattttttattaaccgccatacatgaagtggggcatgccattggtctcggccatcccggcgactatgaagagagtgtggacagctatacaaagacgccctacaaacaagacacccgggcccatagcgtaatgagttattggcctgaaactaatcagcccgggcatgatttcaaggagcgtgggccttcggtactgatgaaggatgacattgcgtcggggcagaagttatatggtgtcaacttcaagacgcggaatacggacaccgtctatggctttaatgccactactggcgatggttacttcagtcttaactccgcgaatgacaaacctgtgttttcaatctgggacggcgggggtcatgacactttggacttctccggcttttaccagtatcagaaaatcaatttgcgcgctgagtcgtattccagtgttggtggcttgaagggcaatgtgtccatcgccaagggcgtcgtcatggaaaacgcaatcggcggttccggcgatgacgacatcaatggtaacgaggttggcaacaggctccgtggcgggggcggagcggaccggttgagaggcggtgcaggcgcggatatttttgtttatgacacagccagtgactctacgctcgacagcccggatgacattctggatttcaccagtgggtcggacaaaatcgacctcagcggcttattcaaaaactactcggtcaagaatttcaaggtggttgagcagtttaccgggcgagccggcgagatcgttctcagccatgatcagaacagcgggaatggcagcttgagcgttgacctgacggggcgtggcaaagccgatgtgtttatcaggagcgtgggcgttattcaggccagtgacattgtcactggcgagggtgttgcgcaaccgaacaccaccccgattatccagggctcgggcggccacgacaccctggatttttccggcgccaggcagaaccagaccatcgacttgcgccgctctgcaagctccggcgcaggcggcctgcgcgaccacgtctcaatggctgaagacggtctagtggcgaatgccatcggcggttcaggcagggaccggatcatcggcaacgaggtggacaacaccctcaccggcggtggtggcggcgatgtgctgtggggcgtgggcggtagaaacacattcaaatatgccaaggtcaccgactcgctcttttacgaccctgaccggctcatggatttcgccagtggcgaagacacgattgacctgacagcactggcaaccgagctgggaacccctttgcgcctggttgatgcctacaccgggcgtattggcgataccgtggtcaagcacgacccaaggactggccgttccgttgtgggaatcgacctgctcggcaggcgtcactcggacttccttattcgaagcgcgcggttgatcaagccgcaggacctgctcggcgtggccagccgttagcgcccaccggctcaagcgctgagcagcgtttcgacatactccacaaacgcccgcgccttggcgctcgccatcctgccggttgggaacaccgcccacaaatcaaccggcgggagatgccagtcggtcagcaccggcaagcgtcattcaaaaatggtttttgctggccgcaagaggtttgttttaaaagcgccaaggtaacgatgagttggtgttgggatcgcagttgcggtcatgtttcaagaatgtgcattttagtgtttcgcaatatgcggatttgattgtgggttagctgttgtttgtcattgtatgtgaggtgttgtttttatattttgtagtgttttataagtgcgttgtccttggctgttggtttttcgtatgcgactcttttggggggagtaacctcttgggtgctcgttgattattttgtgcggttaaaaatattctagagaggacgttggatgcttaatggtgttgttggcgcgggacggctgaggcagaatgcgtcagttttttcaaaacccaatttatcttctgcacctgcggcctatgggtataatgcaggtaatggtaaaacctctttttctacggaagaagcgggtaaatatatagttcgcaacgggtatagacactatgatcataataactctcaaaaaatagagttatcgtttactatcggtacggggttctcggctggccagcaggcgcgaataaggcaggctctggaagcttggcaagatgtcgcaaatataacattcaaggaacatgcgacgggaaccgatggctcgctgaaatttaacaaagaccccagccataatggtggctttggctctgttccgaatcggtattcccgtgatatgtcgattatcgtcggaacgaaacatgtaggtgattctcccgggaaaggcgactatttcactttcacggcacttcatgagatcggccatggcctcggccttgaccacccagggaactataatagcgttgtaggcgggtacgagaaaaacgcacattatgcgcaagataccagagcgcgaagtgtgatgagctattggcaagaaaccaatcagccgggacatgatttccgttggcgctattcaccgacgccgttgctggatgatattactgctgtgcaacatctttatggtcctaataaaagcactcgaaataccgataccgtctatggtttcaactctaatactcagcgtgacaatctgagtctgacatcatccaccgaagcgcctgtgttttgtgtgtgggacactggcggcatcgacacattggatttttccgggtttcggcagcgtcaagtgatcaacctcaatgctgagtcattttcagacgtcggcgggttgaagggcaacgtgtctatcgccaaaggtgtggtacttgaaaatgcgatagggggcgccggcgatgacgatctgctgggtaatgaggtcggtaatagaatcaaagggggggctggcgccgataagttgaaggggggcggtggggcggatgtttttgtttacgacgacgccactgattcaacgttagaaagacccgatgaaattctggattttaccagtgggtccgacaagattgatctttccggcattctgaaaaaacaccgactttcaagtgttcatgtcgtggactggtttaccggccgaccgggtgaggtcgttctgggttacaaccctaaaaccggccgagcaagcttgagcctggatctaaccggtaacgctagggctgacatattaatcaacgctcaagggctgatccgatctgccgaccttgccacaggcgcaggtatcaagccggtgatagtggaacctgatctgacgccccaacctaagcctgggacttcaaacaccgtctacggcttcaactccaacaccggcaatccggccatgagcctgaatgcttccagcaaagcgcctagatttacagtggtagaccgggagggtaatgacacgctggatttctccggtttcaaacaggatcagcgcattgatctacgtccgggcgcgggctctggtataggcggcttgatcaacaatgtttcaatcgcaaagaatgtcgtcatagagaatgccatcggtggttccggcaatgatctgttaatcggcaaccatgtgggaaatgtgctgaaaggcggcgtaggcgcagaccgtttctggggggtgggaggggcgaatacctacgcttacaacagcgtaagcgattcaagttactacaactctgacctcatcatggacttcgtcagtggcagagacaaaatcgacctgagggtaatcaagcaaaaggcgaaggtgcctttgcgacttgtcgactcctacacgggtcgagttggcgataccctagtgaagttcaatccaaagagcggtcgatacttcattggtgtggacctgacgggcaatcgccaaacagacttcctggtcagaagtgattaccccatcaagccagaagacgtgattggacttgccgcttaaattgcggttttcggttcagactactcaggtgtttaatacataaggttgataaaagatcgcctcttcaggtcttcaataaaccttccacgtactccacaaacgcccgcgccttggcgctcgccatcctgccggttgggaacaccgcccacaaatcaaccggcgggagatgccagtcggtcagcaccggcttcacttcgccgttggccagttccggggcaaacatccaggtcgacgccatggtcaggcccaaatggctcagcacggcggcgcgtacgccttccgcggcggtgacgcgtatgcggccgcgggcgacgatggggtgttgggtgtcgccttggctgaacgcccagggtgagccgccgccgagggtgtagatgatcgccaggtgctgcagcaaatcggctggggtggccggctcgccgaaacgctcgaagtacgccggggtggcgagcacttggcgcggggattggccgatcttgcgcgcggtaaggccggagtcggtcaagttgcccatgcgcagggcaacgtcgatgccttcttccaccaggttgaggctgtggtcattgagcaccacttcgatattgaccccggggtattgctccaggaacggccccaggtgaggaatgatgtgcaagcgggcgaaggtggttgcggcgctgacgcgcaagttgcccgacaagcctgcacccgcgcctcgggcggcatcatcggcttcgttggcttcgtcgatggcgcgcttggctttttcaaaaaatgccaggccggcttcggtcggggtcaggccacgcgtggagcgcagcagcaagcgcaccgccaggcgcgcctccaattgcgcaatgcttttggagatggcgggttggcccacgccaagctgtttggcggcggcggagaacgagcccgtctcgaccacatgcacgaacgtttccatggcggtgaggcggtccatcgagtctccttggtttatcggttaaggggttattgggtaagggcgtcgagcatcgccgacggttctgggcgttgagtgtaatccgggttgacctcggcgtaacgaatcacgctgtcctggccgatcacatagcgcgcaggcatgggcagggtccaggccggatcatcgttgatcagcggcaggttgttgccgaagcccttgtagagttcgatcaggtagtccggcaattgaaagcgcaagccgaacgcctcggcgacgtcgttgtgggtatcgctgaggatcgggaagcccagttcggcgatgcgctcggctttacggctgttggcggcggtctgtggcgacagggccagcaaggttgcgccggcggctttcaacgtcggcagaaacgcttgcagcgcttgcagctccatattgcagtacgggcaccacacgccccggtagaacgtcagcaccagcgggcctttggccaacaggtcggccgaggacaccagggtgccggcggcgtccttgaggctgaacagtggggccttgtcacccaccttgagcgcccgttctgcggcgccggaagcgatcagctcggcggtggcgcgctccatgatcgggtgaatgtgcgccggtgcgttgtagggcggcttgccggctttgaagtcggcgcggaaggcatcaagtgtggcttgaagtgtcattgcgatattccctcgggagatgagccaggttggctggagagcagcatgggggaggcaggatgggcgaggaagccgggcgcagggcataggatttatgctctgttggaatagatttagcggttttccaatatggcgtaatacaaccgtcaatccactccagccaatctgtgcttgagtaaatataactctagggttacttttattcaggccaagccaaggaggctggggtgcaaagcaggttattgatcaaggagctgcaagaggcgggttgggtgctggatcgggttacgggcagtcatcatatttttactcaccgctataacccgtacacgatcccggtgccgcaccccaagaaggacttgcccctgggcaccgtcagaagcatcaggaaacgcgccgggctgtttcagttttaaggagagcactcatgcaatacccaatgtgtatcgaatggggcgacgacttcaccgccaccggtattcagatccccgatattccaggcgcggtcaccgccggggacagcttcgaagaggcgtataacgccgccgtggaagtcgcgcacatcatgctgcaggagatcgccgccgaaggcgggccaattccgatgcccacctcggtggccaaccaccacgcgaacgaagactacgccgggatgggctgggggatgttggagttggacatctcgccctatctgggcaagaccgagaaggtcaatgtgaccttgcccggttatgtcatccagcgaatcgaccgttatgtgcgtgagcacaaggtcaaaagccgctcgtcatttctggcggatgcggccttggagaagttggtgcgctcctgaccgcaatcaggcggtggcgaccgccacttgccgcgacgcactcacgaaccgcaacaacgccaccagcgggaacgcactgcccaccagcattacgcccagccagccgccgtgttcatacacgctgctggcaatcgccgagccgaaggcaccgccgatgaagatgctggtcatgtacagcgcgttcaggcggctgcggctgttggcgtcgagggcgtagatggcgcgttgaccgagcaccatgttcatctgcacgcaaaaatccagtaccacaccggtcacggccaggccgatcacgctgtacagcgggtgcacaaaggccggcagaaaactcaacgcggcgaacagcatggccagcaacgaggcgcggtgcgtgtggcctgcatcggccaggcggccggcaattggggcggcaatcgcgcccagtgcaccgaccagggcgaacaacgcgatctcgctttggctcaggccatgattgcgtgccagctcaagaggcgcggcggtccagaacaggctgaaggtggcaaacatgcagccctggtagaacgcccgctggcgcaataccggttgcttgcgcagcagcgtaccgagtgagcgcagcagttggccgtagctcgcgctgtggtcgggttgacgcttggggatggtcagcagcagcacgatgctgatgaacgccatcaacgcggcggcggccatgaacatcgcacgccagccgaagtgatcggccaccacgctggacaccggccgcgccagcaggatgccgagcaacagcccgcccataatgctgccgacgacgcggccacgggattcggcaggcgccaggtgtgcggccagcgggatcagaatttgcaccgagacggaactgaatccgatcagcaacgacacaagaaggaacaaattcggctgctcggtgaaagccgcacccagtaggctggcgatggccagtaccgtggtggcgatcatcagcttgcggttttccagcaggtcgcccagcggcaccaggaagaacaggcccaaggcgtagccgatttgcgtcagggacacgatcaggctggccatcgccggggtcaggccgatgtccggcgcaatcaattcgatgatcggttgggcgtagtagatgttggccacaatggcgccgcaacagaacgcaaaaagcatcaccatgcctcgggtcatggtacctgtagcgtgtggagtcgcgttcatggtgttctcgtcaaagcaaaggaagatggcgtgcgagagtaaaggcaacctcgaggccggagtagggcgctgtgagtgatatcactcatgccgcaaattaatgactgaatcgttaacttttgagtcgaacggcaatgatacattcagtcacaactgccgaaacaggaaatccactttcatgaaaatcgcgctgaacaagatgatcctggcttcaaccctcgccgcggccatggccattggcttggccaacgccgccaatgccgccgacgcgccacgcgtcggtgtgcgcggcgccattacggcgatcgacggcgacgccatgcacgtcaagatcaacagcggtgaagacgtcaccgtgcacctgaccaaagacacccaggtgcgcgccgtcaccctggccaagattgatgaaatcaagcctggcagctacatcggctctgccgccatgccgaatgccgacggcaccctgacggccttggaagtccacgtgttcccaccggccatggccggcaccggcgacgggcaccgcgcgttcgatttgaaagaaggcagcagcatgaccaacggcaccgtcggcgacctggtggtcagcaacgggcgcaccttgaccgtgaagtacaaaggcggcgagcagaagattgtggtgccggacgatgtgccgatcgtgaacctggagccaggtgaccgcagcttgctcaaaccgggggtgaaggtggtgatgtttgcggcgcagggcgcggatgggacgattaccgcccaagcgatctccgccggcaaggatggcgtgacaccgccgatgtaacggccaaacactaaaccaaatgtgggagctggcttgcctgcgatgcaagcacctcggtgtttcaggcattgcgaggtgatgctatcgcaggcaagccagctcccacacttgactgcatttcttcagttaaagcggtttattgaccgctgtagatctgatcaaaaaccccgccatcattgaagtgggttttctgcacggtgcgccagtcaccaaaggttttctctaccgacaggaagtcgactttagggaagcggtcggtgtacttggccagcactttcgggtcacgtgggcgcaggtagttgttggcagcaatttcctgaccttccggcgaccacaggtatttcaagtagtcctcggcagccacgcgggtgccttttttctcgaccactttgtcgaccaccgacaccggcggctcagcttcggccgagacgcttgggtagatcacttcgaactggtcacggccaaattcacgcgcgatcatttccgcttcgttttcaaacgtcaccagcacgtcgccgatctggttggtcatgaacgtggtggtggctgcacgcccgcccgtgtccagcactggcgcgtgtttgaacagctcgccaacgaatttcttcgccttgtcttcatcgccgccgttcttcagcacataaccccaggccgacaggtaggtgtagcggccgttgcccgacgttttcgggttgggcacgatcacttgcacgccgtccttgagcaggtccggccagtctttcagggcttttgggttgcccttgcgcacgataaacaccgtagccgaggtgaacggcgcgctgttgttcggcaggcgcgttacccagttgtccggcaccagcttgccgttgtcggccagggcattgatgtcggtggccatgttcatggtgatcacgtcagccggcaggccgtcgatcaccgagcgcgcttgtttgctggagccgccgaaggacatctgcaacgtcagcttgtcgttcgggtgctcggcttcccagtgcttctggaaggcggcgttgtagtccttgtagaagtcgcgcatcacgtcataagagacgttgagcagtgtgacgggggcggcctggacggcgcccgccagggcaaggccggcggccaggagagaggcgctaacgagttttttcactgctcattccttgttgttcgagaaggttgctgattgagtaggggcaatttgccagcgactatagccgggcctgcatagacgtttaaagattaaaacgaactttgcttattccactttacgaaacaagttactgccacagcgcgagcaaaacgccgcgttgggttcgtggttgtctttcttgcacaccgggcaatcatgcttcaactgttcgccgcgcatggcgctggccaattcggcggtgaagatcccggtgggcacggcaatgatcgagtaaccagtgatcatcaccagcgacgaaatgacctggcccagcggggtcttcggcacgatgtcgccaaagcccacggtggtcagcgtcacaatcgcccagtagatgcctttgggaatgctggtaaagccgtgttcggggccttcgatcacgtacatcaaggtgccgaacaccgtcaccagggtgcacacgctgaccaggaacaccacgatcttctgcttgctgccgcgcagcgccgccatcaggtagttggcttgcttgaggtacgggctgagcttgagcacgcggaaaatccgcagcatccggatgatgcggatgatcagcaggtactgggcgtcgctgtaatacagggcgaggatgccgggcacgatggcgagtaaatccaccaagccataaaagctgaaggcatagcgcaatggcttgggcgaacagtacagccgcagcccgtactcgatggcgaagatcagcgtgaagccccactcgatatacgccagcagatttgcgtagttctggtgaatctggtcgatgctgtcgagcatcacgatcacaatgctggcgaggatgatcagcagcaggatgccgtcaaagcgccgcccggccagcgtatcgctctgaaataccatgacgtagagccgctgacgccagtcgttgttgctgtccataaagcccgcccaaatcgaatatcgagcaagcctagggggattcgtacgggctgtccacgcgggcttttaacaaccgctggctggcgcgtaccagccagcaggcgaggataaacggcgcggtcagcgcaggcaggtgcagcgcggcgaaaccgggcgtgagcatgaccgccaggagaatgccgagcagcggcagccacggttggcgacgtgtctggctcaacgccagtgcggccaacgccgggttgtagctgtgcaggccgaggagggcgctgccggtttcgtccatcagcagggcgagcagcacgccgcaactggcgccgatcaacgcccacagcgcggcgcggcggttggccagcaacaggcccagcgcaatcagtgcgccggccaccggttggtccagcagcatgatttgcgcgagcccggtaaacggcgcgctgagcgcgctcaacgtatcgggttcggtgagcacaaatgcgttctcaggcacgctgcccagcagcaaccagcccaggccgacaaaaggcgcggtataggcgggcaggtcatccgccgccgtcgcgtgtttcaaccactgccgtgtgagcatcgcactcaagccgccgcacgccaggatcagcggcggcaacaaggccgaccaggcgaaatgctggctgatcaacacacccagcagcacaccgttgtagctataaagcccggcctggcgttccgccttgggataaccccggcgctgggcggtgagcaaacccgcgacgccacccagcaacgccccgccgaacaaggccggggcgccgatcaggatggccagcaggcacagcaagccacacagcggctggcgttgcaggaagatttggctgaagccgttgagcagggcttcggcccagtcggggcaggttgggttgtgcatggtggtttagtcagtgagaccgagttggccccaatcgcaggcaagccagctcccacatttgactgtgttcacacatcaaaaaatgtgggagcgggcttgcccgcgatggggcacttacagacgctaaatcaacgtctcgatacgcaacgagttggtcgaccccggctgcccgaacggcaccccggcggtaatcaccaaggtatcgccgcgctgcgccatgccctgggcctgtgcaatttccagcgccgtggaacacacctcatccacttggcgcagccgatcattgaccaccgagtgcacgccccacgccacgctcaagcgccgcgccgtggacaggttgggcgtgaggttgaggatcggcgccaccggtcgctcccgcgccgcgcgcaggctggagctgccggactcgctgtagttgaccagcaccgccaccggcaggatgctgctgatacgccggatcgcgcagctgatggcgtccgacaccgtggcatcggccttgggccggctgacgtcgagttgcgtctggtaatccgggccgttttccacctggcggatgatcttgctcatcatctgcacggcttccagcgggtactcgcccgacgcggtttccgccgacagcatcaccgcgtcggcgccttcggccacggcgttggccacgtccgtcacttcggcgcgggtcggcgccggagagaagcgcatggattcgagcatctgcgtggccaccaccaccggtttgcccaactggcggcaggtgctgatgatgtctttctggatttgcggcacgctttcggcgggcacttcaacgcccaggtcgcctctggccaccatgattgcgtcgctcagttcggcgatttcctgcaggcgttgcacggcggatggcttctcgatcttggccatcaaaaacgccttgtcgccgatcaactcgcgggcttcgcggatgtcttccgggcgctgcacgaaggacagcgccacccagtccacgcccagctccaggccgaagctcaggtcgcggcggtccttggcggtcagcgggctgagttccagcagcgcttgcggcacgttaacgcctttgcggtcggacagttcaccgccattaagcacggtggtgtcgatggcttcggcatgtttggtgatcacccgcaggcgcagcttgccgtcgtcgagcagcaggtccatgcctggctccagcgccgcgatgatttccgggtggggcaggttgacccggcactgatcgcctggcgtcgggtccaggtccaggcgcaatgcctggccgcgtaccagttgcaccttgccctcggcaaacgtgccgacgcgcagcttcggcccttgcaggtccatcaggatgcccagcgggtaattcagctggcgttccacttggcgaatccactggtaacgctgtgcatgatcggcgtggtcgccgtggctgaagttgaggcggaagatattcaccccggcttccaccagctcgcggatgtcatcgatgccgtcggtggccgggcccagggtggcgaggattttgaccttcttgtcaggcgtcatggttggcagtctcaaggatcaggatggcgcggaagtcattgacgttggtgcgcgtcggctcggtgacgatcaaaccgtcgagggcagcgaagtagccgtagccgttgttgttatccagctcatcgctggccgacaggcccagggcttcggcgcgcgcgtagctggtgggggtcatgatcgcgccggcgttgtcttccgagccgtcgatgccgtcggtgtcacccgccagggcatacacgccgggcaggcctttgaggctgtcggtgaggctcagcaggaactcggcgttgcgccctccacggccatcgccgcgcacggtgacggtggtttcaccgccggagaggatcacgcacggtgccgccagcggctggccgtgctgcacgatttggcgggcaataccggcgtgtaccttggccacgtcccgcgcttcgccttcgaggtcgccgaggatcaacgggctgaacccggcctggcggactttcaccgccaccgcttccagggattgttgcgggcgggcgatcagttggaagtggctgcgcgcgagcaccgggtcgccgggcttgacggtttccgacgccgggttctgcaaccagctgcgcaccgaggcgggcgcgtcgatgccgtagcgcttgaggatcgccagggcttgttgcgaggtgctcgggtcgccgacggtggggccggaggcgatgacggtggcctggtcgcccggcacatcggaaatcgcgtaggtgtagaccgtcgccggccaggccgccttggccagccgcccgcccttgatcgccgagaggtgcttgcgcacgcaattcatctcgccaatggttgcgccggatttgagcagggctttgttgatggtttgcttgtcggccagggtgatgccttcggcgggcagcgccagcaaggccgaaccgccaccggagagcaggaagatcacgcggtcgtcttcggtgaggttgctgatcagctccagcacacgcttggccaccgccaggcccgctgcatcgggcaccgggtgcgcggcttcgaccacttcgattttcttgcacggtgcgccgtggccgtagcgggtgacaaccaggccggtgacctcgccctgccagcagttttcgacgacaagggccatggcggcagcggctttgccggcaccgatcacgatcacccggccactgcggtcggcgggcaggtagggttcaaggacccgccgggggtgggcggcgtcgatggctgtggcaaacagctcgcgaagcaggtgttgcggatcgaccgacataagcgggctcccggggattttttgttattagagatgcagcgatcgttcccacgctccgcgtgggaatgcctcatgtgacgctctgcgtcatgctttgggacgcggagcgtcctggactgcattcccacgcggagcgtgggaacgatcagtacgatcagtggtgtttcttatttatcgcgaatcgaaaagttcgccatatgctccagccccttgatcagcgccgaatggtcccaattgccgccaccgatcgccgtgcacgtgctgaacacctgctgcgtaccggccgtgttcggcaggttgatccccagctccttggccccggccagcgccaggttcagatccttctggtgcaggttgatgcggaagcccggatcgaaggtgcccttgatcatgcgttcgccatgcacttccagaatcttcgacgaggcaaagccacccatcagtgcttcacgcaccttggccgggtcggcgccgtttttcgaggcgaacaacagcgcttcggccaccgcctggatgttcagcgcaacgatgatttggttggccactttggcggtctggccatcgccattgccgccgaccagcgtgatgtttttgcccatgctctggaacagtggcagggcgcgttcgaaggtctgcggctcgccaccgaccatgatgctcaaggtgccggccttggcgccgacttcaccaccggacaccggcgcatccaggtactgcgcgccggtctcgttgatcttcgccgcgaacgccttggtggcggtgggcgagatcgagctcatgtcgatcactaccttgttcggcgacaggccagccgcgacgccatccttgcggaacagcacgtcatcgacctgcggggtgtcgggcaccatgacgatgatgaattcggcttcctgcgccacttgctgcgggttggccaacgccacggcgccggcgtcgatcagggcttgcggggctttgccgtggtgttcggagaggaacagttggtgacctgctttctgcaggtttgccgccatgggttcgcccatgatgccggtgccgataaatccgattttagccatgatcaaaatcctctttttattagatgggcaggcctgtttcgggcctgccagacaccgaagatctactgtgggagctggcaagccagctcccacatagttctgtgttgtgtctgtcagatagcgttgtgggttttgagccaacccaatcccgcctcggtcgtggtcagcggcttgtactcacagccgacccaccctgcataaccaatgcggtccaaatgctcgaacaggaagcgatagttgatctccccggtccccggctcgttacgccccgggttatcggccagctggatgtgattgatctcacccaggtgcgccgccatggtccgggccaggtcaccttccatgatttgcatgtggtagatgtcgtattgcaggaacaggttggcgctgcccacctgctcgcgaatcgacagggcttgcgccgtgttgttcaggtagaagcccggaatgtcacgggtgttgatcatttccatgaccagcttgatgcccgcggcttgcagcttttcggcggcgtacttgaggttggcgacaaaggttttttccacggtttcgtcgtcaacgccctgcggccggatgcccgccaggcagttgacctgggtattgcccagcacctcggcgtaggcgatggccagcttgaccccggcgcggaactcctcgacgcggtccgggtggcaggccaggccgcgttcacccttggcccagtcaccggccggcaggttgaacagcacttgagtcaggccgttggcgtccagctgcgccttgatgtcggcggagctgaactcgtacgggaacaggtattccacaccctggaagcccgcatcggcggccgctttgaaacgggcgagaaagtcctgctcggtaaacagcatggacaggttggcagcaaagcgcggcatagggttctccttaatcgagcagggaaatggcagtcggcgcatcgttgccgaccagagccagatcttcgaattcgttgacggcgttgatctcggtgcccatggaaatattggtcacgcgttccagaataatctcaacaatcaccggcaccttgaattcttcgatcatttcctcggcgcggcgcaacgccggggcgatttggcctggctcgaacacacgcaaggccttgcaacccaggccttcggcgaccgcgacgtggtcgacgccatagccgttgagttccggggcgttgaggttgtcgaaagacagctgcacgcagtagtccatttcaaacccgcgctgggcctggcggatcaaaccgaggtaggagttgttcaccaccacatggatatagggcagcttgaactgcgcgcccacagccagctcttcgatcatgaactggaagtcatagtcacccgacagcgcgacgaccttgcggctcgggtcggccttgaccacgccgagtgctgctggaatggtccagccgagtgggccggcctggccgcagttgatccagtgacgcggcttgtacacatgcaggaactgcgcgccggcaatctgcgacaggccgatggtgctgacgtagcaagtgtctttgccgaacacctggttcatctcttcgtacacccgttgcggcttgaccggcacgttgtcgaagtgggtcttgcggtgcagggtggccttgcgctgctggcagtcattgagccaggcgctgcggtccttgagcttgccggcggctttccactcgcgggctacctcaatgaacattgtcagtgcggaaccggcgtcggacacgatgcccaggtcaggggtgaacacgcggccaatctgcgtcggttcgatgtcgacgtgaatgaatttgcgcccctcggtgtacacctccaccgagccggtgtggcggttggcccagcggttgccgatgcccagcaccacgtccgatttcagcatcgtcgcgttgccataacggtgcgaggtttgcaggccgaccatgccgaccatttgcgggtgatcgtccgggatcgtgccccagcccatcagggtcgggatcaccggaatgccggtgagttcggcaaattcaaccagcagttcgctggcatcggcgttgatcacgccgccaccactgaccagcagtgggcgttcagcttggtcgagcagagccagggctttctccacctgaatgcgcgtggccaaaggcttggccagaggcagcggctggtaggcgtcgatgtcgaactcgatctcggccatctgcacgtcgaacggcaggtcgatcagcactgggcccgggcggccggagcgcatttcgtagaaggctttctggaacgcgtacggcacttggccgggttcgagcacggtggtcgcccacttggtcaccggcttgacgatgctggtgatgtcgacggcctggaagtcttccttgtgcatccgtgcacgtggagcctggccggtgatgcagagtatcgggatcgagtcggccgaggcgctgtacaggccggtgaccatgtcggtgcccgccgggcccgacgtgccgatgcacacgccgatattgccggccttggtgcgggtgtaaccctctgccatgtgcgaggcgccttcaacgtggcgagcaaggacgtgatcgatgccaccgaccttctgcaaggccgaatacagcgggttgatggcggcgcctgggatgccgaaggcggtgtccacaccttcacggcgcatcaccaggacggcggcttcgattgctctcattttgctcatggttttggtgcctcttgcgttttttaattgtatacaagtggtgtctgttcaaagtgtattcacggcgagcggcgcaggtcaatgcattttataaactggcgtttgcgttcgtctgaatggcttttttcgacgtatggagcctttgtgcgaaaatattgtatacaaaaacaatattcattgtgttctatttgtttgatcgagcttctgatccttcagacctcaacggctttacccataacaagataaggacggcacctatgagcgctttaaccttgaaactcgccacccaactggccagccaggccctcaccgcaggccgcacgatttcagccgcgccgctgaccattgcagtgctcgacggcggcggccacttggtcaccctgcaacgcgaagacggcgccagcctgctacgcccgcaaatcgccatcggcaaggcctggggcgcgattgccctgggcaagggctcgcgtttactggcgctcgacgcccagcagcgcccagcgtttatcgccgccttgaacagcctggggcagggcagcgtggtgccggcgccgggcggggtgttgattcgggatcagcaaggcctggtgctgggcgcgatcgggatcagtggggatacatcggatattgatgagcagtgtgcgattacggcgattgaggcggtggggttgttggcggatgcgggggtgtctgcttgatttgaggtgacagatagatcgccatcgcgggcaagcccgctcccacacaggaacgcattccaacctgtgggagcgggcttgcccgcgatggcggcgactcggtctagagtcaaagccaaatggcatcccacaggggataatcgccaaacttcttaaccaggcccgctctcagcgggttggccacaatgtagcgggctattccttccaggctttcctctcggcgcacggcatgatcgtgaaatccaggttgccaaaggcggccatggcgaccggcaacaccattaatgattcgagtacttttggattttacctggcgcatcagatcgctaaggcagcctttgtccaatgagatcagccagtggaaatggtctggcatgaccacccaggccaaagatgtcgccaggccttgagcctgggcaattctgaattgttgaactaccagtcgacctaacctgaaatcctggaagatgggggtgcgatcaagggtgttggtggtgagtaggtaaatgcggttggattcgctgtagcgacctatgcgcagttgttttgatgcggggagttcaggcattccatggcctctcttcagttggggttctgagaggctaggcctggactggggagtctgatgagcgggcttttggcaggatgtgtctgggagggcgctatcgcgggcaagcccgctcccacaggggactagcggtgttcatacaatttgtgtgcgacccaggccagtgtgggagctggcttgcctgcgatggccacaccaccgtccatcaatccggctcacaccccttcaacaccaaccgaataatcgtctgcgccgccgcttcataatccgcctcatccagcttggctttgccggttaccgccgatatctgccaatcaaaatccgcatacgtctgcgttgcagcccagatgctgaacatcaggtgattggggtcgatggcggcgatcaggccgcggtccacccagctctggatgcagtcgatgttgtgcttggcctgggcgttgagctgctcgatttgctcggggctcaggtgcggggcgccgtgcatgatttcgctggcgaacaccttggaggcaaatggcaggtcgcgggagatgcggattttcgagcggatgtaattgctcagcaccaccgacggctcgccctcggggttgaatggcgtggaggcggccaggatcggctcgataatgctttcgagcacctcgcggtagaggttgtccttggacttgaagtagtagtaaacgttgggcttgggcagcccggccttggcggcgatgtcgctggttttggtcgcggcgaagcccttgtcggcaaactcctcgctggccgcccgcaggatcttttctttgttgcgctcgcgaatggtgctcataaaccaagagtttccttgccaagacaggcggtcgagcatggtagcaccggcttgacgcagggctcaataataccggcccagcccttgcacgccgggcgtttgagctgactttgtctgtcttgatgctgaacgcattcacggtagtacaggcacaggcaaggcgcgctgctagagttcaaagcaacgacgcggctgttttggccggcgttcagtcctgtagtcggcgttcgagtgagaaaccgtggagaaaagcagacgacgtacgttcgcctgggtggttggcgcgttgttggtaatagcgttgttgattggcctgggcctgcacttttttggcggcacccacaaaggccggccagcgtcgcccggcgagccggtggccgtggtgccggtgattttgcaggatgtgccggtgtacatcgacgccctcggcaccgtgacgcccacccgcagcgtgacggtggtgacgcaggtcaatggcatcctcagcagcgtggaattcaaggaaggccagcacgtcagcaaaggccaggtcatcgcccgtatcgatgaccgcgcgctcaaagcgcagctggccgtcgccaagggcacactggcgcatgatcaagccgtattgagcaacgcccagcgtgacctcgcgcgttaccgcgacctggtcaaggccgggtcgaccagccagcaaaccctcgacacccaggcctcgctggtgcagcaacaacaaggcaccgtcgccgccgatcaaggcaatgtgcaaaacctcgaagtgcaactgagctattgcaccatcacctcgccggtggatggcgtggtcggcctgcgcctggtcgaccccggcaactacgtgaccaccgccagcaccaccggcatcgtggtgatcacccagatgaaccccgccaccgtggtgttcgccgtgcctgaagatgacctgggggcaatcaaccaggccatgtcccatggccgcgtcacggtgttggcctacgaccgcaacaagaaatccctgcttgccaccggcgcgctgctggcgctggacaacgaggtggataccagcaccggcacgatcaaggtcaaggcgcagttcgatgattcgggcaatgcgctgtttcccaaccagttcgtcaatgcgcggctcaaggccgacaccttgagccagattgccgtggtgccgacccgcgcgatccagcacggcagcaagggcgacttcgtgtttgtggtcaacggcaacaaggccagcctgcgcaccatcaagaccgctgcgtcgaccggggacgttaccgcagtgctcgacaacggggtcaaggcgggtgagcaggtgatcaccgaaggcgccgacaaactggacgatggttcgtcggtgaaggtcgtcgcccagtgaggagctgccgaggatgaatatttcgcggccctttatcgaacgctcggtggccaccacgctgatgatggtcgcggtgctattgctcggcctgttgggttaccacttgctgtcggtgtcggcgctgccggaggtggattacccgaccatccaggtgttcacccagtaccccggcgccagcccggatgtggtcagctcttcgatcaccgcgccgctggaacgccagctcggcgagatgcccggcctcaagtcgatgaactcgaccagctccgacggcgcctcggtggtgaccctgcaattcgatttgtcgctgtcgctggacgtggccgaacaggaagtgcaggccgcgatcaacgcggcgggcacgttcttgccggccaacctgccgtacccgccggtgtacagcaaggtcaacccggcggacgcgccggtgctgaccttgtcgctgacctccgacgtgctgccgctgaccaaggtcgaagacctcgccgacacgcgcttggcgcagaaaatctcgcagattaccggtgtcggcctggtcaccatcagcggcggccagcgcccggcggtgcgggtcgaggccaacacctcggcactcaacagcctcggcctgtccctggatgacctgcgcacctcgctcggtacagccaacgtcaaccaggccaagggcaatatcgatggcaagttccaggcctattccatcggcgccaacgaccagttgcaatcggccgaggaataccgcgacctggtgatcgcctacaaaaacggcgcgccgattcgcttgtcgcagatcgccagttccacccaaggcccggaaaacccgcgccaggccgcgtggaccaacgacacgccgtccatcgtgctgaatatccagcgtcagcccggcgccaacgtgatcgaagtggttgaccgcgtgcagcaactgctgcccaagctgcgcgccagcctgccgggcaccttgaaggtcgcggtgttgactgaccgcacccagaccatccgcgcctcggtgacggatgtgcagtacgaattggggctggcgattctgctggtggtgatcgtgattttcgccttcctgcgcaacattcccgccacgatcatccccgccgtgaccatcccgctgacgctgatcggcaccctggcagtggcctacgcgctgggcttttccctgaataacctgacactgatggcgttgaccatcgccatcggttttgtggtcgatgacgccatcgtcatgatcgaaaacatcacgcgctacctggaggccggcgacacgccgttgcaggccgcgctcaagggcgcggagcagatcggcttcaccatcatctcgctgtccatcgcgctgattgcggtgatgatcccgctgctgttcatgggtgatgtggtcgggcggctgttccgtgaattcgccatgaccgtggcggtgaccatcgtgatttcggcggtgatttccctgacgctgacgccgatgatgtgcgcgcgcatgctcaagtccaaacatgaggagcgccgcgcggacttcttcgaccgtatcaaccgccattacgtacgcggcctggattgggtgttggcgcaccgtaccttgaccctgatttcggtggtgctcaccgccgcgctgaccttgttcactctggtgatcatgcccaagggctttttccccgatcaggacaccggcctgatccagggcatttcccaggcctcgccgaccatctcgtttcagcagatgcaggtcgagcagcaacgcctggccgcgcggattctcaaggacccggcggtgcaaagcctgtcgtcgttcgttggcattgaccagaccaacccgaccatcaaccagggcaatttgctgatcaacctcaagccacgcggcgagcgtgacagcagcaccgaagtgatccgtcgcctggccgacgcgaatgccgacgacgccggcatccgcctgtacctgcactcggtgcaggacctgaccctggacgccacggtgtccaccaccagctaccgcctgggcctgcaagccaccgacccggatgagctggagcagtggaccaccaagctgctcaccgcgatcaagcaagacccgatgttcaccgacgtgcaaagccaggccatgcagttcggcaaccagatcaagctgaccttcgaccgcgccaccgcttcgcgcctggggattacgccgcaggccatcgacgatgtgctctacgacgccttcggccagcgccaggtctcgaccatttacacccagctcaaccagtaccacgtggtgatcgccaccgaccacccgccgcgcaatttgccggacttgctcaccggtttgtacgtggacattcccggtggcggcgtggcgccgctgtcgagcatggcgaccatggaagtggtgcgctcgccggtcaccatcaaccgcctggggcagtttccctatgcggacgtgtcgttcaacctcgcccccggccaaacattgggcgcggcggtgacgcgcttgcaagacattgaagccaaggtcggcctgccgttgtcggtgcaggccaacctcgaaggcgcggcggcgacgttccaggcgtcgctgttcaaccaggtgttcctggtgttggcggcgattgtggtggtgtacctgatgctggggattttgtacgagagtttcgtgcacccggtgacgattctgtcgacgctgctgtcggcagccctcggcgccttgctggcgttgctggtgacgggcacgcagttcgacatcatcggcttgatcggcattgtgttgctgatcggcatcgtcatgaaaaacggcatcatgatggtcgacttcgccctggagctgctgcgcgaaggcggcttgagcccggtggaggcgattcgccaggcggcggagctgcgctttcggccgattctgatgaccagcatggcctcgctgttcggtgcggtgccgttggcgctgggcaccggcattggctcggagctgcgccacccgctgggcattgcgatcattggcgggttgctgctcagccaattgctcacgctgttttccacgccggtgatcttcctcgccatgcacggcttgggcgagcgtttcagccgtcgctcggtggcggtggaatgatgcgatgaacctcagcgcaccgtttattcatcgcccgattgccaccacgctgctggcggccgggctggccttgtttggcgtgttggcgttcaacctgttgccggtggcgccgctgccggaagtggacttcccgaccatcagcgtcagcgcctcgttgcccggcgccgacccgaccactgtcgcaagttctgtggcgacgccgctggagcgccagttcgggcagatcgccggggtcacgcaaatgacctccgccagcagcctcggctcgacgcgcatcaccatgcagttcgacctcagccgtgacatcgacggcgcggcgcgggatgtgcaggcggcgatcaacgccgcgcgcagcaacttgcccagcgacttgtccggcaacccgacctaccgcaaggtcaacccggccgactcgccgatcctgatcatcagcctgacctccgacagcgccacgccggggcagatgtacgacgcggcctcgacggtgcttgagcagcgcctgctgcaaaccaccggcgtcggcgacgtgacggtgggcggcggcgcgttgccggcggtgcgcatcgagcttaacccggaccggctgaacaggtacggcgtgagcctggagcaggtgcgccaggtcatcggcgcgtccaacgccaacctgcccaagggcaatgtggcggtgggcgatcgctcgtatggcatcggcgccaacgaccagttgctcgacagcaatgattacgggccgctggtggtcaaggccagtaacggcgacctgattcacattgccgacctcggttacgtgcgcgaagacgtgcaggacctgcgcaactttggcctgtccaacggcaagcccgcagtgctgctggtggtgttcaagcagccgggcgccaatgtgatcgacacggtggacgcggtgaaagcctcgctgccgtttctgcaaagctcgatcccggcgtcgatcaaactcaacctgctgatggaccgcaccaccaccattcgcgcatcgctgcatgacgtggaagtgaccttgctggcctcgatcctgctggtgacgctggtgaccttcggcttcttccgtgactggcgcagcaccctggtgccggccgtggtggtgccgttgtcgttgcttggcacctttggcgcgatgtacttcctcggctacagcctgaataacctgtcgctgatggcgctgaccatttccaccgggttcgtggtcgacgacgccatcgtggtggtggaaaacatcatgcgccacctggagcgcggcaagacgcgggtggaggcggcgctggccggggcgcaggaagtcggcttcaccgtactgaccatcagcgtgtcgctggtggcggtgtttattccgttgctgttgatgggcgggattgtcgggcggttgtttcgcgaattttcggtgtcgctgtcggtggccattgtgatctcgatggtgatctcattgaccgtgacgccaatgctcgccagcgtgttgctgcgcgcgccgaaggacatccgcgcaggcaacgagcacccggattcacgctttcatcgcttttacgaccgtacgctgggctgggtgatcgatcactcgatcctgatgggcctggtgacggtgctggtgatcgtgctcgcgggcgtgctgtacgtgctggtgcccaagggcttctttccccaggaagacaccgggcgcctgcagggcagcatcatcgcggcgcagagtatttcctacggggcgatgcaaaacgacttcaccgcgatcaaccacaaggtcatgcaaaaccccaatgtggaaaccgctgcggggtttgtcggcggcggtggcgggggcggcggggcggtcaacagcgcgcagctgtttgtgctgctcaagccgattgatcagcgcaaggacagtgccgtcgacgtgatcggccagatccgccgcagcctcggcgacttgcctggcaccaagctgtttttgcaggcagcccaggacatcaccgtgggtggccgccaaagcggagcgcagtaccaatacaccttgaccgccgacgaccagcaatccctggatgagtgggtgcccaaggtggttgaagtgctgcacaagctgccgcaactcaccgacctgaacaccgaccagcaggacaacagcctgctggccaatgtgcacattaaccgcgacaccgccgcgcggctcggcgtgggcatgtcggcggtggaccagacgctgtacgacgcgttcggccagcgccaggtctcgaccctttaccgcgccgccaaccagtaccacgtggtgatggaaatcgccccggagtactggactgatccttcagcgctcaaaggcatttatgtgccgaccggcaacgcgtcagtggcggccaaaggcaccaccgctgcgccgaacctgaccaccccaacgacgttggtgccgctgtccgcactggcggataacagcctctcgcgcacggcgatttccatcagccaccaaggcactttcccggcggtaacggtatcgttcaacctggcgcccggcacttcgatcggccaggccaccgcgctggtggaggacgcggtcaagcagttgcgcatgcccgccagcgtcaccggccagtttgccggtacggcccaggtgttccagtcgtcggtggccagtgagccgctgttgatcgtggctgcgctgctctcggtgtacatcgtgctgggcattctttacgagaacctgatgcacccgctgaccatcctttccactttgccttcggcaggcgttggcgcgctgatcgccttgttgctgaccggcaccgagttgtcgatcatcgcgctggtgggcgtgattttgctgatcggcatcgtcaagaagaacgcgatcatgatgatcgacttcgcgatcaccgagcggcgtgagttcggccttacggccaaggaagcgatacgccgcgcgtgcctgatccgcttccggccgatcatgatgacgacgctggcggcgattctcggcgcgctgccgctggtactcggctcaggctatggctcggaactgcgccggccgttggggattgcaattattggtgggctgttgctcagccaagtgctgacgctttacaccaccccggtgatttacctctggctcgaccgggcgtcgcaacgcctggggcggcacaaggaagcaaggtcatgaaactcagatatagcgtgctgttggccagcctgatgctggggggttgcatggtcgggccggactaccagaaaccggcgatggagctgccgcaatcgttcaaggaaggcgcacagtggcagcgtgcggtctccaatcctcaaggggcgttggacagccagtggtggctggcctaccaagacccggtgctgaatgacttggtggcgcgctcggccaaggccaaccagtcgatcattgcggccgaggcggcgtatcggttggcccaggcgcaggtggcgtcgagccgcgccgggttgtggccgacggtgggcgtaggcttgtccggttcgcgcggcgagggcggtgacggcagcacgtccagcaccaccacggcatcgagcggcgtgaagaacagtgtcagcgcgacgttgaccgccagttgggagccggacttgtggggcgaggtgcgccggggtatcgaatccagccaggccacggcccagcaatccgatgcgttactggccggggtgcggttgtcgatcagctccagcgtggcgagcaattacctggcgttgcggcagatggatatcgacgtgcgcctgttgcaacagcaacagcgcatcaatcagcaattgctcgacatgatccaggcgcagttcacccaaggcgtggcgaccaatgaccagttgctggtggcccaggaccaactgaccacctcgattgccgacctgcagacgtcgctgcgtaatcgtgagcaatacgaacatgccttggcggtattggtgggcgtggcgccgagcgagttcagcattgcgccacgcactgattttgccttcgtggtgccgcggccaccgctgaccctggcgtcgaccttgctgcaacgtcggcccgatgtggtcgcggctgaacgctcggcggcggcggccaacgccaagatcggcgtggctgaggcggcgtttttcccgaccctcgatctcacggcccaactgggttatcgcggcagtgccttgggtgggttgttttcgttgcctaaccgcatctggaccctggggccggccttggcggagacgatttttgacggcggtgcgcgggaggcggcggtcaaacaggctgaggcgagttatgaccagattgccgccaactaccggggcacggtgttgagtgccttgcagaatgtcgaggacaacttgtcggcgatcaatcacctgcaaacccaggcggatgcgtttcagcaggtctatgcgcgcaatcagcaactgtttggcagccaggaagcgcagttgcgtgcgggcactgtcagccgggagacggtgctgactcagcaactggtgttactgcaagccgagcagaacctgcgcgacacgcagggccaactcagccagggcagtgtcgcgctgattcagagcctggggggtggttggcagccttgacacaccggtgtcccactgtgggagctggcttgcctgcgatagcggcctccgagccgcccagtatcttgctgacccaaaacaattgaactgtgggagcgggcttgctcgcgaaggctatatttcagttggctgggatattgattcggagtacatatccattcctgcggtaacggccacctatggttccgctcttacagcggctcactttttgagggaccaaaaagtaagcaaaaagtcctcgccccaccactcggcacctcgcccaggctcggtgtgcccgcactccggcttgaatccgtgggccgccgcgatgggccatccttggcccagcgcggctaacccggcgtcctgccgggttacccacggactcaagcctgcgttcggccagcgtggttgacggggcgactcagatcaagatcaagatcaagatcaaaagccagatcaacagccagatcaacagcaatcctccgcgcagtagcgccctatattccctcaggttctccgcgttatattcgcggcactctaatcgcaggatgaatccaccatggcaggaagcagcttactggtactgatcgacgacatcgccgccgtcctcgacgatgtggcgttgatgaccaaaatggcggccaagaagactgccggggtgcttggggatgacttggcgctgaatgcccagcaggtctccggggtgcgggccgagcgggagattccggtggtgtgggcggtggccaaggggtcgtttctgaataaattgatcctggtgcctgcggcgttgctgatcagcgcgtttgcgccgtgggcggtcacgccgttgttgatgctgggcggggcttatctgtgttttgaaggctttgagaagctcgcgcatagctttctgcacaagcgcactgaggaacaggcgcacttggtcgaagcggtggcggacccggcgactgacttggttgcgtttgagaaggacaagatcaagggtgcgatccgtaccgactttattctgtcggcagaaatcatcgccatcaccctcggcacggtcgccgatgcgccgctgatgcagcaggtgatcgtgctgtcgggcatcgcgatagtgatgaccatcggcgtttacgggctggtcgccggtatcgtcaagctggatgacctgggcctgtggctgacgcaaaagcccggccgggctgcgcgcagcattggcggggcgatccttcgcgctgcgccgtacatgatgaaaagcctgtcggtgatcggcacggcggcgatgttcatggtcggcggtggcatcctcacccatggcgtgccggtggtgcatcactggatcgaaacagtgagtcaaagcgtcggcgccatagcgtggttgatgccgacgctgctcaatgcggtggccgggattgttgccggggcactggtcctggcgattgtgactggggtgggcaaagcctggtcgggaatcaccgccaagccatagacgagtagggcgttgggcgctccttagttaagttttctggtcgtgaactgccaggcttttaccgagatcagtgccagcagcgctccacacgcgccactcaacagacctagtttcaggcgggcccaagggctgaaatggcaggcctcttgaggcgtgccggtcggcgcgatgcacacttcagggaacatcatctgccaggcctgaggccagccaatgatcaacatgaaccctatggcgaacagcacgcatacctggctgcgggaggtgtttttgaatgccgtgtggaggacgaatagaaacaggaccaggcaaaacgataacagcgccggggtcagcatttcttcgtagaaaacctgctcaagtaattgtgagtaagggtccatgtcatctctccgggaacgcagggtgacgccgttggtggctgggcggagcacgcagattgcgctttggttgctgacctgcaataggcgacgttgccttaaagggttgtaggggggttccgtagttggaagattggcattcgctgagaatatagatacgaagtgagtaaaatcagcgccataaaaaaggccattcaatcgaatggccttttttgtgatgctttagttactcggcaatctgcaacttgcgcgattcggtatagatataccgcaccttctcatactcaaacggcgagttcatctggccgtagcgaaagctggtctggtagcgcttgtcgacagcgcgcagggcccagatttccgggtggttttcgctgactttggacacgttgaggaagttgatctcggtttccgcgccgtagtcgacgatcaggccggtggtgtcgcgcaggttcgacgggccgaagatcggcagtaccaggtaggcgccgccgggcacgccgtagaagcccagggtctggccgaagtcttcgctctggcgtggcaggcccatggcggtggccgggtcccacaggccggcgatgccgatggtggtgttgagcagcaggcgcccggtggtttccagggagcggtggcccttgagttgcagcaggctgttcaacaggttgggcacgtcgcccaggttgttgaagaagttgctcacgccggtgcgcaggaagctcggcgtcacgtagcggtaaccgtcaaccacgggcaggaacacccattggtcgaagcggtagttgaagtgatacacgcggcggttccaggattccagcgggtcatacacgttgagcgcagtcagcgatgaacgctcgaactcacgctggtccaggcccgggttgaacttgagcttggtcagcggttccttgaaaccatcggaatctattttgaccggctcatgcgccttgctgttgtcggcattggcgacgcccgcgcacatcagggcggcgagcagcagaagatatttagccacggaagaactccagcatggcgtcggcgttgacgcggtaattgaggttgccgcagtggccgcccagcgggtagacggtcaagcgatcgccgaaggttttacgcaggaaaccgaggtcgccagggccgaggatcacgtcgtcagcgttgtgcatcaccgcgattttcgggctggtgtgcaggtagtctttgagcgcgtacaagctgacctggtcgaccagttgcagcaggctgccgccgtcggaacgcgcgcgccacatcgggatcacttgttcggtgaggtagcagtcgaagtcgcattgcagtgcacgcttgaggaacggcgtgaggctggtgccttcggtgatcgggtatttaggcgggatgatcaggccgcgacggttgatcaggtccgaggtgaacgcaatgtcggccgccgagaagcggaacgaagtgccgatcagcatcgccatctgttcattggtcaggtgctgcttggagttctggaagtcgtagagcagggcgtcgttgaggtcgatgtagcccttttgctggaagtagcgggtcagcttgctcagcaccagttcatagaaagtggtggtgttgttgatgcccttgacctcggtctgcaccagcttgtcgaggttggtgatcgaggtatagaggttgaccggcgggttgagcagcagcactttcttgaagttgaagctgcgacgggtctcgtcgagcttgctcacaaatgccgcatccagggcgccgaggctgtagccagtgaggtaaaagtcggtcaccggcagcgaggcgttctgcgcgcgcacggcctgcatgacgcggtacatgtcctcggcatcttcctgggtgatcccaggcgttgcgaagcgcgaggcggcgctgatgaagtcgaagctggttggcgacgacagttgcaccacgtggtagccggcctggtaatagagctttttcaggtactcgttgatgctgctgtcaaaccgcgcaccggtgccggcgatcaggaagatcagcggtgcggcgtggtcttgcttggcgatgcggtaagtgagtttcttcacggcccagaagttgtcgggcaggctgaattcgcgctcggggcgcatgttcagggtgtagtcggactggttgatctcgtcgtcggtcggcaatttgggccgaaggtcaggcggagtggtggcgatggtcgcttcgaacgggttggtcaaagggtagccatacgtggcctggtcgatatcgacggccagtgctgacgcactcaaaaataggctgcccagcaaggcagcacagcgcaaggaacggagcatgacttaatccctaagaggaaacgtgctgatagattcgcaggctatgaccaccgctccatcaccgaagtgccagcattcggcacgaaaagtcggaaaaagaagtcggaatcggggtaatagtagccagaagatacactttgcgacgcttggatgaacagttatatgcgtacacgccttgctaacggcagccggggcattaagctgagcgccgtttttgcctatcggagtgccttatgtcccgccgcttgccgttgattcttctgcttattgccctgccgttatggctggccgccagttatggcgcccgctacggttttatggaggacggccgctgggtgggaatctgcgtcgatgaggccagccgctgggaatgccagctgcgctcgaacctggggctgatgattcatttcaaggtgctgggctgggcggcgttggttacgtcggtgctggggttttttgtgccgggccgcgcggggtggggcttggcggtgttggggatggtgtttgggttaccggcattggcgctgtacaacaccacatttgcggtgtttgcggtggtgattgcgggattgcggttggtcaggaagccgcgggttactgattaacccgcgtaggtcgcttttgtggcgagggggggtgctcccccttgggggggcagcgctccccagccttttttgggccctccccccccccaccgggggaagccccccccctccccggggcccggcacccccagagggggggcaattcctgcgccagcccccgaaaaacggccgggcagcgcgcgcgcttttctcccctctgggagggcaaaaacaccccc

SEQ ID NO: 69 - DNA, 44135 bp, Pseudomonas poae FL10F
gtgtactgctgtgggggcactgtcatctctggaacagcagcttggaaaaaagccatcaagacagttgctcccacatttctttcactgtgtttaatcagtcagtgagggtacgcacgccaggcttggcgcgctcatccaccaccaactcaaaaatatccggccgcgcgtaatgccccaccacgtcatagtcataacgtgcgcgcaccaaatcatcggtgttgatctgcgccgtcaacagccccgcctcgccgcgcaacggccctgccagaacatcgcccatcggcccgacgatcacgctgccgccggcgatcaaagggcggtctgacggccagttggccacctgcacgcccagcgcctgcggcgatgcctgcacctggcaggcactgaccacgaagcagcggccctcatgggcgatatggcgcatgctcacctgccacatttcacgttcatccacggtgggcgcgcaccagacctccacgcctttggcgtacatcgccgtgcgcagcaacggcatcatgttttcccagcacaccgcgccccccacgcggccgaccgcggcgttgatcaccggcaaggtcgagccatcgccggtgccccagatcagccgttcggtgccggtgggcatcaacttgcggtgcttggccaccaggccgcccgacggctcgaaatacagcacggtgcagtacaaggtgctgccactgcgctcaatcacaccgatcaccagactggcaccggtacgcgccgacaacccggccagcgcctcggtctcgaccccaggcacatcgatggcgttggcaaaatactgcgcaaaggcttcgcggccttccggcaggcgatagcccaattgcgtgccgaagccctcgcccttggggtagccacccagtaatgcctcgggcattaccaccagttgcgcaccactgcgcagtatctcgtactcatacgtcaggatttgcgccagggtgtcggccttgccacctggcagcgaaccgatttgcaaagcagccacagttgaaacaggcatcacactcactccgaatgttggggttgcccattctccggcgagcagcaatcatgaataaagcccacctcagtgctaaatgatatgagccaaatgaatatcgcccaggttgatttgaacctgctgaaaaccttcgaagccctgcatgacgagtccagcgccagccgcgcggcgttgcgcctgggcgtcacccaatcggcgatcagcgcgggcttgcggcgattgcgcgagctgtatggcgatcaattgtttgtgcgtaccgggcgtggcttggcgccaaccttgcgcgccaaccagttgaagccggtgatcagcgaggcgctggaccgttgccgccagagcctggcgatgatcaacccggataacccgcactatcaggggcgctcggtggtgctgggtttgtccgatgatttcgagattgcccatggccgtcggctgatcgaggagattgcacggcgcgcgccgaagctgcgcgtgatcttccgccagacccacagccagatcgtcgccgcggccctgctcgaccgcagccttgacctggccataacggccgggggttttgccgagcgcaggctgagccgacaagtgctgggcgaaggtgactaccgctgcctggtcgacccgcacagcctggcgccaggccagcacggcatcagcctgtcggaattcgtcacacgcgagcatgtgctggtgtcatcgggcgggtttatcgggattaccgatgaaggcttggcggcgcaagggttgagccgccaggtgtgcgcgtcgaccagccactttgccgcgctgccgtttttgctcaagggcagcgcggcggtggcgacgattcccgggcatgccgccgaggcgattgcgcagatgaccggcttgcgtgtgctgccctgcccgctggcgctgccacgctacccggtggaactgggttggcgcacccaggcgcagctggatccgctgttgctgaaagtacgcgaggcgattgtggcgtgctttatttcgccgccgccatcagcttgttgacttcgctgcgcaccatgttggaaaactccggcggcgacatgccgtctagctcggcgcgcacccactcggcccacttgcctttgcgcttggcgcgctcgccgaacaagcgtgccgcttcgccttttgccttgcccaggttggtttgccacaggtcgtagaggcgggacttttcatcttccagctcggcgcgttcggcgagggttttgttggccagattgaagctcatgttgaattacctgctgcacaaataggtgacatcttacactgtaggtcgaaatatcctgattcggattttgcccccaaacagctcgcggcaaaaaatctgcaacttttgccgtcgcccgacactccattgttcactgtcacattcactcgcaaggagtcacacaatggcccgcaaaaccgctgcccaagctgtcgaagaccaaatcaaggatcaagccttcagtgaactgacggcgctgatcgaagaatcggacaaactgctcaagagcagcgcctccctggtaggcgaagaaggcgaaaccttgcgcgagcaggtcgccatcaagctcaagcaggcgctggaatcggtgtccaacgtgcgtgaacgcagtaagccggtggtcgatgccaccgagacctacatcggtggccacccgtggcagaccgtagcgatttccgcaggctttggcctggtggttggcctgttgctgggccgtcgcaactaaacctctgaacaccatgcctctggggctgcgccgccggcgcagccccttttagccttcggcgagtgcctgcaactgctgaaggtcctgcacgtcaatctcgatccctgtttcctgcgacttcgcccgtgtgcgatggcgccgatcccccggcaaccgccgtaaacccgccgcatgcatctgccgcaccagttcctggctgcgctcggcgaagtgttgcccggcggttttgctcgggtcgatcagtatcaccaactgcccggtccacggcgtgcgggcgccggggtgatccgaccagttgaattcaaacgagaagttcccacccgtcagggcggccgcgagcaattcgaccatcatcgataacgccgagcccttgtgcccgccaaacggcagcagcgccccgccctcaaggatggccttggggtcctgggtcggctggcccaggctgtcgacgcccatgcccggcggcaagcgctcgcccttgcgcgcggcaatttgtacgtcgccatgggcgatggcgctggtggccaggtcaaacacaatcggcgcgccatcggcccgtggcgcggcaaacgcgatcgggttggtgccgaacagcggccggtcggcgccatggggcaccacgcaggtcatgctgttgaccacgctcagcgccaccaggccttcttcggcgaacggttcgacatccggccacaacgcggcgaaatggtgggagttgtgaatggccagcagcgctatcccggcactgcgggctttttccaccagcagcgcacgcgcagctgccaatgctggttgggcgaagccgttgcaggcgtcaacgcgcacaaaacctgaggccacatccgtgaccaccggcagggccttgccgtcgacccagccactggccagggtgctgaggtaaccggggatgcgaaagatgccatggctatgggcgccatcacgttcggcgctggcgcaattgtgcgccaggatggcggccacctcgggcgaggtgccgtgccggacgaatatctgttgtagcaaggccaccagctcagtaagaccgatggaggttgaagccgtagccagtgtcggagactgcgcagacatttgaagctccgtttttatgattggagggcgcaacgaatgaacatacaggcctcgataaaacaccacgcacggcgcctgctgtcaacttgcgcaggggctgattatttaccccggcctgccaatcacgcgtacttaccctgtcgtcttccgagcacactggagactgatcatggtccgcgtcaccccgccgtactttttcgacgaattcctgcagcccatcagtcgaaaaacccccagcgaccgcgagcgcgcattggggctcaccaccaaagaccttgattggctgcataacctttactacgccagcgatgccgctcgccaggatacccagctgcgcggccatccgatgcgcgtcgagaaactgctgatcagagtctcaggtcaaccggcgacgcccatcgccggtgcatttgtgatgagccccagcccggacggtggcaaggccctgctgtacaccccgtatggcggcattcaggttgctgacgatcatgcctcgctgctcaccgaggtgggcgagcagttggtggacccggtgcagcgcgtcgaatggctgagcttcctgtcgattgcccagcgcaacgcgttgcctgtcggcaccaccatcatgttgaccactgcaacgatcgaaggctcggtgcaagtggaccaggagcagacgctgcaggcctgccagcatgccaacgtgcaggcgatgctggcgcacctgcaaaaaatcccgaccttgcccggcatgctcgatacgctgctcggcatcatggcgcgcgctgacttcccagggctggatcaacgccatacgcaggtgaactgttttgtgcaaatgccggggggcggcggtcgacgctgggtcggctcccaaccgttaagcgaagcgctgctgcaattttatgtacgacatgcctggcccaaagcgcaaacccgcgagttcattaacccccggcatgtcaccagcgccttcacccagccccaactggaacaggatcagcagcattgggaaacgctggtcgaacagacctccagcatcttgtcaaagctgctggacagcctgctgcagacttactggaacgaggacaccggcagcggcacctcgcgcctggattttttcgcgcaggtcatggctgacaagtttcgtctggatatcttgctcaagcgccaacaagaaaccctcactgccgaccaaagccacacgctccaggcactgttcctcagcgaccagaccgcgcgcagccactacgccagccgcctgagcgtggagaaagtgcggctttacgcgccgtatcagcactatgtggagctggccggcacgctgatgctcagcgaaacacacgcttacctctacacgcaatcgcgtggattgcaggtgctcgaaaacctggatgatctgaaagacaccttgttgagcatgctcaaggccgcagggcacgaagatgagttgctcaacgtgctctccctggatgaacgcaacacgtttatgagcctggaccagataaccatcgcggccggccccgtcacgggcggcgtgttcaccggcatggtcgaagacatagcactcaagcagatcagcaatatgaaccacgcactggaactttaccggcgcagcgatggcctggtagacctggctgcgctgctcgattacgccctggatatacgcacgatgctggacgatcgcctggcaccgctggacaccgccgggcgttggacggttcatccggtcaccagcggtaacagccgcccctctaaggtaaaagccgagcgcgccaagctgcaccttcaacgcctgatagcggccgaggaggcgctggccatcgagcgcaaacagcatccgaccttgcgcagcatggtcaaccttgccctggacgcgcagttgcaggcacagcaattggaggtgaaggccgatgaggtctacatcaacacctacgaaaccccagcccaggaacgtgaagagcgcccgcctgtgtcgtcgttgagcatggtcgagcacttcatcgaacgcttgagccttgaagccgcaccgattgccggcgccgacaccaccggcttttacaaaaagctcgacccgcgtgtggcccagcagttgcacagcatgaccctgagcactttcaacgacgtgattgaccgagtgttgaaggtgtttgctgacaacgatatgcatagcctcccacgcctgtttttgggcaacgttcgtgacaagcatgcccactcaatgcgccttgggttgcaaagcgaggccgaaatgcgggtattgggtaaaaccatgaccgcccgcagccaggcggtgcttgatacggtgttgcggccggacagcttgttgcgcttgacccgtcacggcctcaacggctttttgccggatgcctacgcattgacactgggtattggcacctcggctgctaccagcccccttgccaacctgtttgtactgactgaacgaggtggtattgaccccgaacgctcaggccgggccgtgctgtggacgcctcggctgggccatgaagtgtttacgtcgattgaaaccctgcgcagcgcgttgacacagcgcctggcgcatccgatcaagcgtttgagcctgctggaaaacctgcccgtctccctgcgcaggccccatcaggtgtatcggttgggtctgttgcaacgcatcgatgacaacctactgaacaaccgcctgcaaacctacagcgattacgtgatggacggggttgatctcctgctttccatgaagttacccgcgcgtgccctgcaagaccgcctggacaacgtgctggaacaggccgcgcccaccaatctggcacgcgcgatcagggtggccggcgccctcgtcaaccagcaggccctgcccgtgtggctgggcatggcaacgactcaggaccagatccatcacgctgaactgcttgagcaataccacaacagtgcacccgacgaaaaagactacctgcacggcatcgtgtccgtgcgccaacatgcgttcacagccctgcagacgctgctcaaggcacggtttcccgaccttgacctctcgccggatgacattcaactaccggtgcaccaggcgctggacgtgcatgtattgagcctgaccgattttgccgtgcgtcactggccggacctggaagccgaaaacctgcgtccacgttcacgcactgccacgccactgccgcctgcactggacgccagtacggtgatccagatggtccggcagctggacctgaaaaccgcctaccacacgatggtgcagaacacgctcaatgcccagaccgaagaggcgcgcaaacgccggcgcctgttctgccgtcagttgccttggcaaatgctgcaatacgcccatgagcaaaagctgcaggagcgccttacagcgcgggcccattgctatatccagcaggttttcaacatgcccgatgccctggcacgcgcaacccttgcgggtgcgaccgccattattcgcccgctggcgttgatagcgaccgatggcgctgcggccgtgaaggcattgggcatgtacctgattggccctgaaaccagcagcgccgggccgctggtgttatatgcgccctacagcgagaaccatgtgctcaaggagtatgcaaacgaacaagccttgctggatgaattggaaaagccgggtgcacttcaggattggaccttgaggcacttggagctggcgcatcaggccacttaccgcaacctgctgcaaaacaaccggcatcgcgccaccgacatccgtctcgccgcgtctgcggtgagcggcaacgccctgcacgccctgttcagcgacaacacgcaaatgctgctcaagatgctggcttgccagttcaagaaagacgccaaagttctatgggacactgcggtcaacctgctgggcgaggaaatccccacggccgtgcgcttcatggccggaaaacttgcgtaccctctggtggtgtggcgcagctaccaattgttcaaacgctcagccgagtcgctgcaattgcacaagtggagggctgccttgaaggactttatcgcgggcgtggcgcaaatggcggcgctgcgcggggagctggacggcagcgcaaaaccgccgcccacagaaaaacccgtcacgctggaagagctgtcggacgacacgctgcccaacgcgacaagcctgaacagcctggacatcaccgcgccctcgcgcacaggattgcagcctttcgaagatcacgatattgcgctgaaggaccttgaaaaaagccccaccagccatgtctatcacgacaagtcgaggtcaaaaagctatgtgccactggacggaaaagtctactcagtcaagaaaaccgcccagcactggcgcctggccaaggacccactgaacggcgcctacgtgggccgcaacccacaaggcaaatgggtgctggacctgcgtcggcataacccgcgcttcggcaaagtactgtcgcgctacagaacgcgcaacggcgagcgcgagacgatcaacatcgaagcgagcggcatacgcgcgattgccaacctgtccaactggaaagcccaggccatcaatgaagcgttgaacgtggcgacttattacggcgtcacctgcaagcgcaacatcgcgcacttttcgctgcaacgtgatcccaatagccgcgtcgggcattttttgggggaaatgttcggtgtgatcagcatcagcccgcagcagctcagtcgggtcgagaaaattatcgatggcatactcgatgaattaagcgacccgagcttgaccgggcctgattccaaacgttttgtcagcggcaccagccgcgtgagcatggcgcaggaatacgcctttgtgattcctgaggaccgggagcgcaaactgtatttgctcaaccggttctttgatccggacatggacgagtaccagaaccgcctgaactcgcccttcgacatctcggcccacgccagggccagcacgttgattcacgaattgacgcacttgaggtcgcgtaccgaagacatcgcgtacatggacacgatgcgcccctttcccgacttgattaaccctgcgcagccgggtgcgcagttgatgaagacgaccctggaagatttgcgcaagaccgcattgtcgacgctgacacccgccacaatgctgttcaagacctgggacgatttatcggcgacatgggaagactacggtgcgggcagcggcacccattacatcaaacaaaaagtcctcagcgccacgggcgccaaggaccttgatcacgcccggcaggtattcatgagtgaccccgacaagcgaatcgacaccattttggccaacgccgattcagtgacttatctgattactcacctgggccgtttgctggatgcgggggcctgagcggcccccggcagtgcctcagtctttctggtcacgcaggatattgcccgaggcgccgtcgatacgcgcttcatagactgtgccatcggacttgcgtcctttgacttcccaatagccatcgttgtcggcttcggccgcgtagacctcaacgtaaccggccttggtcttggccacttcgatggccttttcgatggggatccagcccgcgcccggcttatcggccaaggctgcgccggcactcagcaaagcggtggttgcacacagggcggctaaggttttcttcagcatgttcgtactcctttgtgggaatgacggactcgtgtcctgtggtttctgagtttttcaaacgagaataagttccaattgatgtgcaatcgccatgatggttgttctcgccatccgcctcgggaggttagaatgtgcgaaatcaggatggattaatgagcgaaaactccctttcagaagccgaatacgacgccatcaccgacgccgctgcgcattggtgcatgcgcctgcatgccggtgattgcacggctgaagaacgtcgggcgtttgcgcagtggcacgatgccgacccgctgcacgcgttcgaatacgcggccatgctggaaatctgggacgtggccgaccacctgccgcgcagcgagccttcgcccctggtactgccgttcaagccgcgcagccgcttgcgcacttacgccgtcgctgcagcggtatgcctcgccgccctgccgctggcagccttcaccggctgggaagcgggctggctgcccagcgcctatgagcatttcgacgctgccaatggcctgcgcaaagtcacccttggcgatggcagccaagtcgagttgaacctgggcaccgaattggtctaccgcaattacaaggaccagcgccaagtcaccttgaaaaagggcgaagcgtttttcaaggtcacccatgaccgcagtcacccgtttgttgtgaaggccggtgacgggcaggttcgggtcaccggcacccaattcaacgtatggaagtatgaagaccaggtccgggtgatgttgctggaaggctcggtgcagatttccagcgatacgcagcacgccggcgtgccgctcagccctggcatgcaagccagttaccacacgggtgacgccaccccgcaagtcgccgcgatagaccccaacgacgctggcctggcatggcgccagggcaagttggtactcgacaacctggccctggccgacgcgttgccgctgatcaaccgctacctgaataaaccggtgatgctggcagatgccaataccggggcgattcgcatcggcggcatctacaacatcaatgaggttaacaacctcgtcccttccctgcccaaggttttgccggtctacctgacccagaatcaggacggcaaccccgtactcaattccatcccgcgtaaagcgccgaagggctaagcctgcctgctcacacgggctcgcttgcgcccgtagtgtccatttttgaaacacttacctggcctgaatcgcccgcccggtgcggattcatggctttgtcatgtgcagtgtttcatcactgagacagccaacaggtggggctgcgcataggcagccgcagggcgagtgtttcgcggatgaaacacttcggccctcacctccccacgttttaatcgcaacctactgaatattcacgaaaaatcaaaagcggcacgcgttctgctctttcccttacagcgctgtttagggtcagcgcgaagaataaggaacactgccatggacacacacaatcacggctccttgagcctcctgctgatcagctgtgcactgagtgccggcgtgagcctcccggtgctcgcggcaggtgatggtgtgatcgtgattgaacgccaggtgcaaccgtattcaatcggccgtacacgcggcaccgacccctaccccaccaccgtcaatgccaacccgtctgcgcaaatcttccgtgcctccaccaatgagctcagcgaccacgacatcgcgggcatcagcagtggctccagcatcacgcgcagcatcatgcccaacggcgacatcaccggtttgaacaatatcggcagtgccaacaacctcggtgcaggcagcgcagcgggccatagcggcagcggcggcggcatcgccggcacggtaaacggtgcgatttccagcggcctcgccccactgaacaacatcagcggcatggtcgggggggcaatgaaatgaaccactcctggatgctgcttgccgcgctcggttgcacagcggccatggccgacagcaacaacaacgcgaccctcgataactcgggcaagcaatacaacggcgtggtcacggtcaaccaggccgccggcgaccagcaacagctgagtaacaacgttgccatcaccgtcggccacaacgcccagacgaatattgccgtcacgcaaaaaatcagcggcggcgccgccgaccgcggcctcaacgccaaggccgcgatccagggcaactctttcagcaatggcaacggtgcactgagcgtcaaccagtccgccggggcccagaaccagatgatcaatgccgtgcgaatcagcgtcagcgctgggccgcaaagcatcgacgacagcgtcatgtcgcaacagaacgttgcgcttgcaaccgactcagggttgacccctaccactggcagccgccaggtcgttaccagcgaccaggccttcaccggcagccgtggagtggttcaggtcaaccagagcgccggggtggggaaccgagtggctaacaccctgaatgtacgactcaactgatggagctgagtcgatagctagaccgtaccaacacttaaccaactaatagaagcaaggagatacaccatgaaaactacaatggctcttaaaccactggctttcgctctcgctgcgctcatggctgttgctgctcaagcgggtcaacctaaccatcatcctcagcctgcgccaaccaccgcttcggcgacgactctggacggtcaaagcaaccactccaacgtggtgatcaatgacaaaaccaaaaacaacgcttcggccaatgactcctacaaccacatcagtggcgtagcgaacggcaacgtgctgagcggtgacaacaaccaaggcaaaaacgacgtggccatcgtttccggtgatgccgacttcgtgttcgccagcaccggtaccgcacaatcgaacaccggcaacttcgtgctcaacagcggcaccaaaaacaacgcttcgctcaacgacagcggcaacaacgcatcgggcatcattcagttgaacgcagcgtctggcacctccaaccaagccagcagcagcgttgcgattgcctcgggcaatggcgacggcggcgcagcagcggtcaccggcgtgcaggacgtgtcgggcaacctgacgctcaacctgagcagcggccacggctggagcaccaaacctgtggtcaacaacgccagcgtgaacaactcgatgaactacagctcgggcgtatcgaactccaacgttctgtcgggcagcaacaaccaaggtcagaacaacgtagcaatcactcgcttctgatccagatcgggccttggcaacaaggccctttttatttccagtgtccaacaggtcatacgatcatgcgcctcgttgccgtcctccttttgctcgcactcaccggcccgacctgggcaggccaagtggcaatcgtcatgcccggtggcgggctgatgtacaaaaaggtcgaaagcatccgcgagcgcaaattcgccaacctggtggaacagaaaaccgatttcagctgcggcgccgccgcgctggcgaccatcttgcgccaagcctattggatggacgtggatgaagaccacgtcatcaagggcatgctggtcaatgccgaccaggatttggtgcgcacccagggcttctcgatgctcgacatgaagcgctacctggaaagcatccacatgcgcgccaagggctaccggattacgcccgaagtactgatcaccgtgaaagtgccggtagtggtgctgctggagattcgcggctacaagcacttcgtggtgatgcagcgtgccgacaaggactgggtgtacatcggcgacccggtgctgggtaacaagcgctatgccaaagacgatttcgtcaaaggctggaatggcatcgtgttcgcggtgatcggcgagggctacgacaagaccaacgccttgctcaccccgcccaccccactgaccgccaagaaccagctgaacgagttcagcccggtacgcgacagtgaattgatggacttcggtttcatccagagcgacttcttttagaagcgcaataaggagcaggacgctccaggagcaaacgatgaacactctccgttggctgacggtcatgtgcctggcagccgcagcaccggcttacgcctcctcggcgttcaagccaatcgaactcaaggactcggaaatggctgacctgcgtgggcgctatgtaatgcccgggcgaattgtcagcttcggcatcgtgatgagcagcacctggaccaacgccgccggtgcgagcgtcaccggcaccgcgaatatgcaggtcaactcgtccaccatcaccccacagttctacgtgcagattactggccacgacggcagcggcgtgatcaagcaaccggaaggcactggcacggtggtgggtggcgccggcctgggcagcggccaaggcgtcgtgcaaagcgtgcgcgccgccggtgatggcaacaccgccagcaacggcgtcgacattaacgttaacaaaaacggcctggcacctgccaactacgtgcaatccgggcaggccttgatggccggccagccgattaccggaggcaccgcggcgggccaagtcacggtcacggcgaagaatggcgggctgcaaatggccctccaggccaataacaaccaaggcaatgtggtgcagcaaatcggcggtggcaacgtgctgcaaggcaccgttattcagggcaacagtaacttcgtgaacaacttgacccagctcaatgtggtgttgggcaacaacggtttgaacaacatcacgcagaacctcaatctggatcaactcaaaggcctacgccctgccggatattgaactacgctgagcctcgacacttacgcattagaaagggacggcttatttcatgcatcgatcgttatcgttacgtgccgtggtttgtttgagtacgctcctgcccgcatccatgttgtatgccgcgccggatgccgatatcgaaacgttgaaacaggaacttctggagctcaagcaacgttatgaagtgcagcaaaaagcactggccgtattggagcaacgcgtacgccaagtagaagaccaacccgccacacccgcgccaaaacgcttggccaaatcccctgccgacttccagaaaggcggcaccacggtagccggcaacacccacggcgtcggcgccgctgctgcctccggcggcgcagcgggtggcagctcgtacgggcagagcctcaaggacgactccgccccggcacaaagcgtgagcaacttgtacaacgaggccagcggcttcttcggcaacggcaagttcagctttgaaaccggcatcacctatgcgcgctatgacgcacgccagttgtcgcttaacggttttctggcgctggactcgattttcctcggcaatatcaacctggaccgaatcaagtcggacagctggaccctggacctcaccggccgctacaacctggataaccgttggcagttcgacttgaacgtgccggtggtgtaccgcgaatcgacttaccagtcgggaggcgcaggcggaaactccaacgccacatcggaagggacggttacccgcgacccgaccatcggtgatgtcaacttcggcattgcgtacaagttcctcgacgagagcgccagcctgccggatgcggtggtgtcggttcgcgtcaaggcccccaccggccaagacccttacggcatcaagctgatcgagcaacccggtaacgataacctcgccgtgccggaaagcctgccgacgggtaacggtgtgtggtcggtgacgccgggtatttccctggtcaagaccttcgacccggccgtgctgttcggttcgctgtcttatacccataacttcgaggactcgttcagcgacatcagccccaacgtcaaccagaaaatccccggcaaagtcagcctgggcgacagcttccaactcggtgtgggcgtagcttttgccctcaacgagaaaatgagtatgtcgttttccgtgtctgacctggtgcaacgtaaaagcaaggtcaagcagagtggccaggattggcagtcggtggtgtccagcgatgccaacgccggttacttcaacgtgggcatgacgattgcggcgtcggagaacctgacgattgtgccgaacctgtcgattgggatgacggatgatgcgccggactttacgtttagtctgaagtttccgtattacttctaggggcggcgggacgcggagcgtcccaggctacattcctttgctgcgcgtgggaacgatcagcccgctcgccacaacgatcagccccgcaacgataagggtcgttgcggggcttttcggtttacccgccctagcggatctggtgtttgtgcagtaaccggtagaacgtcggccgggaaacccccagcacgcgggcggcaacactcaggttgtcgctgtgccggttgagcacatcgcacagcgcctgtcgttcggcgcggtgcttgtaatcttccagtgtagccatcggcggcgcgattgcctgctcgccttgcagtcccagatcaacggcttcaatctgccgcccttcagccagcaccaggccacgccgcacgcggttggccaactcacgcacattgcccggccacgggtgttgccccatggccaccagcgcatcttcgctgaaactgcgcgggcgccggccggtttcctggctgtagaaacgcgaaaaatgattggccagcattgccacatcgccatggcgctcgcgcagcggcgcggtcatcacctgcaaaacgttaagccggtaatacaggtcttcgcgaaaggcgcccttggccaccgcggcctccaggtcgacgtgagtcgccgccagcacgcgcacatccaccgggatgggctggctaccgccgacgcgctcgatctgtttttcctgcagaaagcgcagcaggttggcttgcagctccatgggcaagtcgccgatttcatcgagaaacagcgtgccaccgtgggccgcctcgatacgcccgactttgcgctggtgcgccccggtaaatgcacctttctcatggccaaacagttcggactggatcaagtgttccggaatcgcgccgcagttgatcgccacaaacggcttggcatggcgctgggattggcgatgcagggttttggccaccagttctttaccggtgccgctgtcgccgcgaatcagtaccggtgactccgtgggcgcgagcttggccagcaatttgcgcagttcacggatcggccggctgtcgccaagcaactcatgttcgggctcgtcgaccagcgcgtagcctttgccccgcaggcgtgccatgccgaacgcacgcccgagggtgacctgcacccgcgccacatcaaagggcagcgtgtggaagtcgaaaaaccactcacagacaaaatccccgacattttgcaggcgcagcacatcctggctgagcacggcgatccattcagtgccgctgcggctgatcaactccttgaccgcttcggggcgttcaaggtgctcgggctgcaagcgcagcaagcccacatcacaggaacgatcgcctacggcgcccagcgcacagctgtccacttcccacccggccgtgcgcaagccgggtaatagcgcgtggcagtcctcacagggatcgaccacgagcaggcgacgttggacaggtgtaacaaccatgactattccttggcgccagaattattaaagttatttagaaacaatggtttgtgaggcctggcgctaacactagcaaggtattgacgcgcgccttgtaccgtttcgctataagtgttggcagaaagccacttctgcagtgtttggggttaaaaactgaaggcgtattaaccccctcattcagcgaccaaaacagccgcttacatgacgttaatcaggaaaagttgaaatttcttgctctaacatgtgacccgtaccccgccatcgtgcatcagtacaagtaactcaccgtttggcccgcccaaccaacggcacacacttgatgggcattttagagagaagacccacatgaacgccccgctccgcatcaacgaagctcttttgatcgcagaccgtgctttccaaccctttcaatgcgtggcctggcacgatggcaatggcgcgctcagcctgagcgtcatcgaccgtaccaatacccgtatcggcagcaaacagctgtcttcgagcgcctataccgaccctgcgcaactggaagacttgctgttgcaggcgcgcgccgaactcgacaaagatggccatcagttgcagtcgtgggcaatgccgaagtaagtcgtccaagtaagtcgcccaagaaacttccgatcattgcctgccagcagcaacaatgatcggaagttgattgttagagcgttggcacttcaagttggcgttattgtttcgccgcgagaataaaccgctcaatggcttgcgcagcgccatcctcgacattgctgccggtaacgacactggcttggcgcttgaccacttcttccgcctggcccatggcaatcgaaaagcctgccacgtgaaacatcgccgggtcgttgccgccatcgccgatggccagcgtttgttcaagcggcacgccaaggtgcgcggccagggccttcaaggcatcacccttgttggcgagcatggccgtcacgtcgaggtacaccggctgtgaacgcgacacgtgcgccaacccttcaactttgggctgcagctgcgcttccagcgctttgagcaacgccgcgttgtgactggcggcgacgatcttgtcgacgcgatccaggtagggctcgaaactctccaccactatcggcccgtaacccaagccggccgcctcccgcgcgaccatcgggccaggcgggtcgcggcgcagccaatcgccgtcggcgaacagccagacttcgacgtccggctctgcgctgaacagcgccagcgccaccaaggccgcttctgccggcaaatgatgcgccagcaggatgctgccatcggggttgaccagcgtaccgccattaaagcccgccaccggcacatcgataccgaatgcctcgaccatctgcatcatggccttgggcgggcgcccgctggccaggctgaagagcaccccggcatcgcgcaacgcgcgcaccgtatcgatggtgcgttgactgggggtgtgatcggggcgcagcagcgtgccgtccatatcacttaatacaaaccggatgggatggatcgtggcgtcactcatccgaggctgtgccaggtgcggccgtcacgggccagcaaggtatcggccgctgccgggccatcttcgccagccttgtaggcctggataccgtcgtcctctttccaggcatccaggaatggctgtaccgcacgccagccgttttcgatgttgtcggcgcgctggaacaaggtctggtcaccggtcatgcagtcgtagatcagggtttcgtaacccgtcgacggctgcatctcgaagaagtccttgtagtcaaaccccagttcgatattggccatttccagggtcggcccaggctttttggccagcaggtcgaaccacatgccttcgttcggctggatctggatcttgaggtaagtgggcttgagttcatccacatcggtatcgcggaactgcgcgtagggcgcgtgcttgaagcaaatcacgatttcagtgtcgcgaatgctcatgcgcttgccggtacgcaggtagaacggcacgccaacccagcgccagttgtcgatcatcaccttcagggcaacgaaggtctcggtgctgctatcgggcgcgacattggcttcttcgcggtaaccgggcagctgcttgccggcgatttcaccggcggtgtactggccgcgcaccgagttggcccgcgcatcttccaacgaccagggccggatggcaccgacaaccttggctttctcgccccgcaccgcatcagcgccaaacgccgccggcggctccatggccaccatcgccagcaactggaacaggtgattgggcaccatgtcgcgcagggtgccggttttttcgaagaaattgccccgggtttccacaccgacggtttcagccgcggtgatttgcacgtggtcgatgtaatggttgttccagaacgcttcgaacagcacgttggaaaaacggctgatgaggatgttctgcaccgtttccttgcccaggtaatgatcgatgcggtaaatctgcttctcgctcatcaccttgagcaggctcgcgttcagggcttcggcagtggccaggtcggaaccgaaaggtttctcgatcaccacacggcgaaagccttcgtcggtttcattgagcaaaccggcgctgcccaggcgctgcaccacttcactgaagaagcgcggtgcagtggctaggtagaacaccgcgttggcggtgccgctgtcggcgattttcttgccgatgtcggcgtaggtgctgtcgtcgaggaagtcgccctcgacgtagctgatgcctttggccaactgcgcccacagctcggggtccagggcgttatcggcattgcccttgaccttgctggcggcctcggtgcggatgaaatcctcgagcttcttggcaaagtcggcgtcactgatggcgttgtgatcaacgccgacaatgcgcaggccgtcgcccagcagcccatcacggctcaggttgtacagcgccggcatgagcaggcgcttgaccaggtcgccatgggcgccaaacagaaacagcgtggtcggtggagcgggttcggccttgggtttcttgccgttaacggtcattttttggaagtctccacatggccgccaaagccgaagcgcatggcagaaagcattttgtcaccgtaggtgctctgctggcgggaacggaaacgtgcgaacaacgaggtagacagcaccggcaccggcaccgcttgttccatggccgcttcgatggtccagcggccttcgccactgtcggccacggagcccgagtagccgtcgagtttcgggtcggtggccaaggcatcggcggtcaggtccagcaaccacgacgaaaccacgctgccacggcgccagacttcggcgatgtcggcgacgttgagatcaaagcgctgatcttccggcaggttgtccgagttcttggttttgaggatgtcaaaaccttcggcaaaggcctgcatcatcccgtactcgatgccgttgtgaatcatcttcacaaaatgcccggaaccggctgggcccgcgtgaatgtagccatgttcggctcgtgaatcagccgaggcggaacggtccttggtgcgcgggatcgtgcccaggcctggggccaggctggcgaaaatcgggtcgaggcgttgcacggtctcggcgtcgccaccgatcatcatgcaataaccgcgctccaggccccagacgccgccggacgtgccgacgtcgacatagtgcaggcctttttccgacagcgccttggcacggcgcacgtcgtctttatagttggtgttgccgccgtcgatgatcacgtcaccgtcttccagcagctcactcaattcattgatggtgttttcggtagggtcgcctgccggcaacatgacccaaacggcgcgcggcttttgcaggccggctaccagggctttcaagtcggcaacgccagtggcgccctcttcgctcaagcctttgacgaatgcttcgttacggtcgtatacaacggtggtatgcccattgagcatcaggcgccgcgcaatgttaccgcccatgcggcctagtccgataatccccagttgcatgtgctgatgctcctaactgctaaataaatgtgtgacatagtttatagcgcaatgaggctaatgagggttagtccagagcggatccgtgtagtttcatgacaaaaagttggccagcgtttcagcatcaccgcgcaaaaagtcacacgaccgtcaaaaataaaaaagttcccttgattcaaaaaagaattcagaattgcttccgactggtgtcgagccccacccctaacgcgttccgacatcgcgatctaccggctatttgcgaggcaagcaatgagcacagcacagatgacccgcccgccacagaccctctacgtcagcgtccgtcgcgatgaattgcgccagttgaaagacgaacgcgatcagctgcagcaggaagtcctgcgcttgcgttcctaccttcaggcccagatcaaccaggcgtccggcacccagcccgcgctttgctgaacgtgagctgaacgaaccgttcaggaataactcacgaagttttcacaccctcctcccgatactcccgccgaatagggccgcccacctggggtagccctcgtgttgcgcgcacttctgcgcggtgactggcaattatcgggttggagcgctggatggcgatgttcaaacgcagcacgaagtctgcgaaaggctttgattgggccggccttggctggctgttcctgtttttctggtatttctcgggtatcacccaactcctgatccaactgaccggcacgtccggtttcagtggctttcgccaagccttcttcctgagcgccttctggttggcgccgatgctgctgttcccacgccagacccgcgtgctcgccgcattgatcggcgtggtgctgtgggcctgttccatggccagccttggttacttcttcatctatcagcaggagttttcgcaaagcgtcatcttcatcatgttcgagtcgaacatctctgaagccggcgaatacgcgacccaatactttgcctggtggattgtgctggcgttcatcgcccataccgcctttgcagtgttcctgtggacccgcctgcgcccggtctacctgccgcgcggccaggcgatcctggcggcgactgcgattgtactggcggtggtcggctacccgctggtcaagcagattgcgaccaacccgaccatggaactggccatcgacggcttcgaatcgcgtgtcgagcctgccgtgccatggcagatgatcgtggcctaccgccgttacaccgaacaactcaacagcatgcaaggcatgctgaacagtgccagccagatcccgcccctgaagaacctcaaggacagcatggccggccagccctccacgttggtgctggtgatcggcgagtccaccaaccgccagcgcatgagcctctacggctacccgcgaaacaccacaccggaactggacaagctgcgcgaccagctggcggtgttcgacaatgtcatcaccccgcgcccctacaccattgaagcgctgcaacaggtgctgaccttcgccgacgaagataatccggacctgtacctcaagacgccgtcgattgtcagcgtgatgaaacaggccggctacaagacctactggatcaccaaccagcagaccatgaccaagcgcaacaccatgctcacgaccttttccgagcaggccgacgagcaggtgtacctcaataacaaccgcaaccagaacgcccgccaatacgacggcgacgtgctggagcctttcgccaaggccatggctgaccctgctgaacgcaagttcatcgtggtgcacctgctgggcacgcacatgagctaccagtatcgctacccgccgaccttcgacaaattcaccgatcgccagggcgtcccgcccggcatcagcgatgaacagctgccggtctacaacagctacgacaacgcggtgctgtacaacgacttcgtggtgtcgagcctgatcaaggactacgccaagaccgacccgaacggcttcctgctgtatctgtcggaccacggcgaggacgtgtacgactcggccggccacagcaccctggggcgtaacgaaggcaagcccactgcgccgatgtacaccatcccgttcatggcgtacgcctcgccgaagtggcgggaaacccacgactggagcttcgccagcagcctgcagcgcccttccagcagctcgcaattgatccacacctgggccgacctcgccgggttgagcttcgatgaatgggaccgtagcaagagcctggtcaatgccaacttcaagccgcgcccgctgatgattggcgatccttatatcggccagaaaaagggcctgatcgatttcagcatgctcaagccgaagaagccggatgccgctgaagtggtcatcaagtagccagggccttgtaacagaaagataacaatcattctcgtttaaacctaaagttccacgtctcctttcgtctttgagccatggccttccctttccggggtggcttcaaagacgacaaggagtctgccgcgatgcttgcgccgtttacccgttccatgaccctcacccttggcctgttcggtgccgttctgagcccggacctactggccgaaaccgaccccgaacacccgccgaccaacacgcttgagctgggcgccaccagcatcaccgccgaaggcctgggcgccactaccgagcacaccggcgcctacaccaccggcgcgatgagcacggccaccaagctcaacctgtccatcaaggaaaccccacagtcggtctcggtgatcacccgtcagcagatggatgatttcaacctcaacaccctcaccgaggtgctgcgccagaccaccggcgtcaacgtccagcactatgactccgaccgcgtctactactcatcccgtggctacgccatcaccaattaccagattgacgggatgctcaataccttcgggtatatgaagtcggacgccgacaccatcatctacgaccatattgaggtcgtacgtggcgctacaggcttgaccaccggcgcaggtgacccttcggccaccgtcaacatggtacgcaagcgccccaccgcgcaatggcaggcaaaaaccggtgtgagcggtggcagccacgacaactactacagctacgtggacgtgggcggcccgctggcctttgacggccgcttgcgcgggcgcagcgtgctggcctaccgcgacagcaagtcgttccgtgacaactacgggctgcagcgcaccgtcggctacggcattctggaaggcgatctttcagacgacaccgtgctggccgtaggctttgattaccaggacaaacatgtgcaaggcacgtcctggggcaccgtgccctactggaacagccaaggcggcaaggccgggctgtcacgctccaccaacatggcggcagactggagctcctggccgctgacggacaaaaccaccttcgcgacgctggaccatcggctggcgggtgactggcatctgaaggcggcgtatacccatcgccaaagcgatacggatggcaaggtctactacggcggtgcgggctttcccaatgatgatcgcagcggcatgaaagcctggaacagccatatgctcggtacgtccagaatggaggcgatcgacctcaaccttgccgggacgtacgcgcttctgggccgcgaacacaagctgatggtgggttatggcgaagccgcacaacgcgacacctcaccgtttatgcgctcgggcaaaacacccgacgggtacaacgacatcgacgactggaaatacatgggcgggatcgccaagtttcctgacacggtcacgtcgctcaagggtgagcacagctctaaaaaacagaaggcgggttacctggccactcaactgaacctgacggatcgcctgcacgcggtactgggcagccgctatggcagttgggagtacgaaaaagccgaacctgactatgacgccaatgaccagttgaagaagagcggcaagacgcgtcagacccacaatgacatgtggacgccttatgcggggctgctctatgacctgacgccggagtacacggtctacgccagttacaccgatattttcaagccacaggattccgtcgacgtgggtaagaagtatctggagcccgttgtgggtagcaactatgaagtggggctcaaaggcagcctgctgcaggagcgcttgaatgtggccgcggcttacttctggagcactcaggacaacgtcgcagaactcgacgactcggtgccgccgaacccgaccacgggcgaggaatactataaatccggcggcaagggtaacaaggtcaatggcttcgaactcgaggttgccggtgaagtcctgcccgactggaatgtgaccgcaggctacacctacacccactcgttgaatggctcgggcaaacgtaacaatacccagcaaccactcaacctgctgaagctctccagcgcttaccggctgccgggtgaatggcgcaacctcacggtgggtggcgcggtgaattggcagagcgacatgtatgacttcagcaaccggccaacgggcgcgcgggatgacaagggcaacctgatcaccacccgggcgaagatcactcaacaggcctacaccgtggtcaacctgatgtctcgttaccagttcgacgaacatgtttcggcgtcgatcaacgtgaacaatctatttgataaaaaatattacgaacgtgtcggcttttataatggcgtgtattggggagacccgcgctccatcacgcttgccttggactggcagctgtaagccctgccccggaagttaacaaaaacgttaacttccgggcggttccacgttaattcccacttaataagacgccgccatagtcgccccatgaaccggatcaaggagtgatcggacacctttcactcttaatgggaatactgccatgaaactctccaccctgatgctcgccagcctgatgaccgtgacctccgttgccgcctttgcagaaggcggttcagagcgctccaagcagttctacaacgacttcaccttcatgcagcaaaagacacacggcacgaatgacaaaacagcgattgccgatggcaagactgtaaagcctcgcactaccgaacaaccggatgccgagcaaaaaccgaacagctgatttaatacttagttaatccgcattaccctgtgccatcccgctccgttggtaaaggttaacttggcgccatttaatggcgccttttttttgccccgcgtttaatcagcgcaactattaaagcggtttactccagaacaacatgcgcccgtgggccgggtcaaagatcgaatcatcaaacccaaacttgcgatacgccgcttgagccacgtcattgccttcaagcacctccagggtgatcttgcagcaacctcgctggcgcgcgatttcctcgaccttctgcaacattttctgactcaaccccaagccacgaaacgggttcatcaccaccacgtcgtgaacgttgaccagcgggcggcaggcaaacgtcgagaacccttcaaagcagttaaccaaacctgccggctcgccaccgacaaacgccagtacgctgaacgcgtgggggcgcttggccaactcggccggcaattgctgcaacaggtcggcaggcaaggtatgaccgccgcccatcgggtcttcggcgtaatggttaagcaccaggccaatcgcctcggcatgcacggggttggtgtagctggcttgcagcaccaggatgtcaggggtgtccatttccttcctcaatcacgacaacaagggaacaggctccctttgagagcacgattgtaagcgcggagtcggctctggatgaaggagattaactacaaatgcctgcctgaaagcacgaaggttgggcgcatcaacaagcgccttctgcctgggatttgtcctatgcgccgaaacgctgaagttgcatctcctgtaaccggctcagggtgcggcgaaacgcaaactccagatagccttcggtgtagagatgctccagcgccacacgggcctcgataaacaacggcactttgcggtcgtagcactcgtccaccagcgcgatgaagcgccgcacactgtcatcgtgcaccgacaattgcggcagttcgcgatcaccggccaccacgcgctgggcggcatcctctgtgccacgggcaatacgaccggggcgtttctgcgcactcaggttgggaacctcacccagcaaaatagcgctgaagcgatcacacaacagcataaagtccatggcggccaacggctgctcgcacagatcgcagtagcgacaccaaagcaccgtgtcgctggacagcaccgctacaatcgagcgatggccgacactgaccggcccgctactcaccgcctgcccttcgctcagctgtttgaacaccgtggcgagtgcctccggctgattcacccaatagcgctgcaagctcgcgccgggatgcaaacggtgatcttccccaccgtctaccgccaccacctgcatatgctgcttgatcgccgcaatgcccggcaggaaacgttcgcggttgaagccatcggcatacagctggtcaggaggctgattcgaggtgcacaccatcaccacgccttcttcgaacatcacctggaacaggcggccaagaatgatcgcatcaccaatgtcactcacgaacagctcgtcgaaacacagcacccgcacttcctggctgagctcccgggccaaggcctgcaacgggtcgtggatgccgctgagctggaacaaacgctggtgcacccagcccatgaagtgatgaaaatgctgacgccgcgcaggcacccgcagggtctggtagaactggtccatcaaccaggttttaccgcggcccaccggcccccagaggtaaaccccggtgatcggtgaacggccttggtgcaaggcttcgtggcagtgctgcaaggcgtcaaccgcccggcgctgggcgtcgtcgacgacgaaacctggctgggcgatggcatgttggtacgcggcgagaggcgagtcgaaagtcatgcgtgccagtatgacttacagggagatatccagccgcgaaatcttgccctgctcgttcaggcgaaaggtgtagcgcagctcaagcgggctaccggggaaattgccggacaccccattgctgaccagcaccttgccggtgcgatgctgcacattcagcacctcgacccgcggctgataacgacgcccggtgtcttccatccaacgggctatggcggctataccgacttgatgctcgccttcatcgaacacgttggcatcgtcagcaaaacaatgggcgatggccgaggtatcgcgggtattggtcgcagcgatataggccgcaatggccggggccaattcaggcaggctcgacatggcacagctcctttttagtaatgtgtagcgccatgctaagccagggacgtgtcagtttttgtcaggagtaaagggcccggattcattctgctccatcagcttgcgccaagcccgcaaccagtcgctgcgccgccccggataacggtcgccctgggcattcgcggcggccacgcggtcggtgcgaaaggtgcgataggcaccgcgcaattcgcaccacgccacaatcacccgcacttcgttcagaaagcccagcgccaagggccagatcagccgctggctttgggtctggctggcgtctgcgtagtcgatatgcagcttggcctggttgcgaatggcctcgcgaaacacgttgagcggcacgcggttttccgggtagccaaaccccggtgggcctggcagcagcgttgggttacgcagggcttcctgcgcggtggggtcgagcacgtcggcaatctttgccaaggcattggcagcggcgcggctgagcacgtcatcgccacgctgatccacgtagcgcaagccgagcacgatggcctcggtttcctcggcgttaagcatcaacggcggcagaaacaagccactgcgcaacacgtacccaacccccgcctcgccgaaaatcggcgcgcccaatgcagtcaattcagcgatatcgcggtacagcgtgcgctccgacacctccaactgggcggccagcacggcggccgtcaccgggcgttttttgccccgcagggcctggagcaaagtcagtagacgagtggtacgtgacacgttgatcccgccaaaaaggaaaaagtcccgcagcttagcagagcctcctgtcagaaaacgtcagcagtaaaaaacccgcttgaccgaaaacattacaggcatcatattatttacatgttactgaacatttaataaaaccgaacggtcaggagttttcctatgcgcaataaagtctttggccgccgcagcggtctgcaagtctctgaactggccttgggcaccggaaatttcggtacgggttggggccatggcgccgagcgcgaagaagccaagcagatctttgatggctacctggaagccggtggcaacttcctcgacaccgccaacggctaccagtttggccaggcggaaaaactgctgggcgaatttatcgccaccgagcgcgacaacctggtcgtcgccagcaaatacagcctgcgcactcagccgtccgatgccggtacgatcaagcacggcaacaatcgcaagaacctggtgcgcgccgtcgaagaaagcctcaagcgcttgaacactgaccgcatcgacctgctctgggcgcacatgagcgacaacgtcacgcctatggaagagattctgcgcggcttcgatgacctggtccgcgccggcaaaatccactatgccggcctctccaacttcccggcctggcggattgctcgcgctgacctgctggccgaagtacgcagcttcgcaccgattattggcgtccaggtcgaatacagcctggtcgaacgcagcgccgaacgcgaattactgccaatggccgaagcactcggcctgggcgctacgttgtggtcgcccctgggcggtggtttcctcaccggcaagtaccgcgaaagcctcgacgacaaccgcgccaacaagctgggcatgctgatccacgcggaaaccagcgcgcgcgaaaccgccgtgctcgacaccctgctggcagtcgccgctgaactcgacgcgagcccaacccacgtcgccatcgcgtggataagggcaaaggcccgccgttcgaccaccgcattgatcccgatcctcggctcacgcacccgcgcgcagcttgacgccacattgggcgcgctggacgtggagttgtcggccgagcacgtcgcgcgcctggacaccgccagcgccataccgctgggcgtgccgcacgggatcatcgcggagcgtttccccatcgataacggcttggacagccctcgcccgccagttatttgagacgaaaaaaaaacggcctgaacaggccgttttttttaaacgcagaacttacgcaaggctcttgctgaccacctcgaacacatcactcgacagctcgccggatgcacgaatgcgctccaactctgccttcatcagcgcctggcgcgcgctgtcgtatttacgccagcgcgtcagcggcgccaactggcgcgaggcgatctgcgggttgaagccgttcaactggatcaccaggtcggcgaggaaacggtagcccgagccatcggcggcatggaagttgatcaggttctgcccggcaaacgccccgatcagcgcccgcaccttgttcgggttcttgatgttgaacgccgggtgttgcatcaacgctttaacccgtgccagcccgcccggcaaagtgctgccggcctgaacgctgaaccattggtccatgaccagcgggttgtctttgaagttctcggcaaacaccgccagcgcctgggccttctccgcctcgaacggcgaattcaccagcaccgccagcgcggtcaggcgttcggtcatgttgtcgctggtgtcgaactggtccagcgttgctgccagcacttcaggcttgccgctgagcatcagataagacagcgcgatgttctgcaaggcgcggcgcgcaaagtgctcggccgccgccacgtaaggggtttgcttggacagctcgcggttggcctggtaacgcagccacagcgattcgtacaggttgtcggccagctgcttgcgggcgaattcacgggcagcgtggatggcatccacatccgccacttcactgatttccgtcaggtaggcttcgcttggcaacgagagcatttcggcgaccatcgcctggtccaggctttcatcactgagcaccgtgcgcagcgcgtcgatcaggcgctgatcgagcttcaacggctgaccggcttgatgctgaccaatcaactcctgcaacacctgcaccgacagttgctggccggcatcccaacggttgaacccgtcgctgtcgtgctgcatcaggaacatcagttggtcgcggttgtacgggaagctcaacttcaccggcgccgagaagccgcgcagcagcgaaggcaacggctgttcagcgatatcgacgaaggtgaacgtctgctcggcttcggtcaccgagatcacccgcgaggtgccgcccgctgccgcctcaccggccaggcgcaaggcaatgccggcgcccttggcgtccagcaagcccaactccaccggaatcacgaatggcagcttctcaactttgtccggggtttgcgggcagctctggcggaaggtcaggctgtaggtcttggcggcggcgtcgtaggactcgctcaccgccaggcgtggcgtgccggcctgactgtaccagcgcttgaactgggtcaggtcggcgccgttggcgtcttccatggccttgatgaagtcatcgcaggtcacggcctggccgtcgtggcgttcgaaatacaggtcgctgcctttacggaagccttcggcgccgagcaaggtgtggatcatgccgaccacttccgaacccttttcatacacggtcagggtgtagaagttggagatttcgatgaagctgtccgggcgcaccgcgtgggccatgggaccggcgtcttcggcgaactggtgtgtacgcaggtaggccacgtcctggatgcgcttgacggtggccgagttcatgtcggcggagaagccggaatcacggaacacggtgaagccttccttcagcgacagctggaaccagtcgcggcaggtcacgcggttgcccgaccagttgtggaagtattcgtgggcgacgatcgcctcgacgcgctggtgcgcggcgtcggtggcggtttcggcgcgggccagcacggcgctggagttgaagatattgaggcccttgttctccatggcgcccatgttgaagtcattcaccgcgacgatcatgaagatgtcgaggtcatactcgcggccgtaggtctcttcgtcccaacgcatggactttttcaggctgttcatggcgtgctggcacttgtcgatgttttccggctcgacgtagatgcgcagcgccacggtgcgctcggtcatggtggtgaaggtgtcttcaacgcaccacaaatcaccggccaccagcgcgaacaggtaagcgggtttcttgaacgggtcttcccaggtcgcccagtgccggccgtcttcgccggggccgctggcaatcgggttgccgttggacagcagcaccgggtagctgtgttgctcggcgatcaccgtggtggtgaaggtgctcatcacgtccgggcggtcgaggtaataggtgatcttgcggaaaccttcggcctcgcactgggtgcagaacatgccgctggatttgtacaacccttccagcgcggtgttggtttccgggtggatgcgcacgctggtgtcgaccgtgaagctctcgctggtcgggtgcagggtcaggtggctgtcggtcagctggtagtcggcttcgctcagttcgcggtcgcccaggttgacggtcagcagctcgagctgctggccatcaagcaccagcggcggcaggccggggccacgctcagggttgcggcgcatcaccagttgcgcgtggaccaggctgtggtcctcgaacaactcgaaggtcaggtgcgtttcttcgatcaggtagtccggcgcctgatagtccttcaggtaaatcatcttcggttgttcggtgcgcatgggtggcatccttctactgatgcacggcgagctggtaggccgtgtacttacgaatgttgataacgccggtgtcgaagatcaggtattggcccttgatccccagcagcgtgccttcggcaatcgggttcttgtccaggttgaagctgacgatcttggtcggatactgctccaccgggtagcggatttcgagcggttcgaggtcggttaccggttggatggcctgcaggccaaagcgttcctgcaaactcagcaggccttcggcgcacgaggcaaacagtgcatcgcgcacttcagccaggtccaccgccaccgcatcgcccttgagcagtgcgcgccagttggtcttgtccgccacttggctgcggaacaggtcttcgacgaagccggactgctggcgggtggcgacgcgcatgatcggcagcgcctggctggcgccctggtcaagccagcgggtcggcaactgggtggcacgggtgatgccgaccttgatgcccgacgaattggccaggtacaccacgtggtcggtcatgcagaactgctcgccccaacccggatcacggcaagtgccggcgtcgtaatggcaacgctcggggctcatgatgcacaggtcacactgggccagtttggtcatgcacgggtagcagtaaccctggctgaaactggtcttggtcttgcggccgcaatggctgcaatggatggcaccgaggaactccaggcgcacgtgcgtgccgatcaacgggttgaccggcacctcggtatcgcctagacgaaacgcgtattgaacggtcggctcaccgagttgcgccgacattttgctgactgcaccgcgaccaatttcaatcaatggatcgcatccgacttgaacaggatattcggcaccggtgccgatttggacgcgcattcctgcgggcccatgtagccggtgcgctgctcttccggcaggttctggatttcccaggcaatcaccgcttgcagcgacagctcgcgctgctcggcggtgagcttgcggccatcggaccacttgccgatttccacagccagcttgaggctctcgtagatgtccggggtgatgttttcgatcatttcagcaaaagaggacattaggctcttccttatcaaatggaggctttgcggcggttgtacaacccacccagcaaacccgtcaggcaaccgatgaccaagccgctcagatgagccgcgttggcgatttcgccgaaaccgatcatcgagatcagccccgacatgcagagcacaagccatatcagcatcatcgccagcaccccgcgaggcaggcgataagccgggttgggcgacagcaactggaaaatccagcaatgcccaagcaagccatacaacacaccggacaggccgccaaacaggctcgggccgccataagcgtattgcgcgtaattggaaaccaggctgaacaacagggtcaggcccagcaggttgatactgccctggcgcacttctatgcgccggccgagttcccagtaccacatgccgttcatggccaaatgcaggatgccgaagtggatcagcatcggcgtgaccaaccgccaccattgccccgacgccatagtctcggcaaatggcgtgaactggaggtactcgcccgtcacatggaacggcagaaacgtcagccagctcatggtttgcaggttttcacccagcaacgtcaccgcgccgacaatgatgctcgccagcagcaccagcgccgtcaccgggctgtggcgtacctgctgaacaaagctgggacgcgtaacgggcgcctgctcggggatgtccagttgctggtccggatcaccggcgggaaagcgctggtacaacacgcgcacgtcgtcgctgatgctctcgggcacccacaacacctgctcgccggcctcttcgctgacacgatggggcacttgcatgcgttgcagcaacttgacgaaacctgccaggtcgacactcagcggcaagcgcaaaacagctacggtgctcatgaaataacctcagggcgctcaacgtcgacccatacaaatttacgcggatccagctgggtttcctgatccagccgatacgccaccagcttgccgtacagcacagcgctgtagtccaggcaggccaggttcgggcggatcggcgcgggtttgccgctgcgccagtaatggccgacgaacaacaacggttcgtcgacgccataacgcagcagggaatttttttcagtcgacgacagcggcgtacgcgccaccggctccggcagtgcatcgggctggaacacaatgtcgccgtaggtcttcgggtcgtcttcccagaatttggtgcggaagaacgagcgcgtcaggccatcgccaccggtcagcgtcaggccgtccggcaggcgcatgtcggtgccgcgcagcaaacggtcgaaggcgttgcaggcaaaactgccgggcacggcggcggcctgcaggaagtgctggtcgatgcagccatccgggaaggtggcgcgcaacggcgcgataaacccgtcatcccagcacgcatgcaccacgcggaaacgcccggcgtcgacaaacagcggcatgtcgtagaaccagccgagaaagtcatgccagtcggctgggtggtgctcgaactgggtcagggtttcgtggatcaaccgcgcgtggcgtgggttgtgttcgcgcacgaactgcttgccactgcccggcggcgccggcgtggtccagcccagcgcgttgaactcgtggttacccatgatgcacagcgcctggccggcctcggccatgtcgtggacgatgtgcagcgcttcgcgaatgcgcgggccgcggtcgatgatatcgccgaggaacaccgccattcgcgtcggatggcgccaggtgccggcctgtttctggtagcccagccggtcgagcaagtgctcaagggtatgagcgcaaccgtgcacgtcaccaatcaggtcgtagctacgcgcgggatcgagcatcagtcgcctccaccccccaagcggctgccccagcccagcttggtgcggcacacttcgtagtagttgtgatccagcgggtggatcaaccgcaacttctgcgcctttttgctcacggtgatggtgtcaccgggggcacaggtgaaatggttctgcccgtcacaggagacttgcgggtaaatctgcatgtctttggacaccacgattttcagctcactgttgccgtcgaccacaattggccggctggacaacatatgggggtacatcggcacgatcacaatggcatccagcttggggtgcatgatcgggccgcccgctgacagcgcgtaggctgtggagccggtcggcgtggcgacgatcaggccgtcggccttctggctgcacacgaactggccgtcgatatacagctcgaactcgatcatccgcgtggacttgccggggtgcagcacgacatcgttgagtgcatcgccctggccgatggcttcgccgtggcggcgcacttcggcctgcagcaggaagcggttttccaccaggtaatggccgtcgagcaccttggccacttcgacttccaggtcatcggggcggatatcggtgaggaaccccaggctgccccggttgatccccagcaccggcacgttgtgccgcgccagggccctggccgcacccagcaggctgccgtcaccgccgaccacgatgaccatgtcgcagacttcgccgagcatcttgcgcgacgaggtttgcaagccgtgacccggcaggatttcggcgatggtgtcttcgaggatcacgtgcaggtggcgctcgagcagaaactttttcagtcggcggacggtgtccagcacctgggtactgcccaggcgaccgataatgccgatattgcgaaattgctccatggggctcctgcggggtttggggtgtggcgaaaaacaacgattatgggcgaaaggccgcgtcaggcaaaatcctttgtcgccgtgaacccttgatgacaatggttctcagccacctgcgcggcggttaaaaggctatgctcggaccatgactgtgttcccggatttgcacaacctgccccgccaactgcgccaccccgaagtgcgcgacttggcgtgggtgatgctcgccccgccgatgctcgcgcaaacgccctggccgcagcgccacccgctggcgggcagtgactgggtgcaggcaccgcagcggttggaacaatggttgcgcgcgctcgatcaagacagcagcgccttgcagcattggctgagccttgcccgcacccggcgcctgggcctgtactacgagcgcctgtggcaatttgccgtgcagcacgcgccgggcgtggaattgctggccgccaacctgccgatccgccgcgccgggcacaccctgggcgagctggacatgctgctgcgcgaccgcgatggcgtgcaccacctcgaactggcgatcaaactctatctggggccgcaggatggcgacggtcaggacgcggcgcaatggctgggccccggctgccatgaccggctggaccgcaagctggcgcacctggcccagcaccaattaccgatctcggcacgcgccgaaagccgcgaagcactggcagcgctggatatccagcagtttgatgcgcatttgtggcttggcgggtatttgctctacccctggcccggcgaggcggaaccaccccacggcgcccatccccagcatttgcgtgggcgctggctgcatcagcgcgattggccagcgttcgtccgtggcagcccgtcagggcgctggcaacccctgccccgccacgcctggctggcgccggcgcattacgcgccgaccgaggtgtggagtgaggaacagatgcacggctggctggcggaattggacccgatggcccccgcacagctactggtgcggctggtttgcaatggcgaagattgggaagaagccgaacgcctgttcctggtggcggacctgtggccaaacgttcccggcgttacttgaccttcaagtgccgcgcataccagggccgcctcggcacgcgcttgaacaacgcctgcaacccctcgtcttcagcagcaaacgtaatcctaagcgccagcttcatggtctccgggtccatttccatcgagcggcccatctgcaagcccggcgtggtgctgcagccatgggtatccggccccaaccacggatcgccgacttccacccagcgcccctgggcgaaccaatccacgccattgacctcaagccggctgacctcgcctggattaaagcgctcatgggcgcgaaaccaatcctcgatacggtcatcgatccagccgtggaagtgccagaacaccgggtttacatgggatgaaaacgggtcgccaagaaagtcgttctccgccgcgtaccagcgcgcggcaaagtccgacgggtcgcgggcgaacggcaccggcgcgccgttggacgggtcgcggggcaccgaggcccagcgcatgtgcagccagtcgtgcaggcccagttccatctccgaaccgagttgcccgagggtcagtttggccaggtaacgcgggtcgcggtactgggattcccagacctggaagttgctgtgataggtctcggcggccttgatatcgccgacccattgggtgtaatcggcgtcgtccggtgccgaccagccgggcggcagggcaaagccgtcatggttgtcgaaataacgcacaaagcccaggcgatcacgctccagcgccggctgcggctctgggaactgcggccacgatggcaaatcttgcatcgagcgcgcagtgccgagcatatggcggtgcatgaagaaaaaatcgatccccgaaccgttgcggtccttgcgcttgccacgggcgtcgcgctccaggccgcggggcccgggctgccagccgatgccgcgcagggcgtcgcgtttttcttccgagagcttgtgccactgatcacgggtggcgtgccagagctggtgaaacaggcggtgttcgggcgaaatcagccaggccagcagcgtcgggttaaggccgatgcgttgccgggcttcgggaaacagctgtttgtgggcgacaaagcggttgtcccgttcggtcaacgccaaggggcgatcaaggttgaggatctgcccgctgagcgtgctgctgccggcgttggcgaagtcggcccagacttcgtcgagggtcatcttgaattcataggccggtgcgccgttggctgcgtcgcggtcgatcagccgccagtagagcacggcgccgtcgccggtcagcaggtcaccgagcacgcggtagcgcggctcagcctcgccccgcaggttttcggcggtgtccaggtagccgcgcaagccgcgcccgcgcggggcgatatccagcagcacttccaggccgtgcagcggcaagcctttcaggccggcatcgcgaccttccaggcgcaggctccacacgccgcgcaagatgttcgccaaatgctggccggccgtgtcagccagatccaccgtggcctcgcccggggtaatgggcaattcttcttcacgcgtcagctcgcgatgggcataaaaggccgcgggcacggcggcgcctgtcagcgccaggcctgcgatgaacccacgtcgagagatcgtcattgtctaccttaggaaacggcttaatcagagctagaacgttggcggctcgaagaaatttaccggcgcgccgccgaggcctaaatttcccccgccatggctcgttcttccctgatagcaaaggcctcaactgactgagatggcaatgacaaaaccacgttcgaaaaaggcgctgtatatcggcctgccactggcattggcgatcggcgccggggcgggcttcctggcctgggaccattggttccggggcaatgcgggttacccgctggaggtgatcaagcaggccaatgaaatgcaggaccgcctgctgtcgttcgacagccatatcaccgtgccaatggatttcggcaccgccggcaatgaggccgataaagatggcagcggccaattcgacctcgccaaggccgcacgcgggcgcttgtcgggggcggcgctgacgattttcggctggccggaaatctggaacggccccaacgccccgcacaaacccaccgaggggtttgtcgaggaggctcgccacgagcaggaggtgcgctacaagatcatctccggcatggtccgcgactttcccaaccaggtcggcattgcctacacgccggacgatatgcgccgcctgcatggcgagggcaagtttgcggtgtttatcagcatgctcaacgcctacccgctgggcaacgacctgaaccagttggacctgtgggcggcgcgcggcatgcgcatgttcggcttcagctatatcggcaacaacgcctggtccgactcgtcgcgcccactgccatttttcaatgacagcaccgacgcccttgaagggctgtcgcccatcggccagcaagcggtgcatcgcctcaatgacctcggtgtgattatcgacgtgtcgcaaatgtcgaccaaggcgctggaacaagtggcgcagttgagccgcacgccgatggtggcctcgcactcggcgccgcgtgcctcggtggatatcccgcgcaacctcagcgacaaagaactgcaactgatcaagaacagcggcggcgtggtgcaggtggtgggctttcctgcgtatttgcgcccgttgagccagccgacccaggacaagctcaacgccctgcgcgcgcgtttcgacctgccgccgctgcccaacctggccatggccttgatgcctggcgacgcgattatcgccgcctggtccgagcagaagttcggccagtacgccagcgcgctgtacgccattcttgaggaagagcccaaagccaccctcaaggattggggcgatgccatcgactacaccgtacgcaagatcggcattgatcacgtcggtatctcgtcggacttcaacgacggcggcggcatccagggctgggagaacgtcggcgaggtgcgcaacgtcactgccgagctgatccagcgtggttattccgaagccgatatcgccaagctgtggggaggcaacttcctgcgcgtgtgggaccaggtacaaaaagccgccaagccattggccaaccgctaatcaatcagaagcaagtccatgaccgaccgccgtacatttctcaagcaggccggcgtattcgccgccagcctgccgctgggtgccgccctcctcccgcaggccttggcggccaatccggcacctgccgcgaacgacccatggacggggttcaaacagctgttcacccaggatccgaactacctgcatttttccaatttcctggtgacctcacaccccaaacctgtgcgcgacgcgattgaccgttaccgccagcagatcgaccataaccccggcctggcgatggactggggcctggaagaaacctggaaacgtgaaggccaggtgcgcgaatgggctggccgctatctgaatgccacgccgccacagatcgcgctgaccggcagcacctcggaaggcctggcgatgatctacggcggcatcaagctgcggcccgaccaggaaattctcaccaccgaacacgaacactacgccacgcagaacgtgctggattttcgcatcgcccggcaaggcacgcaggtgcgtcgcatccgcttgttcgagcaggccagccaggtctccagcgacgaagtgctgggcaatatcaagcgcaacctccgccccaacacccgcgtgctgggcatgacctgggtgcagtccggcagtggtgtgaaactgcccatcggtgaaatcggcaagctggttgaagaactcaaccgcaaccgtgacgagcaggaccgcattctctacgtggtcgacggcgtgcacggctttggcgtggaaaacctcgacttcccggccatgcactgcgacttcttcatcgccggcacccacaaatggatgttcggcccgcgcggcaccggccttgtctgcgcccgcgacagccagaacacatacgtcacgccgatggtgccgacgttctccgaggacaccaatttcgccaccaccatgacgcccggcggctaccacgccttcgagcatcgctgggccgccgacgaagccttcaagctgcacctgcagttgggcaaggcgccagtgcaggcgcgtattcatgcacttaacactgagctcaaagaccaactgctggcccacccgcagatcgaactggtcacaccgcgcagccccgagctgtcggcaggttttaccttcttccgcgtcaagggccaggacagtgaagccgtggtggcccacatgatgaaaaaccgcgtggtcatcgatgccgtggaccgcgacgtcggcccagtgattcgcacctcgcccggcctgcttaacagctcagatgagatccagcgcttcatgaccttgctgagccaacggttgtgacggctattttttcctttgaacgagatgccccaatgactccatcccgactcaagcccctcaccgccctggcgctgaccgccctgtgcggcgcgctgttgcccagcctggcccaggccgccactgtgcagccgggcaaagtattcaaggactgcaaggactgcccggaaatggtcgtgctgcctgccggcaccttcaccatgggcaccccggaagacgaagtcggccgcgagcccgatgaaggcccgatgcatgaagtgaccttcgccaagccctttgccatgagccgctttcacatcacggccggcgaatgggacagctatgtacgccagaccggggtcaagatcgccaatggcgacgaccgcccaggccgcgaatgcatcgccagcaagccgcgctacccgcaaggcccacgccagccggcggtgtgcatggacatggacgacattaagaactacgtggcctggctgtcgaaaaagaccgggcagaaataccagatggtcagcgaagcgcagcgtgaatatgcggcccgcgccggctcgaccgggcccttccctttccctttcgatgaaggcaagggttacagcatcgccgaacatgccaacacctacggcccggccgatggctacagctattcatcgccggtcggcagctacccgccgaatgccttcggcatgtacgacatgcatggcaatgtttacgagcgagttgccgactgcgaacaccccaactacatcggcgcgcccaccgacggcagcgcctgggtggagccgaactgcgagagctaccagattcgcggcaacgactggggcgaagcgccggtattttcacgctcgggtaaccgcaacaacatctacccgcaaacacgcggcgactggattggctttcgggtagtgcgcgagctctaagccccccacaattgacttgcctatatcaggtagaaatttgcagcaatgactgggggtattgagctcaaggtcgtgtgcaaaccctaaggccagcaccttccaaatgtgggagcgggcttgctcgcgaaagcggtgtgccagtcaccagcagtatcgactgatccgccgccttcgcgagcaagcccgctcccacattttgcctgcgtgcgccgaacaatatctgaagcagacacgctgcagagtgggagctggcttgcctgcgatagcggtcggtcaggcaaataatgtcaaccggcccgccgtcatcgcaggcaagccagctcccacatttgacttgcctatatcaggttgaaatttgcagcaatgactgagggtattgagctcaaggtcgtgtgcaaaccctaaggccagcaccttccacattttgcctgcgtgcaccggacaataactgaagcagacactttccagtgtgggagctggcttgcctgcgatagcggtcggtcaggcaaataatgccaaccggcccgccgtcatcgcaggcaagccagctcccacatttgacttgcctatatcaggtagaaatttgcagcaatgactgggggtattgagctcaaggtcgtgtgcaaaccctaaggccagcaccttccaaatgtgggagcgggcttgctcgcgaaagcggtgtgccagtcaccagcagtatcgactgatccgccgccttcgcgagcaagcccgctcccacattttgcctgcgtgcgccgaacaatatctgaagcagacacgctgcagagtgggagctggcttgcctgcgatagcggtcggtcaggcaaataatgccaaccggcccgccgtcatcgcaggcaagcc

SEQ ID NO: 70 - DNA, 43275 bp, Pseudomonas poae FL10F
tctgtactgctgtaacagtcagaatcgggctttgtccctcctcctcccttcaagtcctagcatacaagcgggcttgcccgcgatgcgatctagaggccgacaatcaggtccctgtaatccccaaccgctgcaaattcagccgtgtctttcggccccttcttgctgtccggttccttcaccgccagcaaatgccccacgccaaactcccgagcactgcgcaagatcggcaaggtgtcatcgataaacaggctgcgggtcgggtcgaagtggatgtcggcttgcagggctgcccagaactgcgggttttccttgggaaaaccgtagtcgtgggagctgatcaaccgctcgaaatacggcgccagttcaatgcgttccatcttcagtgacagcgaatcacggtgcgcgttggtgatcaggatcacgcgcttgccggcctgtttgattgccgccagaaacgtatccgcgtccgggcgcagggcgatcaggtgggcggtttccagcttgagttcgcgcaccggaatgttcagctcggtgctccagaaatccaggcaataccattgcaactgtccggcgttacgctcgaacagcggctgcaactccagctcggccatggcccggctcaccccgtgcagctcggcgtagcgttggggcaagtgctccatccagaaatggttgtcgaaatgcagatcgagcagggtgccgtccatgtccagcaagacggtgtcgatggcgtgccagttcaaagagggcatggtgcgttctcatgtaagtaaagatatccgacacagacaatcggaaaagccacggtatagtaacccgatcacgccaaggagccgcttatgcgccagaaacccaccgtactcgcccgcgaaatagtcgccagtagccgtttgttccgcgtggaggaagtgcaattgcgcttttccaatggcgttgaacgtacctacgagcgcctggtgggccgcggtgccggctacggcgcggtgatgatcgtggcgatgatcgatgatgagcatgcgttgctggtggaagagtattgcggtggcactgacgagtacgagttgtcgctgcccaagggcctgatcgagcccggcgaagacgtgctggcggctgctgaccgtgaactcaaggaagaagccggctatggcgcgcggcagttggaacacatcaccgaactgtcgttgtcgccgggctacatgagccagaagatccaggtggtgctggccaccgatttgtatgaagaacgcctggaaggcgacgagccggaaccgatgcgcgtggagcgggtcaacctgcgcgagttgtcgcaactggcgcagaacgagcaattcagcgagggccgcgccctggccgcactgtatctggtacgagacctgttgacccagcgtggagcgtttaccgcatgagcgaactgtttttaggccacccgtttattgcccctgtgattgagctggcgcgtcaggccggtgaagtgatcctgccgtactggcgtgcggatgtggcggtcacctccaaggctgatgattcgccggtgacggcggcggacctggccgctcaccacctgattctggcgggccttaccgcgctcgatccgagtattccagtgctgtccgaagaggatgcggacatcgaccagagcgtgcgcgcaggctggcagcgctggtggctggtggacccgttggatggcaccaaggaatttatctccggcagcgaagagttcaccgtcaatatcgccctgatcgagcaaggccgcgtggtgtttggcgtggtgtcgatgcccaccagcggccgctgctacttcggtggagcgggcctgggagcctggcgttcggatgtgagcgaagcgccgaagcagattcaagtgcgccaaaccccggcagcgggtgaggctttcaccgtggtggccagccgtcgccataccagcccggaacaggagcgcctgctggacggcctgagcgaagggcttggggaactgaaactggcgaatatcggcagctcgctgaaattctgcctgttggccgaaggcagcgccgattgctacccgcgcttggcgccgacttcgcagtgggacaccgcagcggcccaaggcgtgcttgaaggcgctgggggcgaagtgttggagttgagtggcgagccgttcagctacccggcgcgggcatcactgttgaacccgttctttttggcgttgccggccaaggccgcgtggcgcgagcgcctgctaaacctggctcgttcttaaggcctcaaaaaatcaaaatgtgggagctggcttgccagctcccacagttgtttttgggttgtggcggctagcggtgcaggacgtactggcccgtaaacgccaccgcccgttcctcactgccctcattcacaatccacgtctccagcgtcaaccgcgcgcgcccataacgtttataggtcgcaacaaaacgcttccacaccttctcctccggcgcctggcacaccaccgtcgcatcccgcgtgaccggcagcggataaatgatctgcccttcctgaatcacgatatgcccatcttcaatgccttcttcacgcaattgcaggtgcagccaaccccagcccgccagcactgcgccgcaatacaggctgccgccaaacatcgtgctcttgtggttgatattggcctgcaagggcaggtgcaactgcagttggccgtgttgccagtcgagcaccttgaggcccatttcccgggtgagcgggatgtcgtggtgaaggatggattccaggtaacggctgtcgcggctcatggtggcctcttggcgggtgggcggggtcattcgtcgtcagtgctgtggctggcgctgtcggcgaagttcaggccgtgcttgcgcagtttgtcgtgcagggttttgcgcggtatgcccaaggcttcggcaaggctgcgcaccgagctgtgggggcgcgtcagttcggcggcgatcaggcttttttcgaactgctcgacttgatcgctcaagccgccagtggttgacgtcagcacgcccgcggcggggttgtccgccgtggcatccagtgccaattccagcccaagggcaaaacgctccgctgcattttgcagttcgcgcacgttgcccggccagttgtggcgcaacagcagcgcacgctggcccggttgcaactcgtgcaacggcagaccgtggcggctgctggcttcgtcggcgaaatgctggaacagcatcagcgcatcttcaccgcgctcacgcagtggcggaatgcgcagcggcgcgacgttaaggcggtaatacaagtcggcacggaaacggccctggtcggcagcctggcgcaggtcttccttggtggcggcgataatgcggatgtccagcgggatcagctgattgccgcccagacgctccaccacgcgctcctgcaacaggcgcagcagtttgacctgcacatccaggctcatgctttcgatttcatcgaggaacagcgtgccgccgttggcgaattcgaacttgccgatacggcgtttctgcgcgccggtaaacgcgcccggttcgtggccgaacagctcgctctcgaccaccgattccgccagcgcgccggcgttgatcgccacaaacgggccgctgcgccggctcgacaagtcgtgcaacgcgcgggccaccacttctttaccggcgccggtttcgccgaggatcagcacgtcggcacgcgtggcggccagggcgccgatctgctcgcgcaggcgcagcatttgcggcgagtgcccgaccaggcgcgtgctcaattgctggcggtcgctgagggccaggcgcaggctgcggttgtccagcaccagccggcgcagggccagggcgcggcgcacgctgtcgagcagggcgtcgctggcgaagggtttttcgaggaagtcataggcaccggcgcgcatcgcctgcaccgccagcggcacatcgccgtggccggtgatcaacagcaccggcagctccgggtcctggccgtgcagttcggcgagcagctccaggccgtccatgccgggcatgcggatgtcgctgaccaccacgcccggccagtcgcgggacaggcgcgcagtgaggccggtggcttcgcccagggtcaggactttcagcccggccaggtccagggtctggcacagggcctgacgcaggtgtggatcgtcgtcgatcaacaccacctgaatctggttatcgatactcatacactgcggtcctcggacggttgcagactgacgcccggcgagccggcacgcaatttcaaggttaacagcgcgccaccttccttgtggttggcgaacagtaattcgccgccaaaagcacgcatcagcgtgtcacaaattgccagcccgagcccaaggccctgggtgcgcgtcttggtggtgtagaacggctcgctggcgcggcccagggcttccatgcaaaagcccgggccgttgtcgcgaatgtacaggttgacgccctgttcggtggtttcggcactcagccacagcttgcgcggcgggcctttttcggtgagggcgtcgagggcgttggccagcaggttgccgagcacctggcgcaggcgggtttcgccggcttgcacccacagggtcgcttccggcaggtcgcggatcagctcgacttccatcgaccgtcgccgcttggccagcaacgccagcgcgtcatccagcgccggctgcagggccacgctttccggggcgtgacggtcgcgtcgggcgaacgcacgcaagtgcgcgatgatcgaggccatgcgcccggtcagttcgctgatcagcttgaggttgccgcgggcgtcattggtgcgctcatggtcgagcaaaatctcggcgttctctgcgtagctgcgaatcgccgcgagaggctggttgagttcgtggctgatactcgccgacatggtgcccagcgctgacagtttgccggcctgcaccaggtcatcctgggcgcgcaccagttcctgttgtgcgtgttcgcgctccagcacttcctgcttgaggcgccggttaaggccttccaggtcactggtgcgctcgatcacgcgcgcttccagttcgcggcgggccttggcttcgaaggcgatgcgttccaggtaatgccgacggcgctgcatcatcaagcccagcagcaacatcaacaccagcaacgcggcgccgccgacggccaccacggtgcgcaccgggcggctgatcagcgagcgtggcgcgagaatttccacgttccagccggtttcggcaatggcggtggattggcgcagccaggccgtggtgctcagcgccagtggctgcgggtcgcgcgtggggtagggctggatggcgatgatcgcctggcgttcttcggcggtcagtggccgggtggcgcggaatcgccattgcgggcgcgacgtgaggatcaccacgccgttgtggtcggtcaccagcagttgttcgggggtgttgccccacaggctttcggtgtggtccaggtcgaccttgaccaccagcacgccgattattttgtcgccgtcacgcacggcggccgcgaagaagtagccgcgcttggctgacgtggtgcccaaaccgaaaaaccgccccaggcgcccggccatggcttcactgaagtacggacggaaagaaaaattgcgcccgacaaagctgtcctgtttatcccagttggaggcggcgagggtcttgccggtggtgtccatcaggtacatcacttccaccccggcctgggcggcgacgtccttgagcagcaggttggcgttggtcaggttggtgctgacgtggggcgcatccagcgcggtacgcagggccggcaggtcgccgagaatctgcggcagcacttcatagcggtgcaaggtgccgagcaggttggcgacgtacaggtcgagggtctggcggttttgcccggccagttcgctgcggtaatagcgttcggccaagtgctccagcggccacagcaacggtgccaggcacaacgccaacagggcgaggctgcgccagcggggtcttcgcggaaggggtggagtcatgggagatgcgcctgtggggacaggcgcattatgcctgattaggcgatcaggtccttgggctcggtgttgcccaagcgttcaccctggtagctgccgtcctggacccggcggcaccagtcgaggttgtcgagataccactgcacggttttgcgcaggccggtttcgaaggtttcttccggcacccagccaagttcgcgttcgatcttgctcgcatcgatcgcatagcgctggtcgtggcccgggcggtccttgacgaaggtgatcaggtccgtgaatttttctacgcccgctgggcgttgcggcgccagttcttcgagcaggccacaaatgccgcgcaccacgtcgatattcttctgctcgttgtggccgccgatgttgtaggtctcgcccaccacaccttcagtcacaacttttaacagtgcgcgggcatgatcttcgacgaacagccagtcgcgcacctgcaaaccatcaccgtagaccggcagtggcttgcccgcgagggcgttaaggatgaccagcgggatcagtttttcggggaagtggaacggcccgtagttgttcgagcaattggtcaacagaaccggcaagccataggtgcgctgccaggcacgtaccaggtggtcggacgccgctttgctggccgaatacggcgagctgggcgcgtagggcgtggtttcggtgaacaggtcgtccacgccgtgcaggtcgccgtagacctcatcggtggagatgtggtggaagcggaatgcgcttttggccggctcgtcgagcttgtgccaataggcgcgggcggcttccagcaagctgtaggtgccgacgatgttggtctggataaaatccgacgggccgtcaatggagcggtcgacatgcgactcggcagccaaatgcatgatcgcctgcggctcaaagcgcgcgagcacggcgctgacggtggcctggtcgatgatatcggcctgcacgaactcatagcggctgttggacgcgatgctggtcagcgactccaggttgccggcgtaggtgagtttgtccaggttgagcacttcgtgctcagtgtgttgaatcaggtggcggatcagggcagagccgataaacccggcaccaccggtgatgagaatgcgcatgtcgaggggccttttccttagacggacactgggcgaatgaagcatagcttgagttgtgaagtgggccggtgcaagcgtgggatgcgcgaggggttgattaacggccctgaacaatggcgatatagacgcctaaaaaagcagaggtcgccacaatgttgctcgccacgttgatccatcgtgccagtttgccttgcccacaggtgagtgcggctcaagctgcgcagctacttgagcaacattacgggctgacgggcgcgctgctgtcgctgggcagccagcaggacctcaactaccgagtcgacagcgagcgcggccggtttgtgttgaaaatctgccggggtgactatgcagccgttgagctgcaagcccagcacgccgccctgcatgacctgcaagcgcacgtgcgtgtgcccaaggtggttcgcgcgctgagcggtgaagatctgttgacggtcaccgtcgataatcaagtgttacatctgcgggtactggactatatcgacgggcagcccctgactcacctgccgcacctgggccgcgatgtgatcgcaggttttggtgagctgtgcgggcaagtcagccacgcactcacgcgtttccagcacccgggcctggagcgcacgctgcaatgggacccgcgccacgctcacgaactgatcacgcatttgctggccaccctggagaacctgccccatcgcgaggccatcgagcgcgtggccaggcaggtcgatgcgcgcattcggcccgtggccgagcagctgccgtggcaagccgtgcacatggacatcaccgatgacaatgtggtgtggcagcgcgatgcccagcgacattggcaggtccagggcgtgattgatttcggcgatctgatgcacacctggcgcattgccgacctgtcggtgacttgcgcggcgctgttgcaccatgctgacggcgacccctttgcgattttgccggcgatccaggcctttcacgcggtgacgccgctgcaacgcgacgagctgctagtgctgtggccgttaattgtcgcccgcgcggcagtgctggtgctgagcagcgagcaacagcaacggctcgacccgcataacacctacttattgaaaaacgccgagcacgagtgggaaatcttccatgtggcgacctcggtgccgcttgagttgatggaagtggcgattctgcgttgcgtcggtgaagccctgtcgcctatggccagccaggatttcgcgcccttactgccgggcctggtggggcgcgaatttgcgctgattgacttgggcgtgctcagcccgcatttcgaggccggcaactgggagcaacctggcattgaccggcgcctgctggatgaagcggcggcggtgcacggtttggcggccagccggtatgggcaataccggctgtcacgtacccgtgccgacaccgctgtcgaacccgacacgttgcccctgcacgtggaattgcatctgccccatggcaccgtgctggaagcgccctttggcgggacgttgcgtcagggcgtcgatggtttgctgtgcgtgcatgatgccccgttgagcctgcgtttatggggcgtcaccaccacgttgaagccgggcgcagcgctggtcaaagggcaaatcctcggcgaagtgcatgggccgctcaccgtgcagctttgccgcgccgaccttgaaccgccgctgttctgcacaccgacccgggcacacgcatggcaggccctctgcccatcgccggcgacgctgttggggctggcctgtgatgcagaacccgagctggaccccgaggcgctgctggctcggcgcgacgccagcttcgcccgctcacagaagcactattacgttgacccgccgcgcatcgaacgcggatggcgtaatcacctgatcgacatgcagggccgctcttacctggacatgctcaacaacgtggcggtgctcggccatggccacccgcgcatggcggcggtggcggcacggcagtggtcgctgctcaacaccaactcgcgctttcactacgcggcgattgccgagttttccgaacggctgctggcgctggcgccggagggcatggaccgggtgttcctggtcaatagcggcaccgaggccaatgacttggcgatccgactggcgtgggcctacagcggcgggcgcgacatgctcagcgtgctggaggcctaccacggctggtcggtggcggcggatgcggtttccacctcgattgccgataacccgcaagcgcttagcagccgcccggagtgggtgcacccggtgaccgcgccgaatacctatcgtggtgagttccgtgggcaggacagtgcgccggactacgtgcgaagcgtggaacacaacctggcgaaaattgccgctagtaagcgccaattggcgggttttatctgcgaaccggtgtacggcaatgccggcggcatctccctgccgccgggctatttgcagcaagtctatgggctggttcgcgcccagggcggcgtgtgcatcgccgatgaagtgcaggtgggttatggccgcatggggcatttcttctggggctttgaagaacaaggcgtagtgccggacatcatcaccatggccaagggcatgggtaacggccagccgttgggcgcggtgatcacccggcgcgaaatcgccgaggcgctggaggccgagggctatttcttctcgtcatcaggcggcagcccggtcagctgccggatcggcatggccgtgctggatgtgatggcggaagaaaagctgtgggaaaacgcccaagtagtgggcgggcatttcaaggcgcgcctggaagccctgattgatcgtcacccgttggtgggtgctgtgcatggttccgggttttatttgggcctggaattggtgcgtgatcggcagacgttggagcccgccacagcagaaaccgcgctgttgtgtgatcgcctgcgcgagctggggatttttatgcagccaaccggcgactacctcaacatcctgaagatcaagccgccgatggtcaccaccaaacgcagcgtggatttctttgtcgacatgctgtcgaaggtgctggatgagcatttgtgagtagtcgattgttatcggctataagctgtcatatttgtaattcatgatattttattgctgttaaagccgatttttatccgttataaagtcggccttcacccccattcggagtcctgaacgccatgaccaccttgcacagcacaccccgcgccgatggcttctacatgcccgccgaatgggcgccacaaacgcaaacctggatgatctggcccgagcgccccgacaactggcgcctgggcggcgagccggcgcaggccgcccatgtggcggtggccaaggccattgcgcggtttgaacctgtgaccgtcgcggtgtctgccgagcagtacgaaaatgcccgtgcgcgtttggacgtgcccaatatccgcgtggtggaaatgtccaacgacgacgcgtgggtgcgcgacaccggtccaaccttcgtgatcaacaacagcggcgaagtgcgcggcgtgaactgggatttcaacgcctggggcggctttgacggtggcctgtacgcaccgtggaaccgggactcgcaggtgggcggcaagatcctcgagatcgaacgcgccccgcgctatcgcaccgaaggttttgtgctggaaggcggttcgatccatgtcgacggcgaaggcacggtgatcaccaccgaagagtgcctgttgaaccgcaatcgcaacccgcacctggatcgcgcggccatcgaagcggtgcttcgcgacaacctggctgtggataagatcatctggctgccggacggcctgttcaacgacgaaaccgacggccatgtggataacttctgctgctacgtgcgcccaggtgaagtgttgctggcctggaccgatgacccgcaagacccgaactacgagcgctgccacgccgccatggacgtgctgcaaagcagcactgacgcccagggccgcgcattcacggtgcataaaatgccgatcccggggccgctgtacgccaccgaagaagagtgcgccggtgttgaaccggtggacggcagccaggagcgtaacccgagcgtgcggctggccggctcctatgtgaacttcctgatcgtcaacggcggcatcattgccccgagcttcgatgacccgctggacagccaggccaagcaaatcctgcagaacctgtttccgcagcacgaagtggtaatggtgccggggcgtgaactgttactgggcggcggcaatatccattgcctgacccaacaacagccagccccgcacaaaaactgagtgcagttgtaacagcgtttgagcgatacctgagcgctacctgtttatagcgcgcatagcaagcccgcggccccgcacggccgcgggcttttttgtgtccgagagcctataaacacgggagattggcatagctcttgtatcggtgttgccacagtaacccaaggtgatgactgcacagttctgtcacaaaccttgagtaagttagccgctcacgcagtaggagagagcgctgaaatgaatgccgatatcaacctgatctacacgcgcccgttccaccccacgcgggtcaatggtgatgcgatccatgcgctggcgctctggttgaaggcaaacggctcgcgacaggtgaggcaacagcctgaccttcgcagcgtgatgagtgaacgttacccggcggggttgttcagtgaggatgaagtgcgcgcgttgtgtgagttgatgcaaagctgaagcacactgggatttaaatgtgggagctgcatgtggtggcaagcgggcttgtagtggcgagcgggcttgttgtggcgagcgggcttgttgtggcgagcgggcttgccccgcgttgggctgcgcagcagccccataagcgtcaacgcgctcgtgcagatgtattgcgtcgtcagatttcagggccgcttcgcgccccaacgcggggcaagcccgctcgccacgacaagcctgctccacagttagatagtgatcaccttagaaactgtaggtgcccgtcaccaccaaactgcgcggctcgcccggctggatctgcgccacactggtcgccgactcgtaatagtgtttgtcggcaatgttgttcagcgccgcgcgtacatcccattctttctggcggaacccggccaatgcatcccaacggccataacccggcagcaccacggtgttgaggctgtcggcataacggtcgcccaccagcgtcaaaccggtttccgcgtaccagcccatctccggtttccaggtgataaacaggctgccattgcgcttggccacatcgctgacgcgcttgccttcaaagccgttgttgtccttctcgaccttggcatcctgcaggccgatgccgccgcgcacgtaccaattgccaatgattttgccggtcgccgtcagctccacaccgcgtgagcgctgaagaccgctgagcagggtgatggtacggtccagcgggtcgctggtgcggcggttataaagctcaagctcgtacacggcgagggtggtgctcaggcggtcgtcgagccagtcgcttttcacgccgatttctttctggcgagtcagctcggggctgaggtcgttaacgctgcccgcggcattcggcgtgatgccgatcaggccgccgcctgccggcgagaaggttttactccacgaggcatagaacgagtgatgctccagtggcgtccacaccaggccgacgcgcgggctggtgctgcggctttcgacgtcttgctgggtgttgagcaccttgctggtggtgtccacttcaaagtggtcataacgcaggccagccaacagttgccactgatcgttgaggcgcaattggtcctgcacgtacaccgcgcgactttcgacttcagtgtggttgtaactggaaaggctcatgcgcccggtgtggctcaggtggcgattgggctggttgaggtccaggctcggcacggcctggccgccacggttgacggcggtcgcggtgtacaacttcgggtcgcggcgctggctgccaagctcaaggccggtgagcaggcggtgttccaggccgaaggtgtcgaaaccaccttccagctcaaggttgttgaagacgttgcgggtggtcaggtcttgctgccagcgctggcgcgtgactttgttggttttggcgtcatagccggtctggtaagtgttatcgaagtcgctgtcgagcttgaacacgccgagggtgtggcgcagttgccagttgtcgttgagttcataggcgagcttggagcgcaacgactgggatttgtcgtcgatgtagtcgcggctgtcgaaataggtggtgctgcggctcacgtctgccgggcgcccgttgacgccgggaatgccacggtccggtgtgcggttgtagcggctgtattcgtattgcaccaaccaattcaggtcgggcgtgagctgccagctcatcgacggcgcaaacagtttgcggttgccgctgacgccatcgcgaaagctgttgctgtcttcgttgcccatgttcaggcgcaagctgatggtgtcggtggggtcggtgctgaggtcggcatacaggctgcgcaggtcattgctgccgccttgggcttcgatgctggatttatggcctgcggtgggcaatttgctcacgcggttgacgatgccgccttggccgccgcgcccgtacaacaccgccgccgggcctttgagcacttcgatgcgctcgatgttatgcaggtcgcgcacgtactggctgtcgtcgcgaatgccgtccaggtagaagtcgttgctcgcgtcaaaaccacggatgcgcaggctgtcgaagcgcgtgtcggcgccgctgcttacgttgggaataccgctgagtgcctggcccaggtcattggtgccgtaagagcgcaggctctcggtttttaccgaatcaatcgcctggggcacataacgcaccgaagtggcggtgcgggtggcggtgttggtctctttgacgcgtgggtcgtcttcgtcaacttcggtgctgatcgacgttgtcggcaagaccgtggcggcgcaggcaaaaccagcagacagcagaacagaaagcccgagggtgatgggcgtcagacgaggggcaggcatgggggaatgtatccaaaaatgttgggagggaaaaatcgcgctaatggtaatgctttgcatttgcgcgcgttatgtattcccaaacatgtaggatgtggaaagtgttacacgatgtgttttcttgacgagtcggaggatttttcaggctggcgtgaaggctctggaatgcctggcttagaatttttttgactaaatacagacgattcacgaaattgacacatagttcaacccgcgcataggattgcgcccaacgcctgtggctaaccgccatgactcatccaataaaaaaaggcctgcggcagttcagtcgtccgcaggccttcttttttctggaaaaagtcgacaccagaaaagcaacacggagcctggtgtcacagcgcgtactcaaccagtaataaggaatataaaaaaatgttgaaacaacggatgagtctgatcgctctggggattttgagcgcatcgacagtcatggccaacgaccaggagcaatccaagggtttcgttgacgacagccacctgaacatcgccgcacgtaacgcctacatcagccgcgactacaaaaacggcaagcaagacaaagctgaatggggccaaggcttcatcggcaagttcgaatccggcttcacccaaggcaccgtgggtgtgggtgtggatgtgatcggccaatacgctatccgtctggacggtggtaaaggtcgcagcggcgctggcggtatcgacttcttcaagcaaggcgacagcggcgcagcagccgacgacctggccaagggcggcgcagccgtcaaggcgcgcatctctaacaccgtgatcaaatacggtcagcagatgcccgccgtacctgttctgcaatacgacaactcgcgcctgctgtcggaaacctacgagggcacctcgatcgtttccaaagaaatcgccggtctgcaattggacgccggtcacttcaccaaggaagcacgcaagagcgccgaaggcagcgacagcggcggcctgaaaagcatcaactacctgggtggtagctacaaattcaccgaaagcctgtcggccgcgctgtatgcctccgacatgcaggacgtgctgaagaagcaatacgtcaacgtcaactacgtgctggccctgccagagaagcaatcgttgacctttgacttcaatggctacaaaaccaagctggaccgcagcttcgccctggaaaaccaaggtgatgcggacgcccgcgacaacaaaatctggagcctgggcgctacctgggctgtcggcccgcacagcttcaccattgctcaccagcgcagcaccggcgacaccggctacctgtacggcggctaccgcaacgctggcggcatcggcgacggtggcaacaccatcctgctggccaactcctactggtctgacttcaacggcaaggacgagcgctcctggcaagcaggctacggcctggacttcagcgccttcggcgtgcctggcctgacctacaacatcgcttacgtgcgtggcaccaacattgacgacggctccaaccgcggcagtggcaccgagcgtgaaatcttcaaccagttcaaatacgtcgttcagagcggcccagccaaagacctgagcctgcgcgctcgtgcgtcctggttgcgcgtctccagcaacgccagcgactacaacgtaggcggtaacgaagtccgtctgtttgccgactacccgatcaacgttttctaactgatttggcgtcgcgcctggttccaggcgataaaaaaccccgactggttcggggtttttttatgcgcgcctgctggcctctgacttgttacaccgcagtactaatgaagtactcggcgccctctttatcgccttcaggcgcacgcctaaattagccccacgtgccagcccatcatcccgatggccggccactggagccactgccatgccctttgtcagcctgagcatcacccgtgacggcgttaccccggagcaaaaagcccaggtcatcgccgagttcaccgaaaccctcgaacgcgtcctcaacaaacgccccgacctgacccacatcgtcatcgaagaagtcgacaccgataactggggttacgccggtattaccaccactcaataccgcaaacagctcgcggagaaaccgtcatgagtgcgcccgtcaccatcgacttcgtctccgacgtggtctgcccgtggtgcgccctgggcgccaccgcgctggaacaagccatcgccaacctggcgggcgaagtgaaggttgagctgaccttcaaacccttcgaactcaaccccgacatgccggccgagggcgaaaacgccgtcgcccacatgatgcgcaaatacgggcgcagcgctgaagaagtcgccagcggcaaaagaatgctgatggagcgcggcgaagccatcggcttcaccttcgacctggaaaaacgcagccacttctacaacaccttcgatgcacaccggttgttgttttgggcgttgcaacaaggccggcaaatcgagctgaaaaagacgctgttgcgcggttttttcaccgatggccagaacgtcagcgaccacgaaaccctgacgcgtttagcagcagaagcagggctggaaatcgaaggcgcccgccaggtgctgggctctgccgcctacgccgatgaagtgcgtgagctggaggcgttctaccgcgagcacggcatcaattcagtgccggccatggttctgaatggccgccagttggtctccgggtcgcaatccgtcagtgactacgaacagatgctgcgggaaatgtccgcagcggctgcgtgaaccatcccattttctagatagaggtttcatcatgagcaattcgaaaaaagtcgttgtgattaccggcgcatcccaaggcctcggcgcggctgcggtgaaggcttaccgtgagctggattaccgtgtggttgccacctcgcggtcgatcaaaccgtcgacggatccggacattctcaccgtggccggcgacatcgccgaccccgcaaccgccgagcgcgtaatccgcgaaggcgtggcgcgttttggccgcatcgacagcctgatcaacaacgccggtatcttcgtcgccaaacccttcaccagctacacccaagaagactacgtaaatgtgctggccgtgaacctcaacgggttcttctacatcacccaactggcgattaccgagatgctcaaacagggcgccgggcacatcgtcaacatcaccaccagcctggtcgaccacgcgattgacggcgtgccctcggtactggcttcgctgaccaaaggcgggctgaactcggcgaccaaatccctggcaattgaatacgccaaacgcggcattcgcgtgaacgcggtaagccccggaattatcaaaacgccgatgcacggcgaagaaacccacgcggccttgggcagcctgcacccggtcgggcacatgggcgaagcgagtgatattgcccaggcgattatctacctggagaacgccgggtttgtcaccggtgagattcttcatgtggacggcgggcaaagcgcagggcactgatcaaaaaacgccccggcctgtccaggtcggggcgcgccatcaactacctatccagatcacctgtgggagccgggcttgcccgcgatagcgcccgaccggccacctcattcacatcttattgctcagcattgcagggcgacgccaacaccttcaccgcatcatcaatcaccgcctttaccatctcctgcaaataatgcgacgcccaggcataacggtccgtctccttcgtcatcgccgcatcctctgcgagctgcttggcgacgtggagcaaatcggaagcgtggttcagggcttcgagcagaggaacgccactgttcacgcggaacagaggttggtcggagtgaaaggagaaaggggtgacgccgagagtggttaacgcggggggatttgtagcggtcattggtgagactcccatatcgagtgagagctaccacgttcgttgtttcaacgaatgcgtggcgcttttagcgcctgcatcaaaagcgggttctcaggcccggtcactgcattggcagggacggagtggaggttagcgtggcggggagaggggagcaatcaggaaaatggattggttgttttgtggcctatccaagcggcacggattggctgcggatgaaattatttgttttatggaaacgccataattattgcccagccataattttgcataaaggctgaagtgcgggcggaaacagcggaggggctgcagccgtctatttcatagactgacctgggttgaaaccccagaaacaacaaagccctcacattgctgtgagggcttcgtcttatatggtgccggcaccaggagtcgaacccgggacctactgattacaagtcagttgctctaccaactgagctataccggcgtgttagggcgacgattatagcgattggcaagcttctgtaaacccctgaattctgactatttttgcagaagtgaaggttttttggcgaacacggctttttcgtcgtctcgggcaccgcaaatcagctcaattcccgtcgccgcagtcgtcggtgaatttcatgtagttcagcacctgcgtctggcccttcgaatccaggtacgtcatccgtgcatttactacaccgcagccagagcgggcgtcttcggtagtcgacagcacgcgctgaatgtccggcttgtggctattgtcggcatgcgcggtgaatgcacaggcaagcaggctggcggcgatgagggttttccagttattcgggttcatggtggtggcctctgaggcttcaatggtggggtgaggtcattgaatgcctgggaggtatctgggctgtgtcgcggggcaggtgttttgtctcgttgtgtatggcgtgcggctatctgtacttgctgatacgaagcggcctcaccgccggaagcgcattagccaaatttggttaataaacgtacaggaatcggttaatgcattgttttgaaagtagatatttacccataggcgataggccataaaattggcgccatgccgctcatctgaaagcatttcgatacaaacaccaaaatactgacaccatcatcgtgatatcacacaatgcggccctcatttaatcagcggtttcaacagggaggagcagtcagtggggcgtgcagatcacatttcaaaactatacaccgcgctgggtgcacactctttaagcgagccgtgggtggctgagcctttgcaacggttgctggatcagttgaaccaaggtgctgcgccgtcgcccgaggcggtcgaagccccgcgtggggcgcgctgttcggacgcgtcggcagcaaaagttgtggtggtggtttcagccacgggcggggtggggcgcagcacgttggccgccgcgattgccaacggtttgcagcgccagggtaatccggcgttggcgttggagctggacccgcaaaatgcactgcgttatcacctgtgtccgggcgttgatctgcttggcttaggcgcaaccagcctgctcaaccaaacctggcaagccttgcccaaacgcggttttgccgggtgccgtgttgtcgcctttggtgaaactgacgcggtgcagcaacagagcctgaatcgctggctggggcaggatctcgaatttctcagcaagcgtcttgccgggctcggtttgacggggcaggacacggtggttatcgatgtgccggcaggcaacacggtgtacctgagccaggcgatgtccatggcggatatggtgctggtggtggttcagccggaccccgcttcgtttcggcgcttggcgaagatggacgaggtgctcgcgccgtacctcgccagtgaatcggccccgcaacggttttatgtgatcaaccaggtcgatggcggccatactttcagccaggacatggccggcgtgttcaaactgcgtctgggcgatgcagtgctgggcaccgtgcgccgtgatcctgcgttcagtgaggcgcaggcctacgggcacgacccgcttgaccctgcgctcgacagtgttggcagccaggatgtgaataccttgtgccattcactgagggcgcgcctgcgttaaaacacaagcggccattaatttgactatttaccgtttgtctaaaaaacaaccagcaaaaacatcaaaataatgacacttcctcacgcctgtcacagaatgcttcactgagacgcccataataagacctgcggtaagtgcctgcttgccgaccttcacgtctttacgctgcgtcgtgaggagctggctatgagccttagcgaagaacttctggcgttgttcggcaagaacgtcacccatgatgcccaaggcattaatgcgcgcatgcactttttcggcagcgtgcctgctgacgaaaacacccatccccaatcccaattgactgatattcccgcgttgcgcccgaaagtcgtcgcgttagtgtcgatgaatggcggcgttggccgcagcacgttggccacggcgttgagcagcggtttgcagcgccatggcgaatcggtggtggcgctggacctggacccgcaaaacgccttgcaccatcacttcggcgtgagtgccgcgttgcctggtatcggccgcaccagcctggagcatgggcagtggagccctttacagcagctcggtttcgccggttgccaggtcatcacctttggcgatatcgacatccagcagcaggaaaaccttgagcgttggctcaagcatgagcccacctggctggctcaacggcttgcgtcgttgggcctgaacgagcggcaaacggtgatcatcgatactccggccggcaacaacgtctatttccatcaagcgttgaatgttgccgatgtggtgttggtaatcgtgcaggccgatgccgcgtgccttggcaccctggatcatctggatgtgctgctcgctccgcaccttgaaggccagaacccaccggcggtgcaggtggtggtcaaccaggtggatgagagcaaccccttcagtttggacatggttgaggcgttcaagcagcgcctcggcaaagcgccgctggaggtgcaccgcgacatggcgatcaacgaggcgttggcgtttgccgcagacccgttggacaacgtggcgaaacgcttggcgagtgacgatatcaatgagatttgccgggtactcaaggcgccgaaagcaaccgcctaaagtgcggtttatacgcttatcgccagatgcttatgcacaatcggttggttgggcctgtcacgaaacagccattttgtggagccgttctcaacacgctgcaactgcctgttttgtgtgcgttttattttgtgaacaaaaaatgaccagcgtggcttttgccctgtagcactgataactacagcttctgtaaagattccatcaacagagttatccacagggcgcgtgtaggaatttttgccctctaatcgcgctcagccaacaccatcacgttgcgcggagtcagcgccggttcgcagaagctgcctatatcgactttgtagccctgttccaccaaaaaaagcgaccggtccagcaccagccacatttccaatgggcgccgaaacaggccgcgcagcaactccaggtttcgtacttgcgccaggcgccgccagccgtgtgcctccagcgccgcccaatcctgttcacctgtggataaacctttgaggcttgccagctcctggcagtactcggcgaagggcttacccagccagctggcgggcagggaaggcgtgggcaggtattcgtcgaggccgcgcacgtgtcgctgtaattgatcgaagcccaggcgccgtgccatggaggtgtcgcgctgttgacgcactcggttgccggcggtgacggtttcgctgagcggcaggcccaggtcatcaattgacagcttcagtggcgacgcgcgcccggcgccggacaggggctgatagctgtcggcgttgatgcggttgtaacagcagggcgccagcgccagttgcttgcacccggccgcgctggccagttgcagcagccgcacgtgcaggtcgccgcaggcatgcagggcgacgggcgtgtgttcggggctgatcgtcacatccgccatcacgtcttgcaggcgatggctggcgggtaagccgtggtggtcgctcaaggcctggcctgcggcgatcagggccgggtcgtattccagacaggtcagctgctggtcggcgtgcagcaggcggcggccgagatggcctttgccggcgcaccagtccagccagtgcgtaggcttttgcgcgaaattcaatgaagcgccgaaggcttcgatctgttgccacttgcggcccggcacgtcgacgttgagccgatggcgagcggatgccagcgcctgtgtcggtaacttatccacagcactgagctgcagcgcctgcgcagccagctgtggaaaaggcgccggcgcctgtaagtcatgggggcggttgtgactgttttcggcgtcggccagcgagcgctggcgcagccactgggccagctcgggatgctggggttcccagggtaaatgcagatgggtaaagggccgtggtcgccacagcccttggtgctcgatcagaaacgcatccagcgccgcgaagcgcgcctcaacgtccctggcaagcatcgacgcgcagccagcgttcgagcagtttgaagccgcgtaccaggatgtaagccatcaacagataaaacagcccggcggcgaagaagatctccaccggcaggtaggtgcgcgcgatgatggtacgcgccatgccggtcagttccagcaaggtcacggtactggccagggcgctggccttgagcatcaggatcacttcgttgctgtacgccggcaggccgatgcgcgaggcgcgcggcaggatgatgtagaacagcgtcttcggcttggacatgcccagggcgcgtgctgcttcgatctcacccggcgggatggcctggatggcgccgcgcagaatctcggcgatataggcggcggtgtgcagtgtcatggtggcagtcgcacaccagaacgggtcacgcaggtacggccacatgaagctctcacgcacagcgtcgaactgcgccagcccgtaatagaccaggaacaactgcaccagcaacggcgtgccacgaaagaagaaaatgtaggcgtagggcagggcgctcacgtaccagcggcgcgaggagcgggcgatgcccagcgggattgccagcagcaggccggcgatcacggcgatggccaccagttccagggtcagcgtcgcgccttgggccagtttgggcagccacttgatgatcacggcccaattcaggcccaggtcgaagtgcgacagccagctgtagtcaccgctcattgggtgctccttgcaaagccgcgggcggcgcgtttttccaggaagtgcatgccggtcatggccagcacggtgaggcccaggtacatgaatgcggcgaccataaagaaggtgaacggctgtttggtcacggtcacgccgatctgcgcatggcgcatgatttcttcaaggccgatcactgacaccagcgcagtatctttcatcagaatcatgaacaggttgcccaggcccggcagcgcgatgcgccacatctgcggcatgatcaaccgggtgaaaatccgaaacttcgacagccccagcgccacaccggcttcgcggtggcctttgggaatggcgaggattgcgccacgaaacacttcggtggcgtaggcgccaaagcacaggcccagggcgatcaccccggcagcaaaggcacttagagaaaggtcggggttaccgaaaaactcccccagcgcacgcatcagattgaccgtgccgaaataaatcagcagtacccacaacagttcgggaatgccacgaacgatggtcgagtatgcaccgccaagccattgcaatggcttgtacggggaggttttgccgagggcaccggcaaggcccagcaccagccccaggcataaagccgtgagcgccagtttgacggtcatcagcgcgccggcggcgagcgccgggccgaatccgtagagatcgaaattcatggtgttttcatatcgcggcaggcattgctaaaagccggcgcgccctgtcgagcgcgccgggcagaccattcagatcattcgatgctgaacgggaagtacttgtcgttgatcttcttgtaggtgccgtctgccttgatctctgccagggctttgttcaggcgttcgcgcagtgggtcgcccttgcgtacggcgataccgatcttgtcgctttctacaaccgggtcgcctttgaactcataggccgaaccgtctttgctcttgagccattcgtactgcacgtatttgtcggcgaggatgccgtccaggcggcccgacgtcaggtcgaggtaggcgttttcctgggtgtcgtagagcttggcagtggtgtccggcagcttgtcttccaggtaagtaccggccaacgtcgcgcgctgtgcgccgatgaccttgcccttcaggtaatccgcgtcggtcttgaagtccgcagtcgccttaggcgcgatgaattgcaatttgttggagtagtacgggtcggtgaagtcaacggcctgcttgcgctcatcggtgatcgacagcgaggacaccaggaagtcgaacttcttggcgttcagggccgggatgatgccgtcccagtcggacacatacacttcgcacttctcgactttcatcttcgcgcacaaggcgtcgccgatgtctttgtcgaagccgacaacgttgccgctggcgtctttattgttgaagggcgggtaggccgcttcgatccccattttcaaggtttctgccatggccgtggcgctgaacgccatcgaaacggccgcggccagaaggaattttttatagttctgcatgcatgttgctccgttagcggttgctggacatgaattgtttgcagcgcgccgaaagcgggttttcaaacacctgctgtggcgatccttgctcttcgatcaggccttggtgcaggaacaccacttcactggagacctgacgggcaaagcccatttcatgggtgaccagcagcatggtgcggccctcttcggccagcgcgcggatcacattaagtacttcctggaccatttccgggtcaagcgccgatgttggctcgtcgaacaggatgaccttgggttgcatcgccagggtgcgcgcaatcgccgcccgttgttgctggccgccggacagttgcgcggggtaggcgtggcgcttgtcagcgatgccgaccttggccagcagggcttcggccacttcgatagcctcggccttgctctggccgagcacgcggcggggcgcctcgatgatgttgtcgaggatgctcatgtgtggccacaggttaaagttttgaaacacaaaaccgatttcgctgcgcaggcgattgatctgcttgccgtcagcggccgtcagctcgccgttttttgcggccttgagcttgagctcttcgccggcgacgaggatctgcccctggtgcgggttttccagcaggttgatgcaacgcagaaaggtggacttgccggaaccggaggaacccaggatcgagatcacgtcgccgtcgcgggcggtcagcgagatacctttgagtacctccagctcaccatagcgtttatgcaagttgcggatttcaagcgcgggcgcggcctcggccatgtgcggtcctcattgtgttcagtgcgttcttgctgttgggccgccttcctggcgaggcgccaagctagcatagcggtcagatggcagccaacagcgctacggacggttaacaggtggtgtgcggcagggtgtcgcatcagcgcagcagcgtgtcgcgccatcaacaacctaacagacgtttgaacccgataaatccacaggcttcgcgtaaaaaagggcgcgatggtgccagctttggccgggtgttggaagggttaaccgggcaaacggtccttatcagcccttttatggagcgtcacgtactttttgtgtgtgtttttggtgcgcatttacgtatttaaagtgagtcgcacggtaacgctatagcggaatgccattgttctcaatgacttgcgacggctgatcaattgtcctgcagcccgcgtcaatcgcggctctgtaatattttggcgcaaatcttgcgtaaaaaataaagaacgccctgttggattcttttcacgagaaagactgcaggccgggcggaccgttttcgcaattcctcgtaaaggtgtgtcaatgagtagtacgcaaagctccaatgacctcgaacaggggctcaaaccgcgtcacgtcaccatgctgtcgattgccggcgtcatcggcgctggtttgtttgttggctccggccacgcgattgccgccgccggccctgccgtactgctggcctatgccgctgcgggtacgctggtggtgttggtaatgcgcatgctcgccgagatggcggtagcgtcgcccgacaccggttcgttctccacctacgccgaccgcgcgatcggtcactgggccggtttcaccatcggctggttgtactggtggttctgggtactggtgattccgctggaagccaacgctgcagcgaccatcctgcacgcgtggttccccgacgtggccatctgggcatttaccctgatcatcactttgctgctgaccgcgaccaacctgttcagcgtgaagaactacggtgaattcgagttctggtttgcgctgatcaaagtcgtggcgattgtgggcttcgtggtcctcggcctggcggcgattttcggcttcctgccgaccagccaggtcagcggcgtttcacacttgttcgacacccaaggctttatgcccaatggcatgggcgcagtgttggcagccatcctgaccaccatgttctcgttcatgggcactgaaatcgtcaccatcgctgccgctgagtcgaagaacccgggccagcaaatcaccaaggccaccaactcggtgatctggcggattggtttgttctacctgctgtcgatcttcatcgtggtgtccctggtgccatggaacgatccgacgctggccgcggtaggttcctaccagactgtgcttgaacgcatgggcatcccgaatgccaagctgattgttgacctggtggtgttggttgccgtgaccagctgcctcaattcggcgctgtacaccgcttcgcgcatgctgttctcccttggccgtcgcggtgacgcaccggctgtggccaagcgcaccaacaagagcggcacgccttactgggcggtgctgctgtccactggcgcggccttcctggcagtgttcgccaactatgtcgccccggcggcagtgttcgaattcctgctggccagctccggtgctatcgcattgctggtgtatctggtgatcgctgtgtcgcaactgcgcatgcgccagaagcgtacggcggcgggtgagaagatcgtcttcaaaatgtggctgttccctggcctgacctatgcggtgatggtgttcatcgttggcacgctgaccatcatgttgttccaggaagcgcaccgggtcgagatcatcgcgaccgggatcctgagcttgctggtggtactggcggggttgtttgtggcgagccgtcgcaaggcacagaagctaggcgccgcggtactcaattgagggtgtgcggtgtttgatacaccgccattcaaatgtgggagcgggcttgcccgcgaaagcggtgggtcagtcgccagatgtgctgactgatctaccgccatcgcgggcaagcccgctcccacatttggttttgcgtcagtctgctgagctggcgagtgcttgggaggcggccacgtaatcggcttgaaacgccggcgactcaatccacgccaacgccgccgcttcatcgtcggtgtccgtcgcccactgccgatactcgatcagtgccgcgaggataaagtcggtagcctcttcttcgccttcctgctccagcaccagtgccagcaacgggtgcgccaggaacaccgcgcacagcgcctgttggctaatctcgcccgctgcgcgcatctccacaaacagctcagtcaaatccaccgactcaaggtcaatgcggctgtcatcaccggcaaacgcatccggtttggtcgcaacgctgcgttgggtacggttctgcttggccttggcctttgcccggtgggcacgtttttgctgcttgttcggcgaggccatgggctcacgtcctttgttcaggatctgggtggggtattgaagcgcaggttgggggaaatcccaagggattctaaatgcgctggccgggcgtgccgtgcgccaactcgccctgttgcagccacgccagcgcaatcggccacaaccgatcctgatattcactgcggaaaaatgcgaaatgcccgacggctttttcgccgatttcttcgggtgcgatacgtaagtgagtacacgcgctgccttcgaaatagctcaataaccgctcaatagccgccaccgtgccgaacggatcgtcggtgatgctgatggccagcaattgtgcctttacgcgggcaaacggcagctcaaccagggcgcgcccactggggcgtgtttcatatttgggcgtcggcgtgccccagtcgcgtactacgccagccggcgtgtcttccagccagcccaggcgcttgccggggaagtatccgcacagcgcagtcaccagcggcatcaccacatgccatttaccgaacatctgccagcgcccgctcgctgcataatcgcgccaatacgcaaactgcgcgccgacggtgacaattcgccgaatcaccgcgcctgatgcccccagccctgctgcacaaccgccaaaactgtgaccgaccacatctatcggctgccccggaaactcccgttgcgcacgctgcaacatcgcctcgaaatccagcacaccccaatccgaccacgacgccttgaagccgcgtaacgagccactgcgcgactcgccgatgcctcggtagtcgaaagtgatgacgtcgaagccgttggcaaacaggtaatcggcgaagcgtgagtagtggcggcagcgtacggaagtggcggcgttgattattacgactgggcgctcgaagtcggtgcgtaggtgccgccaggtaaagccgccaatgaggtagccgtctgcggcgggctccttgaagggttcgctggggcctggtttggaggtgatggcaggcctttgcgcagaggcttcattcacattcattgtttctctgcctgtgtcggttttttatttttttggtaacagttgttcagtttgccagtacttgtgctctctccggcagggtcactaatgttcggggccactgataaagccatacatccgagaggaacgacagccaaccatgcaccgattagactggcaggcatccattacggaggtctctatgagtattcccctttctcctatcgtttcagagtttgaaacagaagagcaggccgcgagctatgaccgttggtttcgtgccaaggtgcaggcttcaatcgatgatcctcgcccaagtattccgcatgatcaggtcatggccgagatgcgcacgctgattgagggattggattcaaatactgacagtgctgcacgcccgccaagaatatccctgatgcgcgtaccggttttgctgctcgacctcgagtgagtagatgcataggcttgcgccttcgcaaaccgctagagcgtcttcatgacccgcgacaccctcgaacacaaccagatccccatctatttcgtctccgtcctgctcgcggctgcgttcggcgtgtttgcacccacgtccgcccacggcctcggcattttggtcacgcccgccatcgcagtgctgatgtacgccatgttcctgcaaatcccgtttctggatctgcgccaaggcctgggcaacaagcgcttcatcgcggcattgttgctggccaatttcattctggtgccgttgctggtgtgggtgctcacccgtggcctggtggagcgcccggcgctgctggtcggtgctctgctcgtattgctgacgccgtgcatcgactacgtggtggtgttcacccatatcggcaagggtgattcgcggctgatgctggcggcgacgcctgtgttgttgttgctgcaactggtgctgttgccggtgtacctgggttttatgctgggtgggcaatccgccgtggtggtggcggtggggccgtttgtcggggcgttcgtgtggttgattgtgctgccgatgatgctggcggtgctgaccaccgccctggcgcggcgctcaaggctgatgggggcgtggaataacgcctgggcctggttgccggtgccggcgatggcgctggtgctgtttgtggtgattggctcgcagatcacctcggtggtgcgcgatatcggtgtgttgctgccggtgattccggtgtatgtggccttcctgctggcggcgccgctgatgggggcgttggcggcacggttgttcgcgttgcctgccgcggcggcgcgggcggtgacgttcagtgcgtcgacccgcaactcattagtggtgctgcccttggcgctggcattgcccgacgacgtgcgcgggctggcggccacggcggtgattatgcaaaccctgcttgagctgatcggcgagctagtctacatccggctgattccggcactggtgtggcgcgctggtcgataaatccataaattttcgggtttgttcaggcgctattcaggggttgagtcggcaccatggagtcggcgcagcctacctgaaaggacattcgatggatcaccgcagccgttttcgcctggagtccctgggcattttcctgatcgctttgctgctgttcacctggggcatctgggacgagcaaccccaagggtttgacgggcgttgggcgctgttcatgcaggaaatgtttcgccatggcgcgagccttttccctaccacctatggccagccgtaccctgactatcccggcactgcgaccttcttcagtttcgtctttgccaagttgtttggcgcgccgaaccacctggcgaacgtgctgccgacggcgctggcctcggcgggcatgaccgccttggtctatcgcctgctggcgccgttcagcaggccttgggcattgctgacggtgttgctcacgctgctcactactcaattgctcgataagtcgcgttcggtgtgcctggacctgatgatcgcgctgttatgcgtgggcagtttctacctgctgcacagtggcgagcgcctgggttcgcgggtgaggcagctggccgtgttccccctgtttgtcctggcattcgcaattcgcgggccgctggggttgatcgaagtctgtggcgtggggtgcgtgtattgggcaatgggccggcccggggagcgggtcaagcaggtgctgattcacggtttcgtggggttggtgttgctggtggcgtgctggtggatgttgatgaagctggcgcggttcagtggcggcgatgcctttgccgatgatgtgttcaggatgcaggtcagtgggcggcttgatgagagtggcgagccgttctacttctacttcaagctcagcttgtaccgttacttccctgtggtgccgctggcgttggcggccttgattgcgctgcgccaccgctggtctgagcggtgggtcagtgacgaagtgcaactggtcgtgcggctgggtgcctgtggcttgatgatcttgctcgggttgtcggtgccgcacttcaaacgcgcctattacattctgccgatggtgccgatgtttgccgctgtcgcggcctatgggctgctccaggcgcaaaactggctggttggcgtgcgccgctgttatgaatggcttgtcgcagcgctgccggcgttgtgcgtggttgtgctgtttgtgtgtcggcatgcctggcagaagcacgggtattggcctgaggtttcgttgccgtggttgattggcgcgctgctggttctgcaagcggcggcgttgattgcctggcggcgcccattgcggttggtatggctcagcgcaatcgcattggcggcgcagtggctgctgctggtggtggtgatagatccggccaaagacctgcagttcgacacacgccggtttgtcagccaggtcgaagcgctccgagagtcgcagccgggcccgttggtgtttgtcgacctcggtcgcgacacctgggcaatacgctacatgatgaacctggaccacgatgagcagccgctgtttgtcgcgggcaatgagcttgaaaagctggcgacgttgccccggccatcctgggtgattgtgccgcgtaaagaggctgtgttgttgaaagggacgtcaatggaacagcaggcaccaagcttcgaaggtcggctgaatgacaatccgctgatggtgtttctgctgaaataggcaagtgcctatttgcactggtaaccctcgggcatcgtgacggtgtagttgcgctgcacgcggtcctggaagttcaggttctgcaggccctgttccaccaggaaagcctcgatcttggccgcctggcagtcttcgttgtaagacatcacccggagcagatacacggcgcgtctgctcacctcatcacgcgcagtggcggtgaaggtggtgagcgtggtgtagccggtgcgctccgaggtgcccactggcccgtaggtggtgtttggcgtgctggtgcaggtcagttggtcttctttcttcttgttcttcttgcactgagtggtggtgctggttggcacctggccgtactcggtggcggtgtagcggtaagtgacctgcttgctgtcgacatcaaggaggatggtcattttgatcggtgcatggttcttgggcagcgtggtgtcggtatacacctcatgaaagccctggtccttcatggcactgaccatgtcccgcaggtagtagcgggcattcagcgtgctttgcgcactgccgccgacggacgtcgtcaccagcacggtagcttgtcgatcaaagtgataatccggatccggtgttgcgttgatcgagacatccatttgtgtggcgcagccactgagcagcgccgtcagcagcaacagcgcgcagaacaagtaccgggtcatctaaacactaccttgcagcaaaaaattcagtaacagctatacgattgagccgcgcgataaataacccccggccactaaatcgcaggcaataaaaaaccccaaggaatcatcttcgcttggggtttttcggtattagtggtgcccagagacggaatcgaaccgccgacacggggattttcaatcccctgctctaccgactgagctatctgggcaacggggcgcattaaacgggtttttcagggggtcgtcaagcaagttttcaaaaaatatttaattattaccgtcgcttacgtgccgaccccgatttttgatcaattattgagcaggcggcacgtagccgtcggccttggcgtaatcctcgccggaaaagaacttgtccatctcgccttgcaggtatttgcggtcttcaccgttcatcatgttcagacgtttttcgttgatcagcagtgtctggtgtttttgccagtcggcccaggctttggcggagacgttgtcgaaaatgtcctggccctttgcgcccgggaacggtgcgcgctccagagcaggcaattcttcgtggtacttgcggcacatgatggtgcgggtcatgacggaactcctgcgttcaatacttcagccgcgcgcttcagcagttttttcaccggggcggcaaggcccaggcgcggcggggtggcgaggttataccagagccagtcggcctcggtcacgtgatgggcggattcctcgacctggaccagccagggttcgatggccagctggaaatggctgaaggtgtggatcagccccggcagttcatgcggtttgcccagttcgagcgcgtgctggttagccaggtgttccaggtcttgcaggtcatcgagctccggcaagctccacaaaccgccccacaggcccgtggaagggcgacggtaaagcagaatcgcgccctcggcattggccagcatcggcatcagcgtgcgcttttgcgggatggtcttgcgcggcttggggatcggatagcgcgtctccaggccgagcatgtgggcttcgcagcctttttccagcgggcacaataggcagctgggtttgctgcgggtgcagagcgtggcgcccatgtccatcatcgcctgggtgtaggcgttgacgcggtcgtgcggcgtgaagcgttctgcggtcgcccaaagctgcttggcgaccttgggctcgcctgggtaaccctcttgcgcagtaaagcgcgccaacacgcgcttgacgttgccatcgagaatcggcgcacgcaggcccatgctcaggctggcgattgcgccggcggtggacaaaccaatgccgggcaattcagtcagtttttcgacgtccttgggaaactcgccgccgtattcggcgacgacgattttggcggtcttctgcaggttgcgtgcgcgggtgtagtaacccaggccggtccacaggtgcagcacttcatcttccggcgcagcggccagggcttcgaccgtcggcaaagaagccatgaagcggtcgaagtaattcaataccgtgctgacctgggtctgttgcagcatgatctccgacacccacacccggtaaggcgtgatgccctgttgccagggcaggtcatggcgaccgtggcggtcgtaccagtccagtaccgcctgcgaaaactgctcgtttctcatcgcttgaacaggcccttcagagcgtctttcaactgtgggttgaccttgtcgagcttctcttcaagtttatcgctgagcttgttgccggctgccttgatggcgacttgggtcaagccgtccttgtccaggcggcaggccttggcgcccagttccagcgggccacggcagcgcagcggcacttcgatgccctggaagttggagccgacctggcaagccgggtccggcacgtcgcgcttgtcgccttcgacgataatgccgacgcggtagtccatgcccagcacgcgcaggtcgacgtcaccgttgccgttgaccgtcaggccggggatgcgcactttcaggtcggggttgctggccacgccgttacggaaggtcaagttgccgcgcagttcctggaatggcgtgtccttgccctgcggcgtgctgctcagggtcttgcggttgagcagggcgatgccggtgcacagttgctgttcgaggttggcattgagcagcacgccgttattgatcacaaagctggcggtgccgttgaggctgtcgatcagcgccttctggctgttgccacggccgttgaggttgctgtccagagtgacctggcctctcaccggcggggtttgcccctgggcttgcaggatgcgctcaaccggcacttgcttgatgtgggtttgcagcgccagcaccgggatgtcctggcgcacatcgagcgtgccgttggcctggaaggtgccgttgtagaggccaccgctcagggtgtcgagcttgagttggccgtcgatgccggacgctttgagtgcggcattctggatcggcagtttgctcagagtcagttggccgaaggccaggtcggcgttcacgtccaaggtgcgcaggcgcgtcaatggcagcagtttgtcggtgctccacgcgcctttggtcggtgcatccggcaggggggtggtgccaccggcggccatcgcgcccgcttcactgttctgcacttcggcctggcgtgcggcggccgcacctttggcggtctcggacttggccggcaggtagtcgtcggcgttgaaggtgtcgcctttgagctgcacgcgcagggcttgcttggcgaaatcttcgacagcaatgcgaccggtgaaggtgctgatgtcgagtttcaagttcaggtcttccagcgccacgctggtaggcgtgcccttgaggcggctgaccagttcgactttgctcaggctgcctgcggccatcggcggcagcgggtggccgacgctgtcgaggaacttggccaggtcaaactgggcaatggacagggcgccactgagctgcggggttttgtccaggtcgttgaccttcagttcacccagggcgcgcagctggttggcggagagcttgaggttggtccactcggcaatgttggccgcctggtccaccagcaattgaccttgggtggagaaggtcacggtcttgccttgcagcggctcgccggtggcttcgccgctgagcttcatgtcttcgaactggtagcgcttgagggcgcgctgaatgcgcaagttgccattaagctcggtcttgactcgcatcagcggctggttgctgcccaggaacgcggtgagtttgagcggaatgctcgcgccttcatgcacggcgccggcgctcagttgaatgctttcggcgctgtactgcttgccggtttgctcgtcgttgtattcaacgcgggcgttgttgagggtcaggctgtcgatgtccaggcggatcggctttggcggcttctcgggttccggctcggcgggctgctgcgccgcagcgggggcgccggcggtggtttcggtcacattcttgccgatgtcttcccagttgccgtggccttgcttgtcacggttaaggcgcaggttcaggccttcgacacgcacgtcgctcatctgcacttcgcggcgcaacagcggcagcacgcgcaccgacaggccaagcatctgcaggtcggcaaacggttgggtagggttggtcatggtcgcgacgctggcttcgtgcaattccaggcccagccaggggaacaggctccaaccgatatcgccattgagcgtcagctcgatgtgggccttgtcgcgggcaatctggcgaatctcgtctttgtaatcgttgggatcgaagaggtgggtcagggcaaagcccagggccacaatgatcagcaacagcccgagaagtaccagacccaggattttgccgaacgctttcatgggcgagtccttgtatgtcgatttcaaaatttagccgcagagtataacgcccgacggcctgcgtcagttcacgcatcgttacattgtatccagcgtcggcaaaatcggattttgccgtcgaacaaatcagattgcgtgaaaaaggtgatatcagtttggtttttctgtcatccactggtgctaatctgcgcgggttcgtctgtcgtctgcgacacagcgtcgcgctcaaaaggagctttactcaacaacaacggccaacgctctgcgtgcaaggccgagggagagagcgcctgacggacacatactaataactgggggaaacaccaatgagcacaagcactgcggctggcaatactgccgcacagcctgcgttcctgtccaaggagcgcattatcgccaagccggggttcaaccgctggctggttccaccggccgccctggccatccacctctgcatcggcatggcctacggtttctcggtgttttggctgccactgtccaaggcgctgggtatcaccgcaccggttgcctgtgcgccggacatgagctttatcgcgcaagtcttctcgtcccagtgcgactggcccatctccatgctgggctggatctacaccctgttcttcatcttcctgggctgctcggcagcgatctggggcggctggctggaacatgccgggccacgtaaagccggcgttgtatcggccttgtgctggtgcggcggcctgttgatctcggcgttgggcgtttacacccaccagatctggctgatgtggatcggctctggagtgattggcggtatcggcctgggtctgggctacatttcgcccgtgtcgaccctgatcaagtggttcccggacaagcgcggcatggccaccggcatggcgatcatgggcttcggcggcggcgcaatggtgggtgcaccgttggctgcagcgctgatgggccacttcgcttcgccgacaagcgtgggcgtatggcagagcttcgtggtcatggccgtgatctacttcgtgttcatgattggtggcgcactgtcctaccgcgttccgccgacaggctggaagcctgagggctggaccgccccggcggaaaaagccaacaacgcgatgatcacccatcgtcacgtgcacgtgaacgtggcctggaaaaccccgcaattccgcctggtgtggctggtgctgtgcctgaacgtatcggccggtatcggcatcctcggcatggcgtcgccgctgttgcaggaagtgttcggtggcaagttgctgggtaatggtctggcgtttggccaactggatgccggtcaactggcgtctatcgctgcaatcgcggccgggttcaccggtttgctcagcctgttcaacattggtggccggttcttctgggcgtcgttctccgattacctgggccgtaaaaatacctacttcgtgttcttcgccctgggctttgccctgtacgcgctgattccgaacctgggacacctgggcaacgtcgcgctgtttgtggccgcgttctgcatcatcctgtcgatgtacggcggtggttttgcgacggtcccggcctacctggcggacctgttcggtacgcaaatggtcggcgcgatccacggtcgcctgttgaccgcttgggcggcggcgggcgtgcttggtccggtgttggtgaactacctgcgtgagtatcagctgagcattggcgttccgcgcgctgcagcgtatgacatcaccttgtacatccttgcaggcctgctggtgctgggcttcatctgcaacctgctggttcgcccggtggccgacaagtacttcatgaccgatgcgcagctggctgccgaacaggcgctgggccacgacaaaggggctgacgccacgacttctctggagtggaaagcctcgtccggcagcgtgccaatggcgatcgccgcctggctggtggtgggtattccgttggcgtggggtgtgtgggtcaccctgcagaaaaccgcagtattgttccactaacaccgctgtagtcgggtgggcccggttcctgtgggagccgggcttgtgtgggagctggcttgcctgcgatagcatcgcctcggtttaacaggaataccgaggcgtctgcatcgcaggcaagccagctcccacacttgtatgcacatgtctatccccgacactccatcagtcttatccccttcgatgtttctgtttggcgcccgcgcccctataatggctgcctttttcgcccaatgattttgcggagctggtgatggccgaacgtaaggcgtccgtcgagcgcgacactctggaaacccagatcaaagcctcgatcaacctggatggcaccggaaaggcccgatttgatatcggtgtcccttttcttgagcacatgctggaccagatcgcccgtcatgggctgatcgacctggatatcgagtgcaagggcgacctgcatatcgacgaccaccacacggtggaagacgtaggcatcaccctcggccaggcatttgccaaggccatcggcgacaaaaaaggcatccgtcgctacggccacgcctatgtcccgctggacgaagcgctgtcgcgcgtagtcatcgacttctccggccgcccaggcctgcagatgcacgtgccctacacccgcgccaccgtgggcggcttcgatgtcgacctgttccaggagtttttccagggtttcgtcaaccacgcacttgtcagcctgcacatcgacaacctgcgcggcaccaacacccaccaccagatcgaaaccgtgttcaaggctttcggccgcgccctgcgcatggccgtggagctggatgaccgcatggccgggcaaatgccctcgaccaagggcgttctgtaatgcagacggtcgcggttatcgattacggcatgggtaacctgcactcggtggccaaggccctcgagcacgtaggcgccggcaaggtgctgatcaccagcgatgccaatgtgattcgcgaagccgaccgggtggtatttcccggcgtcggcgcgattcgcgactgcatggccgagatccgccgcctgggctttgacagcctggtgcgtgaagtcagccaggaccgtccgtttctcggcatttgcgtgggcatgcaagccttgctcgatcgcagtgaagagaacgacggcgtcgactgcatcggcctgttcccgggccaggtgaagttcttcggcaaagacctgcacgaagacggcgaacacctgaaagtcccgcacatgggctggaacgaagtgcgccgcaccgtcgaccacccgctgtggcatgaaatcccggacatggcgcgcttctacttcgtgcacagctactacatcgccgcgggtaacccgcgccaggtggtcggtggcgggcactatggcgtcgactttgccgcagcgctggccgaaggctcgcggtttgccgtgcagtttcacccggagaagagccatacccacggcctgcaattgctgcagaacttcgccgcgtgggatggtcgctggtaaatggccaggaaaccgaagttgccgatcttgaacctcacgcccgagcaggagagtgaggctaccctcaagatcaagcgcttcatggaggaccgcttcgagctcaagctgggctcgttcgaggtcgccgagattcttgaactgttcaccaccgaagtggcgccgcactattacaacagggcgattttcgacacgcagacgctccttaaagaaaggttcgaaagcatcgaaagcgacctgtggtcgcttgagaaaccctgatttcccaagcattgctgaatatcgaataaggtttgccagatgctgattatccccgctatcgatctcaaggacggcgcttgtgtacgcctgcgccaaggccgcatggaagactccaccgtgttctccgatgacccggtgagcatggctgccaaatgggtagaaggtggctgccgtcgtctgcatctggtggacttgaacggcgccttcgaaggccagccggtgaatggcgaagtggttaccgccatcgccaagcgctacccgaacctgccgatccagatcggtggcggtatccgctccctggaaaccatcgagcactacgtcaaggccggcgtcagctacgtgatcatcggcaccaaggccgtgaaagatccggcgttcgtcgctgaagcctgccgtgcattcccgggcaaggtgattgtcggcctggacgccaaagacggtttcgtcgccaccgacggctgggctgaaatcagcaccgtgcaagtgatcgacctggccaagcagttcgaagccgacggcgtctccgccatcgtttataccgacatcgccaaagacggcatgatgcagggctgcaacgtaccgttcaccgctgctctggcggctgcaacgaagattccggtgatcgcctccggtggcattcacaacctgggcgacatcaaatcgctgctggacgccaaggcgcccggcatcatcggcgccatcaccggccgcgcgatctacgaaggcactctggacgtcgccgaagcccaggcttactgcgacgcctacaacggctgaggactgaccatggcgctggccaaacgcatcatcccttgcctggacgtcgacaacggtcgcgtggtcaagggcgtcaagttcgagaacatccgtgacgccggcgacccggtggaaatcgcccgtcgctacgatgagcaaggtgccgacgaaattacctttctcgacatcaccgccagcgtcgacggccgcgacaccacgctgcataccgtcgagcgcatggccagccaggtgtttatcccgctgaccgtgggcggtggcgtgcgcacggtgcaagacatccgcaacttgctcaacgccggtgcggacaaggtttcgatcaacaccgccgccgtgttcaacccggagtttgtcggcgaagccgcgcagcacttcggttcgcagtgcatcgtggtcgccatcgacgccaagaaagtctccggcccgggcgaaaccccgcgctgggagatcttcacccacggcggtcgcaagccgaccggcctggacgcggtggagtgggcgatgaagatggaaggcctgggcgccggtgaaatcctgctgaccagcatggaccaggacggcatgaaaaacggcttcgacctcggcgtaacccgcgccatcagtgatgcgctgggtattccagtgatcgcctccggcggtgtcggcaacctgcagcacctggccgatggcgtgatcgaaggccatgccagcgcagtgctggcggcgagtattttccactttggcgaatacaccgttcccgaggccaaggcctacatggcggcgcgcggtatcgtcgttcgctaaacgctgctggacaccatggcaggcgcgcggcactctctgcgcttgccatggattccggtaaccttcatgttcaaacacctgctgctcgccctcgccagtacttccatgcttttggcaggctcggcccgtgccgaagagccgtccgacgcctccctggtgttgctgacggaaaacttcccgccctacaacatggcgaaaaacggcaagaacttcgccagggacgagaacatcgaaggcatcgccgtcgacatcgtgcgcgagacgttcaagcgtgccggcatttcctacaacctgaccctgcgttttccttgggagcgaatctacaaactcgccctggaaaaacccggttacggcgtattcgtgatggcgcgcctgccggatcgcgaagccctgttcaaatgggtcggtcccatcggccccgacgattgggtgatgttggccaaggctgacagcaagatagagctggcggaccttgaacacgcccgtcgctacaagattggcgcctacaagggcgacgccattgccgaaaccctggagaagcagggcctcaatccgctggtggtgttacgcgaccaggacaacgcgcaaaaactcatggatggccagatcgacctatgggcgacgggtgatcccgccgggcgttacctggcgcgtcaggtgggcgtgacggggctcaagaccgtgctgcgcttcaacagcgcccagctctatcttgcattgaacaaagatgtgccggatgagctggtagccaagcttcaggccgcgctggaccagttgcgcaaagacggcggcgtcgacgagatcatggcgcgttacctctaaactggcaaaaatcactgtgggagctggcttgcctgcgatagcggtggctcagttggcctattggttgctgacagactgctatcgcaggcaagccagctcccacaggtttaactgcattccaggtgcagcccagtagtgcacggcgaaacacggtcaaaatgtgggagattctatggttgaggggcaaccctcaaccaatcttcggttggtattcggtttgtcctttcatcaag

SEQ ID NO: 71 - DNA, 39785 bp, Pseudomonas poae FL10F
ggcccatcgcggcggcccccgctccaaagccggagtgagggcacaccgagcctaggcgaggtgccgagtggtggggcgaagactttttggttacttttgtgtctttacaaaagtgacccgccgtaagggcggaaccctaagccgccgttaccgcagcaacggatatgtactcacactatctaatcccatccaacattcaatccttatactccgtatcagtccgctcaagctgccgaatcaacgcattccaatgccgcgccacgcccggcccggccccgttgctgaacaccttggcctgctcttcaaccttggccaccacttcagccggcggaaagatcaactccgcattgccgcccgcctgcgccgcgacctggatattgcacgcacgctccagcccctgcagttgctggaacgcatgctcaacactcacccccgccgtcaacaagccgtggttacgcaggatcatcacgctcttgtcgcccaagtccgccaccaatcgctcacgctcgtccaggtccagcgccacgccttcataaccgtggtacgccacacgcccggaaaacgcgatggaatgctgggaaatcggcagcagcccgtccttctgcgccgacaccgcaataccgtcacgggtatgggtgtgcagcaccgcttgcaagtcagggcgcgcaccgtggatcgcgctgtggatcacatacccggcgtagttgatgcccaggcctgtagggtcgtcgacgatagtgccgtcgaggtcgaccttgaccaggttggacgcactgatttcatcgaacaacaagccgaaggcattgatcagaaaatgctcctccggccctggcacacgggcggagaagtgcgtgtagatgtggtcggtccacttgtacaacgccgccagtcgataggccgcggccagtttgacgcgcacctcccactcttctggcgtcacacgctggcgaacattgctggagatgctggagatcgaggtgacgctgctcatggcaaaacttcctggatggccttaaggacttccagtcagcctaggggaagctgaaaaataataaaaagcacattttaatctaagctaattattatatttttttatgatagttcccacgctccgcgtgggaattcagcccgggacgctccgcgtcccacagggtgacgcagagcgtcacaggagacattcccacgcagagcgtgggaacgagcattaacgagcatcaacagggatcaggcggcattacggattttgtgcaacgacgccgccaccagcttgccaaacgcatccaccggcccttgcaggttgccgagaaaatgcggatagatcagccacaaatccatcaccggcttgaagtccttgagcggcatgaccgccagttgatcacggtgagcgctgcgttccagcagcgggcgtggcaccaggccaaggcccagaccgtcggccaccaagcccaactgcaattcagtgccgaaggtttccaggttcacccgcagcgccaggccctgatcggacaaggtgcgctgcaaaccggcacgaaaaccgcagccgtccgggttaagaatccagccgttctgatacacatcggccagcttgcagggcttcttcggcagctgcgccttggcgcacaccaccaccagttccatcttgccgatggactcgccaacgatgttgtcggggaagatcttgcccgccggaaacagcgccgccgctgcgtccagctcgccgcgttcgatcttgccgaccagttggctgccccagccggtggcgacctgggcgcgcaggtcggcgtattcggtgcgcaggtgtttgagcgcatccagcagcaccacgtcgccgatggtctgcggcacgcccaggcgcaacacgccggtgggcggcgcgtcggtggccaccagttcgcgcagggcatccatttcacgcaggatcagccggcattgttcataaacccgtgtgccgatcagcgtaggcttcaggggtttggtgttacggtcgaacagctccacacccagcgcctgctcgaagttctgcacgcggcgagtgatggccggctgggtcagttgcaacgactcggcggcatggctgatggactggcaacgaatcacttcgacaaaggcatcgatatcgtcaattttcatttgggccgcacatagagaacagtcattaagatgtgtatcaagcatagttgccggaacgctgcctggatagcccgcgctgtgatcgataacgtctaacgctattcagaccggttctaaattaccttcggctataagctaatcattaaaaaatagcatattaactataaacattatgcttagataaactcatcgacatgcacctatcaaagcaccggatggaattgccatgaccctggcccgacaccccgagagactcagagcctttataggcgccctggcggaactgattgacggcaacccacgcgaaggtgacctgctgcaccgtggcggcaagctgctggcgcaactggtcaaccacgatgactggctccccgacgactacgcccaacccgatcccgagcgctaccagcaattcctgctgcatgccgattcgcgccagcgcttcagcatcgtcagctttgtgtgggggccggggcaaagcacgccgattcatgatcaccgtgtgtggggcctgattggcatgctgcgcggctcggagttttcccaaggctttgagcgtgcgcccgacggccgcttgatcgccgaaggcaagccggttcagttgctgccgggccaagtcgaagccgtgtcgcccaaggtcggcgatatccatcaagtcagcaatgcccaccgtgaccaggtgtcgataagtattcatgtgtacggcgccaatatcggtgccgtgcgccgcgcggtgtatcaacccgacggcagcgagaaactgtttatctccggttattccaacgcctacctcccgaacatctgggatttgtccaaagaaaagagccctgccctatgaccaccgtatcgaaccgcagctttgcccagattcgccaggccctgttggaccgtgaagaagtcgccctgatcgacgtgcgcgaagaagcgccgtttgccgagtcccacccgctgttcgctgcgaatatcccgctgtccaaactggagcttgaggtgtacgcgcgcattccgcgccgcgatacccaggtcactgtctacgacaacggcgagggcctggccgaacgtgccgccgagcgcctggttgcgctgggttacacccaggtcagcctgcttgaaggtgggttgaacggttggcgcgaagccggtggcgagttgtttatcgacgtcaacgtccccagcaaagcctttggcgaactggttgagagcgagcgccatacgccgtccctggccgccgaagaagtgcaggccctgctcgacagccaggccgacgtggtggtgctcgacgcgcgccgcttcgacgaataccagaccatgagcattcccaccggcatcagtgtgcccggtgccgagctggtgctgcgcgcccgtgagctggcgccggacccggccacgcgcattatcgtcaactgcgccgggcgcacgcgcagcattattggcactcaatcgctgatcaactccggcatcgccaacccggtgtcggcgctgcgcaacggcaccatcggctggaccctggccgggcaaaaactcgcccacggccagtcgcgccgctttgcgcccacccgtgaagaacaccgccagatcgccgcccaggatgcgcgccgcgtggccgataaagcccgcgtcggccgcgccaccttggccgacctgcaacgctggcagcaggaacccacgcgcaccacttacctgttcgatgtgcgcaccccggaagaattcgaagccggccacttgcccggtgcgcgctccacaccgggcggccagctggtgcaggaaaccgaccacgtcgccagcgtgcgcggtgcgcgcctggtgctggcggatgacgacggcgtgcgcgccaatatgtccgcttcctggctcgcgcaactgggctgggacgtgcatgtgctggacgacctgcaagcggcgcatttcagcgagcacggtgcctgggtcgccccggtgccggcgccgcagcaagccgaattgatcagcccgcacaccctggcggagtggctcacccacggcgacacggcggtgctggatttcaccccgagcgtcaattacgtcaagcgccatatccccggcgcccactgggccctgcgtgcgcaattgcccgaggcgctggccaaggtgccgcctgccgaacgttatgttctgacttgcggcagcagccagctggcgcgcctggccgtggccgaagtcgaggcgctgaccggcaagccggtgttcctgctggaaggcggcaccacccactggatcgccgaacaactgcccttggaagccggtgaaacccacctggcctcaccgcgcatcgaccgctaccgccgaccgtacgaaggcaccgacagccccaaggaagccatgcaggcgtacctggattgggagttcggcctggtcgaccagttggcccgcgacggcacccacggtttctatgtgatctgacccaccccaacctgcctgcacccgccctgattgcgtatgacgatggtccgcatcgagtgagatgccgctaacgcggcctgacagcacccgatctcatacgcaacctctactgtgggagctggcttgcctgcgatggcggtctttcagctggcatttttctggctggtacaccgccatcgcaggcaagccagctcccacaggaaacagccccatgcctgcatctcgctttcaatatggcgctgtcgccctcagcctgctcgccgtaatcgccccagccatggcgagtgggctttttgcgtgggcacacagcgcatcacctaatgcaataagagaataatcaatcaacacataatcaattattttaataattaacatataaccaaaaagaacttcacagcgagtttttatgggaataacgtgaagccacacaccgaccccttctccaggcggaggtagccaacctcttatccgttttgcctggagcctgcatcccatggtcatttccaccccgttcaaacgcctgctcctgggcactgccctggccttcggcctgatctccagcgcccacgccgccgacctgcaaccgctgcgggtcgccaatcagaaatcgacgatcaaggcgctgctggaagtttccggcgagacgaagaatgtgccttacgaaatccagtggtcggagttcccgtccgcctcgccgttgggcgaagccttgaacgccggcgccgtggatatcggcgcgctcggcgatgcgccttacgtattcgccctgggcgccggggcgtcgctcaaagtggtcagcatcatccacgccgaagggcgcaacaccaccgccctggtggtgcccaaggattcgccgatcaagacggtggccgacctcaagggcaagaaaatcgtcaccgggcgcggttccatcggccactacctggcgatcaaggccctggccagcgccgggctgacgaccaaggatgtgcaattcattttcctgctgcccgcagaatcccgcctggtgctggataacggtacggtcgacgcctgggccacgtgggacccttacaccaccgtggtcaccgcacaaagccaagccagggttctggtcagcggcaaccagctgctgagcaatcacctgtacttcgccgccacccaacaggccatcgccgacaagcgcgttcaactggacgactttgtcgcccgtgtcgatcgcgcttatgcgtgggccaacgtgcaccccaatgaatacgccgccgcccaatccaggatcaccggcctgccgttggccgtgcacgtggaggtggccaaggacacccacctgagccccgtcatcattgacgacacggtgatcaaaggccttcaggccacggccgacacctatcaacaagaaggcctgctgcccaagcgcatcgacgtgtcccaaggcttcgacaagagctttaacgccgagcgtttccccacttcccaagcatcgcgctaagcaaggagcagaacatgagcaagccacgtcacttgaaagcacgccaattgaagctgggggctatggtgcacggcgtcggtcacggctggggcgaatggcgccacccgcaggcgcaaccgaatgccagtacgaattttggcttctacaagcagcagaccgaattggccgaaggcgccaaattcgatttcgtgttcatcgccgacagcctgcatatccacgccaaatccagcccgcattacctcaaccgctttgagccgttgacgattctttcggccctcgccgcgctgaccacgaacattggcctggtcgccacggtgacggtcagctacaccgagccctatcaagtggcacgccagtttgcgtccctggaccacatcagtggcggccgcgccggttggaacgtggtcacttcatggctcagcggcaccgccgataacttcggcaaggccgaacacccaccgcatgccgtgcgctaccgcatcgccaaggaacacctcaacgtggtcaagggcttgtgggattcctgggaagacgacgcctttacctacaacaagcaaagcggcgagtttttcaccccgcaaaagctccacgcgctgaaccacaaaggcgagttcttctcggtcaaaggcccgctgaacatcgcgcgttcgcgccagggccagccggcgattttccaggccggcacctcggaggacgggcgcaactttgccgccgagcattccgatgcgattttcgtgcacgtcgaaaccctcgaagaaggcaaagcctactccgccgatttgaagcgccgcgccaaaggcttcgggcgtgacgccagtagcctgtcgatcctgccgggcatccgcccgattgtcgggcgtgatgccgccgaggtggaaagccgctatcagcaggccgtggacctggtcaccgtggaggacgccattgtcgcccttggccgcccgttcaacgaccacgatttcagccaatacccactcgacgcgccattcccggaactcggcgacctgggtgccaacagccagaaaggcggctccgaccgcatcaagcaactggccaaggacgaaggcctgaccctgcgcgaagtggccctgcgcttctcgcggcccaagcgcgactttgtcggcaccccggagcaagtcgccgatgcgatccagacctggttcgagtccggcgccagcgatggtttcatcatcaactcagtgctgcccgatggcttgcagtacttcaccgaactggtggtgccggtgctgcaacagcgcggcctgttccgtaccgaatacagcggccataccctgcgcgacaacctcggcctggatgtgccggccaaccgctacagcgttgctaccgaggtcgaagaacaacaggaggcgctggcatgagcgaatccctcaaccaccaattggccgaactgcatgccgaacgtgtggccacctgggcgccggcggcgttgcaggtcaatatcgaccagcgccagcgcctggtggatgaagcgcaacccgatgcgtatgtgcaggttggtgatgagctcgacccgttcaccctgctcaatgtcgacggcggcgaactgaacctcgacctgctgctggccgacggcccggccgtgctgattttcttccgctttgccggctgcccggcgtgcaacatcgccctgccctattacgagcgccagctctacccacgcctgcgggaatggggcgtgccgctggtggcggtcagcccgcaagtgccgcagcggctggtggagatcaagacccgccatgacctcaaactgctggtggccagcgacccggacaacaacctcgggcggcgcctgggcattctctacagtttcgacgaggcctcgcgcaaagccgcattggccaagggcagcagcatcggcgaaaccaccggcacggggacatgggaattaccgcagccgacggtggtggtgatcgcccaggacggcaccgtagcgtttgtgcaagtcagcccggactggctggtgcgcaccgaggcagagccggtgttgcaggtggtggagcgcttgttgggcgaacagcctgtgcgtatcgctatctaagaccacaattccaatgtgggagcgggcttgctcgcgaaagcggtgtgtcaggcaaccgattcattaactgaaccaccgcattcgcgagcaagcccgctcccacatttttgaccgagtacattctgatgacgtcccaaccttccttacgctccgtggaagtcgccaacttcgaagccttgctcgaacgcctcagcgccgagctggcgagcactgcgcacctgtacgacgacagcggcgccttcccccacgaaaatttcaagcggctgcatgaccacggcctggtcgcgctcaccgtgcccaaggccctcggcggcggcggcgcgagtttgccccaggcgcgcaaggcgatcagcgcgattgccaaaggcgagccctctaccgcgctgatcctggtgatgcagtacctgcaacacacgcggctgcaagacagcaagacctggccccaacacttgcgcgtgcaggtggctgaagacgcggtgcgcgacggcgcgctgatcaacgccttgcgcgtcgaacccgacctcggcacgccggcccgtggcggtttgccggcgactaccgccgtgcgcaccgccgagggttggcgcatcagtgggcgcaagatttactccaccggcagccacggcctgacatggttcagcgtgtgggcgcgcagcgatgacgccgacccgctggtgggcgcctggctggtgcgcaaagacagccccggcgtaagcatcatcgacacctgggaccacctcggcatgcgcgccacgtgcagccatgaagtggtactcgacaacgtgctggtgccgctggaccacgccgtcagcgtcagcccctggagtgcgccgcagccggagttggatggcgatggtttcctgtggatgtcggtgttgctgtcctcggtgtatgacgccgtggcccaggctgcgcgggactggctggtgcagtggctggaggagcgcaagccatccaatctcggtgcagcgctgtcgaccttgccgcgctttcaggaaaccgtcgggcatatcgacacgctgctgtttgccaaccgcagcctgctggatgccgccgctgaaggccacaccccagccgcaaatgccgcgcagttgaagtacctggtgaccggcaatgcgatccgcgccgtcgagttggccatcgaagcctcgggcaaccctggcctgtcacgccacagcccgctgcaacgtcactaccgcgacgtgctgtgcagccgcgtgcataccccacaaaacgacgccgtgctgcaaggcgtcggcaaagctgtgttcgcccaacgtggcccgaaatgaataaggaacgcgcatgagtcaggtgattattgccagccagctggacgaagattacaacgcggtgatccgcgaacgcctcgcctcgattcatcctgaagcccaggtgatcggcgtgcctgtcggcgtgccgagtgacctgccgccccaggccaatattctgttgctgcgcccgatcaacgtgcgcggctacaccgcgcccgacaccccgccgccaggctggccctatggtgcgcagtgggtgcatctggtgtcgtcgggcatcgacttctacccgcaatggctgttcaacggcccaccggtgaccacctcacgtggcagcgccgccgacaacctcgccgagttcgccctggcagcgatctttgccgcatccaagcacttgccggatatctgggtgaaggatgcgcagtggaatttcaccgcattgcgcccgctcaagggcaccactttgggcatcctcggttttggcgcgattggtaagagccttgcgcaaaaagcgttggcgctcggcatcaacgtggttgcgctgcgccagagccctgcaccttttgacgtggacggcgtagaagccgctcgggatatccacgacctgttcgcccgcgccgaccatctggtgctcgcggcgccactgaccgagcgcacgcggcatatcgttaaccgcgatgtgctcggcagcgccaagccggggttgcacctgatcaacatcgcgcgcggtggtttgctcgatcaggaggcgttgttggaggcgttggataatggccggattgggttggcgtcgctggacgtcaccgagccggaaccgctgccggctgggcacccgttgtacagccatccgcgggtaaggttgtcgccgcatacctcggcgatttcgaccaacagcaaagaggagattgccgagacgttcctggcaaatttgcagcgttatgtggacggttcggagttggcgaacctcgtcgatctctgagccgaacctcaatcaaactgtgttgtgtcagtggctcagcaaccacccgccaggcgttcacgcaagaactccaccagcgcctgcaccggcctggagctttgccgatgctggggatacaccgccgataaggtcagcgcgtcgggggcgaagtcttccagcagcgtgaccaggcgcccatctttcaacgcctcagcgacaataaacgtcggcaggtaagtaacacccaacccggcaatcgccgtgtcgcgcaacaactcgccgttattcacgcgcatgcgcccgctgacattcagcgagtgcagcttgcccttggtctggaagcgccattgcacctggcgaccgtggccgtagggcaggcagtcgtgggcggcgaggtcatcgggtttgagcggtgtgccgcgctgggccaggtactcggggctggcgcagtacacccgctgcacgctggcgatacgccgcgcgatcagggtggaatcttcaagggtgccgatgcgcaacaccaggtcgtagccctcgccgatcaagtccacggggcggtcgctgaggtcgacttccaccgacacgtgcgggtggcgttgcaggaacgacggcaacaggcagcccaggtgagccatggcaaacgacaacggcgcactcaagcgaatcgtaccgcgcggctcgctgttctggccggcgatgccctgctccacttgctcgacttcactgagcaggcgcaaggcggattcgtagtaactctggcccagtggcgtaacgtccaggcggcgcgtggagcggtttagcaggcgcacgccgagacggtcttccagctggatcaggcggcgactgacgaactgtttggacaagcccaattgctcggcggccgcggtgaaactgccggactccatgacttggcagaacaggcgcatgtcttcgaaggggttcattgtcgcttctcggtggacattttgcggttttatagcctgtcagtcgccacaccacaaccgatcgtccccacgctctgcgtgggaatgcagctgcggacgctctgcgtccggcgtgagaagtgacgcggagcgtcacgggaggcattcccacgcgtagcgtgggaacgatcaggtggggagttacttggccgtaaacgccgagtagctgttcatcaggttgcggtagttgggaatgcgcggcgacagcaggttggcgaggccttccatgtcgttgcgccagtcgatctgcagctcgcaggccaccgagaaccagttcaccaaatgtgcaccggccgcgctcatgcgtgcccacgaagcgcgttgtacggcttcgttgaaggtgccggacgcgtcggtcaccacaaacacctcgaagccttcggccagcgcggccagggtcgggaaggtgacgcacacgtcggtgaccacaccggcgatgatcagttgtttacggccggtggctttcaccgccttgacgaaatcttcgttgtcccaggcgttgatctggccagggcgcgggatatacggcgcgtccgggaacagttctttcagctccggcaccagtgggccattggggccggtttcaaagctggtggtgaggatggtcggcagcttgaaaaacttggccacatccgccagcgccagcacgttgtttttgaattcgttgggcgagaagtcctgcaccagcgagatcaagccggtctggtgatccaccaacagcaccacggcgtcgtctttgttcaagcgtttgtaggtcatggggtagctcctgtttttgattgagaggggagttttagaaggcaaaacacgagcagccaaacgcaccccagaaaccctggaagtcgctgaccggcacgctggaaagacgcgctttttcatggctatgggaatgcacgccgcacgggccgctgcattgatgcacctgggcttgcaccggcgagcttgggcgccagtggcccggcaccttgactaccggcgaccagtccggcagcaccggcacccgcggcggggcgaaatcttcgaagtcaccggcgccgtacaccaccttgccgccgaccacggtcagcaccgattcgatccacttgatcgcttcttcatcgacactgaaaaagtccgccgacaacgctgccacgtccgccagctggccgaccttgatctggcctttcttgccctgctccgacgaaaaccaggcgctgccgtgggtgaacaactccagcgcagtcaggcgcggcaggccttcggcgtgcagttccaggccaccgacggtgcggccgctgaccatccaatacagcgaggtccaggggttgtagctcgacacccgcgtggcgtcggtgcccgcccctaccggcacgccctctgcgagcatgcgcttgatcggcggcgtggcttcggcagccttggcgccgtaacgctcgacaaaatattcgccctggaacgccatgcgatcctgaatcgcaataccgccgcccaaggcgcgcacgcgctcgatgtttttcggcgtgatggtttcggcatgatcgaaaaaccacggcaagccattgaatgggatgtcgcggttgaccttctcgaacacgtcgagcatgcgcgaaatggattcgtcatacgtggcatgcagacggaacggccagcgctgctcgaccagatggcgcaccaccggttccagttcctgttccatggtcagcggcaggtcggggcgcggttcgaggaagtcttcgaaatccgccgccgaaaacaccagcatttcgccggcgccgttgtgacgcaggtagtcatcgccctggtgcagggtgacgctgccagtccagttcttgaaatcgctgagttcttccttgggcttctgggtgaacaggttgtaggcgatgcgcaccgtcagttgctcgtccttggccagttgctcgatcaccgcgtagtcatcgggataattctggaaaccaccaccggcatcaatggcactggtgaggcccaggcgattgagttcacgcatgaactggcgggtcgagttgacctggtattccagcggcaatttcgggcctttggccagggtcgcatagaggatcatggcgttgggccgcgccaccagcatgccggtggggttgccatggctgtcacgcacgatttcgccgcccggcgggtttggcgtgtccttggtatagccggccacgcgcagggcggcgcggttgagcaaggcgcggtcgtacaggtgcagcacaaataccggcgtgtccggcgcggcctggttcaactcttccagggtcggcatgcgtttttcggcgaactggaattcgttccagccgcccaccacgcgcacccattgcggcgtgggtgtgcggtccgcctgatccttgagcatgcgcagcgcatcggccagggacggcacgccttcccagcgcagctcaaggttgtagttcagcccgccacggatcaggtgcaggtgcgagtcgttaaggccggggatcacggtgcggcccttgaggtcgatgacctgggtgccactgccgcgcaaggccatggcctcgccgtcggtgccaaccgcgacaaaacggccttggctgatggcgacggcggttgcgcgtgggttttcacggtccacggtgtggaactggccattgaacagaatcagatcggcgttcatagggtttcctttacggaggcttcaagccagggagcgaacagacgagtggcggccggcatcagcaggtagaccaccagcagcacgatggtgacggtgacaaggaacgtggcgactacgtagttggagaggaacgggtgcaggcgcaacaccgggccccagatgatcgggatcagcagggtcagtggcaggatcacgcacaaggtcaccactgcttgtttccagcgtggtggtttggcggcgctgtcggccaggggggcgaaccagaattcgttgacggcaccgatttcggtgttgtcgccgtcggcgagcatgggcgtggcttcgttgatcagggcttggcgttcgggggagtcgagccagcgttcgagatcgtcggtggagcggtagcgcaggacgcaggtgaacagcgtcaggcggttttgtttgctgcgtacgacgtcgacgccgaggtggccggggcgttcgccggcgatgcgcacgatgcggcgtagccaggcttcgtagtcggcttcgcggccgggtttgatcaggtgtttgacgaccagggtgacgacttcgtcggggctggttttgggtgttgggtccatggttgtgtgtttccccctggagagtgagcgatagggggagtttggggggtgttggggtttgggaattggatgtatgtgctgtttggcgtggcggccttagggccgaccaggttggtggtttgggttgagtacatatccgttatttgggttagggttgaaattggttccgcccttacggcgggtcacttttggaaaagagccccaaaagtaaccaaaagggctcttgccccaccactcggcacctcgcctaggctcggtgtgccctcactccggcttgaatccgtgggtcgcccacggattcaagcctgcgttcggccagcgtggtttaacggggcgcctaagatcaagatcaaaagcaagatcaaaagcagagcacggcggcctagtagccgacctgagtggttggatcaaaagcaacgccgaggcggcctgacagccgacctgattttggaagctgaactcaatcaaatgtgggagctggcttgcctgcgatggcatcaactcggtgtacctgatagaccaatgtgcctgcatcgcaggcaagccagctcccacagaaaagcagagcgcactggtctggtcgccgaactccgtaaattgtgggaggcggcctggcagccgacctgattttgaaggctaaactcaatcatatgtgggagctggcttgcctgcgatggcatcaactggttatgcctgatgtaccgagttgcctgcatcgcaggcaagccagctcccacagataaagcagagcacaccggtggccgaactcggtctaattgtgggagcgggcttgctcgcgaatgcggtgggtcagtgacagatgaattgactgacacaccgcattcgcgagcaagcccgctcccacatttggatctcagtgcatcaggtggataggcttttgccctgcttttgctgtgcttttgcttcaaccactcaggtcggctactaggccgccgtgctgtagatcttgatcttgattttgatctgaggcgccccgtcaaccacgctggccgaacgcaggctttggagcgggggtaaaccggcaggacgccggtttagccgcgctgggccaaggatggcccatcgcggcggcccccgctccaaagccggagtgagggcacaccgagcctaggcgaggtgccgagtggtggggcgaggactttttggttactttttggtccctcaaaaagtgacccgctgtaagagcggaaccctaagccgccattaccgcagcaacggatatgtacccaatcaaaaatcccgagccatatgctcacttatacgcaaccgcaaccaccgctccgccgggtcattgtcatgcaccccactccacaccatcgacaactccgccgcctcgatctcaaacggcgggtcctcagcccgcaacaccgtcccctcggtcaacgcacaggccgcataatccggcacggtcgcaataatctgcgtgcccaccaacaacgcccgcaacccactgaattgcggcaccgccaacaccaccctgcgtgcccggccaatccgcgccaaatccaggtcgatattgccgctcaaatcccccgaaaacgacaccatcgcatggggccgcgcgcagtagtcatccagggtcaacggcgcctccccgtcgtccccacgcagcaccttgcagggaatatcccgcagcttcttgcgcttggcattcgccggcaattccgtggtgtaactcacccccaccgaaatctcgccactggccaataacgccgacatcaacaggtaattggcccgacgcaccaccaccacaatccccggtgcctcctcacgcagttggctgagcagcggcggaaacaagccaaactccgcatcgtccgaaaggccaatacggaacaccgcgcaactggtggaagggtcaaaatccttggcgcggctgaccgcgccggagatggtgtccatggccggttgcaactccttgagtatcgccagtgcccgtggcgtgggttccatgccccgcccgttgcgcagcagcaacgggtcgtcgaacaaatcccgcagccgccccaacgccgcactcacggccggttggcccataaagagtttttcggcgacgcgggtcaggttcttctcgaacatcagcgcttcgaaaatcaccagcaggttcatgtcgacgcggcgcaggtcgttgcggttcatggcggtttccacagggtttccaggccgccagataagcacacgaaaaaccctgccgattgcacgcctgtgctgtcttttccacgccctgagctggcgaaattaacaacgattaactcgtcagccagacggtccggcgccaagaatgaggcggtctacactggatccattcaccgggaacgctcccatcgactacggatatttgtcatggcccgacttgagtactgtgcgccacgttttagcgcgaccggcggcctatgcccccggcgcgaacgcattgccaaacaactgatcctcgccaacctcggtgaaagcctggcgattgccgacctggcgcaggcgtgcgcgctgtcgcgcagccacttttcccgcgcgttcaagtgcaccaccgggctgtcgccgcaggagtggattcgccaacagcgcatccagcgcgccaaggagttgatcaccgggtcgtccttgagcctgacgcaaatcagcctggaatgcgggttctgcgaccaggcgcacttctgccatatgttcacccgcagcgaaggcgtcaacccgatgacctggcgaaaccaccacttgcgtcacaagccgcaagtgattgcggcctagtggtcggcacacgcctggaatatgctggccagacccttttccccgagcatcggccaccatgagtgaccccagcgaacaggccgtgcacttcggcccctaccgcatccacccgcgccagcgcctggtgctggaagccggtcgcccgttgcgcctggggcggcgcgcggtggatattttgctgatcctgctggagcaggccggcaaggtggtgagcaagcaggaactgatcgcgcgggtgtggccgaaaaccgtggtggaagacggcaacctgcgcgtgcacatggccgcgctgcgcaaggcgctgggcgatggtcaggccgggcagcgctatatcgtcaccgtggcccagcgtggctacagttttgtcgcaccactgagcatcgaaccgatgacgcttgccgccgatggcattccccacagccagggccataacctgccgctgcgccgcacccgcatgctcggccgccaggcgctgatcgatgcgctggtgcagcaattgccgcaacaacgctttattaccctgaccggcacgggtggcatcggcaagaccaccgtggcgctgcgggtggcggaattgctgatcggacattaccgcgacggcatccgcctgctggacctggcgccgctcagcgcgccggcgatgatcctgcccaacctcgctgcattgctcgacctcacacccgccgagcatgagcccctgctcacgctcgcgcgcagcctgcacgcgcgtcagttgctgttggtgatcgacaattgcgaacacctgctcgacgacatcgccctgatcagcgaaaccctgctgcgccatgcgccccacgtgcacatcctggcgaccagccgcgaagccctgcgcgccgaaggtgaacacgtgcaacgcctcgaaccgctggcctgcccgcccgcgaccggcaaccgtgcccaggccctgggctacccggcgctgcaactgctgatcgaacgcgcgctgtcgcatcaagacagttttgaactcagcgaagccgacttgccgctggccatcgacatctgccagcgcctggacgggattccgctggcgattgaactggtcgccgcgcagatccagcgcttcggcctgcagcggctgcgggtgcagatggaagacaatgttcgcctgctgacccgtggccggcgcagcgccctgccccgccagcaaaccctgcgggccacgctggactggagttttgcattgctgaccgcgtgcgagcagatttgcctgcgccgcctggcggtgtttcgtggcgggttcagcctggccagcgcggcagcggtgatcgccggggagcagattgcgccaaacgaagtgctgggctcgatcacccagttggtcgccaagtcgctgctcaatgtggaggctggcgacgatgaaatggtctaccgcctgctggatatcacccgcacctatgcgctggaaaagctcagcgtggccaatgagcttgaggccacccttgagcgccatgcagcgcggtgcctggcgctgatggagcaggcgcaggaggactgggagctgattgcgacccaggcgtggatcaaccgttatgcgccgctgcgcgaggacattcgcgccgccctcgatgggtgtttgggcgacgggggcgcgcacctgttgggcattcgcctgaccgtcagcgccatgccgctgtggcaggaattatccctgctgcgcgagcacgggctgtacgtgggcaaagccctggcgcgcctggcacagtcgcgtgcgccgagccagcgcctgcacatggccttgcaacttgcgctggggagtttttcctatcatacgcagggcggcacgccacagacccttcaagcatttgcctgcgcgcggcgcctggccgaagccggcaaagacttgggtggccagctgcgcgcagtgtcgggccatatggcggtcaacctgtgcagcggcaactaccgcgaggccttggcgcagagcctgcagtttgatcagcttggcccacaatccgagcccttgctggacctcagcgcccagcgtctgcgcgtactggcgcaacactttgccggcaaccaggcactggccctgcacaacgccgaacaagtgatccagcgcatggcccacagcggccacctgaatcggtttacccacggcttcggcgtgcaatacgaccagagtgtggcgtcgttgacgattctcgcgcgcaccctgtggctacggggttttcccgagcgtgcctggcgcaccgcgaaccaggcgctggaactggcgctgcaaatcaaccacggcacctcgatctgctacaccctggccctcgccggcgtggtgatcgcccgctacaacggcgacagcgcggcggcgcgttcactgctcgacctgttgctgcaacaggcgcacaaacactcggtgcagttgttccacacctgggcacggcactacgagggcacggcgaccgacaaggatttgcaagggttgggcctggtccaggacacgctggtgaccttcaacgccctcgccgtggatgacgccttgttcgagcgcgccagcagcggcgcggccggttggtgtacgccggagattctgcgcgtgcgcgccgaggccatccctgatctgcgcaggcgcgaagcactgctgctggaggcgctgggcctggcccaccagcaaggcgcgctggcctgggaattacgcagcgcgacggcactggcgcaactgtggcaaggccaagggcgcgtgcaggcggcgcgcgacttgctgagttcggtctacacgcaattcagcgaagggtttgccacccacgacctactccgcgtgcgccgcttgctcgacgagttgcaagacaaacggccggcctgaaaacggccccaggtaatgcccataaccttgctgcaaacgcgccacctgcaccgggtcacgcaggtgcgccagggcgtagctgcgcaggctgttgagcaggcggtagcgcgcagggcccgggcccggctccaccgtcagcatcgacgtggccgccagacgtgtcagcaggtaggacaagtcggcgtgttccagctcagtgccggccaccagctcgctcaacagcggcaaggtcacggccattttgaacagcgccaactgcaaaaacagccagcgctgcggcaggctcaggcgctcgtaactccagtccagtgcagcggtcagggatcgatgacgttctagcgccgtgcgtcggccacgggtcaacacctgcaagccctgttgcaactgcgcctgcaagccgcgtaggcccagggcctcgacctgtgccgctgccagttccagggacaagggaatgccatcgaggcgccgacagatgtcgcgcaatggcgccaggtcctgtgggcgcagcacaaacccttgctgaccggcacgcacccgcgcgacaaacacttgcaccgccgggtagaccatcgcctgctcgacactgccccaggccgagggcgcaggcagcgccagcctgggcacgcgctgcacccactcgccgggcacttgcaaggcttcgcggctggttaacaacaccgttacctgcggtgctttttcatgcagtacgcgcaccagatggcggcaggcgccgagcagcacgtcggcgccgtcgagtaccagcaacaggtggcgcgcagccaactgctcgcacagtgcatgggcgctgctacacggttgcaggttcagggtcgcggccagatggcgcagcagttggctcggcgcgtggaccgtcgccaaatccacccagcccacgccgtcgcgatagcgcggcaacacccgttcggccagggccagggccaaggtgctcttgcccacgccggcgcagccggtgagcatggtcagccgctggccggacagccgccgcaccagtgcacccagcagctcatcacggcccagcatcggactgagccgggcggccaggttgtgccagggcagcgccgacgcagcggttgatggcgcgacaaagcagtagccacgcgcgggctcattgaggatatagcgctgcccgtccagcgcacgacgcagggccgcgatgtgcacgcgcaagttgttctcttcgaccacgctgcacggccagacccgcgccagcaacgtgtccttgccgacaaattggcctggcgtttccagcagcaccgcgaggatatccagcgcacgcccacccagcggcaccggcaggccagccttgctgaccagacgctgttgccggtgaaaggtgtaggggccgaagctcactgtgtgtgggttgttcatccggttagcggcgctggaacacccggtcttgggcgtttgcgcatccttttccatgggcctgtcgctatcttgccagctcgccgtgacaggacaatgctggcacggggagcgacacggacaatcaggtgcgcgaaacagccatgctggcgttaactgaactgctggcggtattgcgtcgggttaaggccgagcttttcactgaacagaaaacgcatgtgtcgcacgctgccgaagcctgcgtgaaacgccacggtcttgagcggcaggtcggtggtttccagcaagtgccgggcgcggtcgatgcgcgcgccttgcaggaacgccatgggtgtcatctgcacctccttggcgaacacccgcgcgaagtggcgcgcactcatgcccgccaacgcggccatggcgtcgatagtgaacggctgatccagttgcgccagcacgtggttctgcacgcgggtgatggcggtttccagcggcgccaccgcagcggtcatcgggctgaactgggcttggccgccctggcgtttcatcaccaccaacaacactttggccacgtccaccgccacctgtttgccgtggtcctgggcgacaatcgacagcgccaggtcgataccggcggtcaccccgccggaggtgatcaagcggccatcctgcaagtagatgcgatcggtctcgacaatcgccttggggaagcccttgatcaagcgctcggtgtaatgccaatgggtggtgacgcggcggccgtcaagcagcccggcatgccccagcacaaacgcgccggtgcagatcgagccgtagcgccgcgcccgtggggctgcggcctgcagccagggcagcagcgctgggtgacattcgttataggcgccggggccgcccggcaccagcaacaggtcataggcctcgtgggcctggtccagttgcaggtcgggctgcacgtgcacgccattggacgcgcgcagcaggcccggctcagtgccaatcgtcaggatctggtagtgcgcggtcgccggcaggtagcggttggcgatggaaaacacttcaagtggcccggccatgtcgagcaggaggaagtccggaaacagcgccatggccacggttttcatgcggggataagtccatttggaaggaagtcgtggcggcattatggcacggcttttactgtcaactttaaagagacagttattaaaatttcagcttcttaatgaatttctctgtaactattaatcttcttctcaacgcaagcgccctgcatcacgcagcccgcgctcacttgaggacaagaccatgctgacccttcgcaaagcttcggaccgcggcgccgccaatcacggttggttgaagtcgttccacaccttctcgttcgccagctactggaaccccgccgagcagggcttttccgacctgttggtgatcaacgatgaccgcgtcgcagccggtaaaggctttggccagcacccgcaccgcgacatggagattttctcctatgtgctcgaaggcgccctggaacacaaggacaccctgggcaccggctcagtgattcgccctggcgatgtgcaactgatgagcgccggcagcggcgtggcccacagcgagttcaaccacagcccgacccagggcgtgcacttcctgcaaatctggatcgtgccgaatgaggccggcgccgaaccgcgctatcaacaggaacacttcagcacggcgcagaaacgtgggcgcttgcagttgatcatctcgccggatggcgccgagggttcgctgaatgtgcgccaggacgcacgggtgtatgccgggctgttcaacggcgccgaagccgcgaccctggacctgccgccggatcggcacgtgtacatccatgtggccaggggcagcgtggacgtcaacggccagcgcttgcaggaaggcgacggcgcccgtgtgaggaatgaacgccacatcagtctgagccatggcgaggatgccgaggtgctggtcttcgacctgcgccctcaggaccggccgcagatgccttgaccgtcgacgcgatggcccgccctaaaacgggtcatcgctggcatcgatagtcaccatcagcccaatgaagttctcttaaaaaaaccaacgcgtaacatcaaccccatgccaaacggcacccaactaaaacactcggagcacaccatcatgaaacgccaactcttgcttagcctcgctttctcggtactggctgcaaacgcttttgctcacccggttgtcgctgaaggcggcgcggatcgcctgcaaggtaaccacgtagcggaaggcggttctgatcgtctgctggaacgccgtgtggccgaagggggttctgaccgtttgctggaacgtcgtgtggccgaagggggttctgatcgtttgctggaacgtcgtgttgccgaaggcggtgctgatcgcctgcaggaacgtggcctggccgaaggcggtgctgatcgcttgcaggaacgtggcctggccgaaggcggtgctgatcgcttgcatagcaacaacgcataaccccgcactgttcgcggggcaccccaaaccggcctgatcagccggttttttttcgtccccgattcagtcaaggtcgcggtccacccacatcaccgccttgccgatctgttgccgcgcctcgatgcgcgcatgcacctgctgcaccgtctccaggctgtaatgcccttcgatgtccaccgtcagcgaaccctccagcatcgccgcgaacaccgcgttggcgcgccgttgcaccgtcgcgccatcggccatatggtcggccagccgtggccgggtcaaaaacagtgagcccgcctcgcccagttcaatcgggtccaggtcggtcagcgagccggagacgttgccataattgacgatcaaaccaccggtgcgacaggcacgaaaactctcgcgcaaggtgtttttgccgaccgaatcgaagaccacatctaccccgcgcccgcctgtggcttgcagcacctggtcggcaaaaccgtcatacgtccaggcctgatcggcgccgcgcgcaagcgcaatcgcacatttctcggcggtactgccggtggtgaacaccgtggcgcccaagcgccgcgccatctgcaccagcaattggccgatgctgccggacgcggcgtgaaccaggcaggtgctgcctgagtgtaaacgggcgacatcctcaaccaggtagtgcgcggtgcagccctgaaacatcgctgccgccgcctgatcgaagcggatggcgttggggatttgcgcaattttgtcggcgggcacatgggcgtattcggcataggcgccccaggcaatgcaccaggccacgcggtcgccaacggccaagtgactcacgcccgggccgacttccaccaccacgccggcgccttccatgcccaaggtgcacggcagtcgcaccgggtacgtgaccgagtgggcgtatttgccttggcgcgtgtgaatgtccatgaaattgattccggcacaggccaccttgaccagcacatgcccggccgtcgcctggggtttggcaacgtcgtagcgcaggtgggcaacttcagggccgccgtaggcttgcagggtgatggctttcattgggggaacaactccgtttgcactgggaagcggccatggtaaaaggacaggctcggtaggaatattccccaatccttcccagcctctgtgcggaaataacccgatgtttgactggcaggatctgtattacttcaccgtgttggcgcgcacccagtcgctgtcggcggctgcccgcgaactgcaggtggagcacgccaccgtcgggcggcgggtcgatgcgctggaaaaagccctcggcgtaaaactggtcgaccgcctgccccgcagccggccgctcaccgcgcagggcctggcgctggccgaattggcggcgggcatgggcgacatggccaccgaagtgatgcgcctgtcgcgcgtggcctccatcgaactggccggcaccgtgcgcgtcagttgcccgccgtcgattgccaaccactgcatcgcgccgcatgtggcacggctgcgcgcgcaatacccgcagctgaacctggtgctgatgccctccacgcaactggcggcgctggacaagggcgaagccgatatcgccctgcgcacggtacgccccgacgaggatgcactggtgcgccgcaaggtcggcgtggtgcgcttcgggctgtatgccgcgcccgcttacacgcaactgcccgccgcccagtgggcatttatcgcctacgacagcagccgtgatcacttgccgcaacaggcgtggctgcaccaactgcgcggccagcgcccgatcgtgtttgccgccagcgagttgataacccagcaaatggccgcccgctcgcaggtcggcgcggtggtgttgccgacattggtgggcgatcacgacccgctgttggcgcggttgccgaccatcagcgacggcccggtgcgggatatctggctgacggtgtacccggatatgcgccgttcgccgtcggtaaaggtggtgatggagtttctggtggcgtgcatcgaaggtgaagcgcagctgcggcgttgagtcagcctgccgtggcgaggaatttcttgcgatacgccgccggcagcatgccgacgcgctgctggaacaggcgacgaaacgaattgctgtcttcataccccactgcgtaggtgatgctttcgagggtcatgcgcgttgattccaacatctgtttggcgcgctccaggcgcaaggtttgtacataggcgataggcgtatagcccgtcgcctccttgaaccgccgcttgaaattgcgcacgccaaagccaaagcgccgggccacgtcatcaatcaccagcgcctgggcaaactgctgttcaagccaatgctgcacccgcaggacctcgccgtcgccatggttcttgggcaatgaccacatggcgtacaccgactgctcggtgcgtacgttgtcgatcagcaagtatttgccacaggtatgcgccaactcgggagagccgaagcggcggatcagatgcagcatcaggtccatcgcggcgctggcgccaccgcaggtgatcacgcggttttcttcgcagagtatctgcgcgtcatccaacgcaacgcccgcgtagcgttgccggaaaaacccggcaaacgcccagtgggtggtggcgcgcaagccctgcagcaagccgctctccgccagcagaaaagccgccgtgcacatcgacgccagcaccgttccctgggcatggcgttcgcgcaaccagggcccgtaggcgggaaagctcggcatggcctctttgagggtaaacagaaaaccagggatcagcaccaggtcggtctggcgaacctgcgcgagcgaacaccccacctgcaaacgctgcccaccccaggcgtccacggcctggccgtcgagggaggcgaccacgatctcgaacggcgggctgtcggcgaacaggttggcggcactgagcatttccagggccagggtggcgctggcggcggagcattggtcgacgaggagcaaggtaatgtgcatgtttgcgcttttcgcatgtaataagtcatttgcgcacctaccttagccgattcctcgcccgtagagtgcggccactgatcaactgcctggcgcgtttatgaatctctggtttcgattgctctacatgctgtcccgtcgcccgtggcgcacaccggcccatggcctggagaccaccgtggtgcgcatgcgggtgtggccgctggacctggacatcaaccggcacgtcaccaatggccggtatttctccctggcggacgtggcgcggatggattttgtactgcgtaccggcgcgtttcgcgtggccctgcgcaacaaggccctgccgatcgtgggcgatacctggggcaagtttcgccgcgaactgaagctgttcgaagtgttcgaggtacacacccgtatgcttggctgggaccacaagtggagcctgatggagcaccgtttcgtcagcaaaggccgggtgatcggcgtggtggtgatgcgcgggctgtttcgctcagccaaaggcaccctgcccccggcagactttgtgcgcgagctggggttggccgaaacgtcgccaccgctgccgcaatggctgagtgactgggcgaaaagttgtgatgatatgagtgtgcagttgcgcgcagaggagcaggtttaaaccacgcgggccagcttcttcaagttggcttcggcgtcgtctctgcccacatacaggaagcttttaccttcctggactttgaacaacaccttcatgctcactaacttgtccaggtccttacgtgcggtattttccgaaacgtcatagtcgtgggtgagttccttggggctgaagatgcagcccggattacccgctccgcgtgggaatgcatcctgtggcgctctgcgtcacctgtacatcggccttgagatagaagctggtgcgggacgcagagcgtcccaggcggcgttcccacgcacagcgtggggacgatcaactccaccagacaagcatcatcgcgatcctgatcgttcccacgctccgcgtgggaatgcatgctctgacgctctgcgtcacctgtacatcggtcttgagatagaagctggtacgggacgcggagcgtcccaggcggcgttcccacgcagagcgtggggacgatcaactccaccagacaagcatcatcgcgaccctgatcgttcccacgctccgcgtgggaatgcatgctctgacgctctgcgtcacctgtacatcggccttgagatagaagctggcgcgggacgcggagcgtcccaggcggcgttcccacgcagagcgtggggacgatcaactccaccagacaagtatcatcgagacctgatcgttcccacgctccgcgtgggaatgcatcctgtgacgctctgcgtcacctgtacaccggccttgagaaagaagcggacgcgggacgcggagcgtcccaggcggcgttcccacgcagagcctggggacgatcaattaccaactgctccccaaccccagcagccccaaaatctcccgccgcaattccaccagatacgcatcatcgcgatgccgagggtacggtcgatcaatcgtcaactgcgcctggatcttcgccggccggtcactgaacacaatcacgcgattagccagcagcaacgcctcctccacatcatgggtcaccagcaacgccgtatagccctggcgctgccatagctcgatcaactccttttgcatggtgatgcgcgtcagcgaatccagcttgcccagcggctcatccaggatcagcaatcgcggctgattcaccagtgcccgcgccaacgccacccgctgcgccatgccaccggacagctgccgagggtaagcccgggcgaaggcactcaaaccgactttttccaaggcgtcatcaaccttgccggcatgggtcttgagcaacccttgggcttccaggccaagcgccacgttatcccacacgcgccgccatgggtacaaggtcggatcctgaaacaccaccacccggctcgggtccggcccggtgatcggctcaccatcggccagcaaccgcccggaatccgccggctccagccccgccaccaggcgcagcaaggtggacttcccacagcccgacggcccgagcaacgccacaaactctcccggtgcgacatccagcgaaacccgctccagcaccggcaattgctgaccgtccagggcaaagccatggctgaggttttcaatgcgcagcgccaaccccgccggcgccgttaccgcgtgtgccagggctaccatttcatcgctcctttctgccaggccaacaaccgatcacgcagcaagaacagcccggtaatcaaccccgaacaggccaacgccatgatcagcaacgccgcgtacatattcgcgtaggccgcccaaccctgggcccactgcaagtaccagccgataccggatttcacccccatcatttctgccaccaccaaggtcgagaacgacgcgcccaagcccatgaacaggcccacgaacacatggggcagcgcggcaggaatcgccactttaaagatcaggaaacctggcttggcacccagcgtgcgcgccacgtcgtaataggctttatcgacacttgccacacccgaccaggtcagcaccgtgaccggaaaccaagtggccagggcgatcagaaaaacgctggcgctccaactgctgggaaacagaaaaaaacacagcggcaacaacgccgtcgacggcaccgggccgaggatgcgcagcaccgggtgcagccagtagccgatacgcgtggaccagccaatcgccacgcctgcgacgaagccggtggccgcgcccaacgccacgcccgagcccagcaacagtgccgaatgcagcaggctgtcggccaggcgcgcgtagtcttcgatatacaccgcaagcaacgcctggggcggtgcgaaaaacggcaccggcaacagcgccaacttggcggtgagcaactcccacaggcccagcactatcggtaaggcgatcaaccaaggcccggcagtgcgcaggcgcaggcccagcctggaaaagtgccgccccaacagactcaacacgatgaacaccgccgccacgccgacgcacaggttggccagcccttgcgtcatcggccaattgcgtacggcgttgggccaatagctgatcagcagtgccacggccacccaggccgcgaccacggttgcgccctgccaccagacgctgaaggttttggcggggctcagggttaccgcatcaactgaagacatcggcggtgatctccttggcaaactctaccgggtcggtacttttgctgatcacttccacggttttcaggtcggtgacgtaggtggtgatttcctgcgtcagcgccgcgccgaccgcgtggtggccgtgggtgtggtcgtggaggatcgcctgcacttcttcggtggtcgtgttcagtgcgtaggcctggaagccttttgcgacgtcctccgggtgctgcacggaatagtcatgggcttcgaggatcgcctgggtcagcgccgccactacgcgcttgtcttcgcgcaccagcttgccggtgacgccgaccacgcagcagctgagattggcgtattcctcgaccaggttggtggacaattcccgcgccacgccggacttgatcaagcggtacatgaacgggtcgctgccgctgaccgcctgcacttcgccacgctccagcgcggtgcccaacaggtcggccgggtacagccgccattccacatcgcgcaccgggtcgacgccgtgttttttcagcaggatcgagaaaaaattgcggtccgggctggccatgtcggtaacgccgatggccttgcccctgaggtcttcaagcttggtcacgctacccttcaccgcgctgagcaaacgcaggcagccgccgtgggtgccggcggtgagtttcacatcaaagccctgttccaacgccttgagccagcgcagcgccatgccgatgcccgcatcggccttgccggtggcgatggcttcgagcagcacttcggtggagttgccgaagttgaccaactcgacgtcgaggttgtgctttttgaagaagccctgcccgtgggcgatcaccaccggggccaggcacaccgcgttgaggttgactgccagcttgagcgcacgcggcgcgtcgagacggatgaactcgccggtgccgctgggttcctgaggcgtgttgtgcccggcgtgctcgtcagcggcccagcccaggcgcggcagcgacagaccggccagcgaaataccggcgatgccgagcaggcggcgacgggttaagtgatcaaaagcggccatgcgcaatatcctttttaaattgatgtactgggtgacgcgtcgagtggggctgttgtggcgagcaggcttgccctgcgttgggctgcgaagccgccccaatacggcctccgcgtttttccagacaaaccgcggggcctggttttagggccgcttcgcgccccaacgcagggcaagcctgctcgccgcaacaagcctgctcgccacggtcaattgttgagatcggccaaccccagatgctcacgcagcgtcgagccctcataggccgtacggaacaaacccttgcgttgcaaatgcggaatcacgctctcgacaaactcagtgaacgagcccggcaagtagcccggcgaaatcacaaagccgtcgcaaccgccctgttcgaacagctccgccaactgatcagcgacctgcgcgccggtgcccaccagttgcggcacgcgcacgctgctggcgaacaggcgcccaagttgctccagggtggtttccgggccttgcatcagcagcttttcagcggcggccgcaggaatcagcggcgactgcgcgatctcggccaaggtggccgaaagcgggaacggcgacaggtccacattcagctgcgaagcgagtgtcaccaaccccagttcgggccgcgccaaggcattgtgtttgtcgcgtttggcgcgggcttcggcttcgctgccaccaataaacggcatcaccgccgtcagcaccttgcagctgtcggcagcacggccttgctgcaccacttgcgcgcgcacgtcatcgcgaaacgcgcgcatggccgccaaatgcgggtgaatggtgaaaatcgcctcggcccagcgtgcgccaaaccgccgaccacgcccggacgagccggcctggatcagcaccggtcgcccctggggcgtgcgcgggatattcaacgggccttccaccttgaaccactcgccctggtgctgcaccgaagcaatcaaacccgggtcggcaagcacaccgctttcgcggtccagcttgagggcgcccgggccccagctgttccagagcttgagcgcgacttcgacaaactcatcggcgcggtcatagcgcaggtcgtgttccaggtgcttggccttgccgaacaagcgcccttcgctgtcgttcatcgaggtcacgatgttccacgccgcacggcccttggacaggtgatcaagggtggcgaattcacgcgcgatatgcgccggctcgtaataggtggtggagcgtgtcgcacccaggcccagcttgcttgtctggccgatcaggtaagagaggatcggcaacgggtcgagccgcgtggcgtcctgggcgccgtagcgcaaggcgaactcacgcgaaccgcccatctggtcgcccacggccaggcggtcggcgaagaacaggaagtcgaacaagccttcttccaccaccttggcgatgcgtgaatagtagtcagggtcgaggtagttgccgacggtttccgggtggcgccacacggcgtggctgtgcaccaccgggccgctcaacagaaatgccgataggtggatttggcggcgggtggtcatggcaggccttagcttttcgcgtaaagggttaagccttaaaacttatattagtaatcaaccgttataaaagaacgatatattccatggttatgccggattcatcgaaatgctgaaaaaccgccctaagctcagatcaaaagagtatttatcgaatgctttttagaactttaagcttggccatatttcgctgaagatcgagcgcgccatgtctattcgtcgtcccctcgccgttgtcatcgggctgctggcgttttctgtcgccgtgagcgccgaagcccaggaaaccgtacggatcggttaccagaagtcctcgaccctgatcaccctgctgaaaacccagggcactctggaaaaagccctcaaggccgacaacattgacgtgagctggcacgagttccccagcggattgccgctgctcgaagcgctgaacgtgggcaacgtcgatatcagcgccgacgtggccgacaccgtgccgattttcgcccaggccgcccaggccaaactcacctacttcgcccaggaagcgccctcgccttccgcccaggccatcgtggtgcgcaaggactcgccgatccagcagctggcggatttgaagggcaagaaaatcgcggtgaccaaggccgccggcacacactatttgcttatcgccgcgctggccaaagctggcctggccttctcggatatcgaaccggcctacctgtcgccagccgatggtcgcgcagcctttgagaacaataaagttgatgcctgggtcacctgggaacccttcctcaccagcgtgcagcgtcaattgccgacgcgcaccctggcggacggcgcaggcctggccagctacaagcgttattacctgaccggcacgccctacgccaaagcgcatcccgaggtgctgaagctggtgtatgcgcagttggaaaaagccggccaatgggtgaaaacccacccgcaggacgcggcgaaagtgcttggcccgctgtggggcaacctggacgtggccacggttgaagcagccaatgcgcaccgcagttatgaagtgcagccggtgacggttgatcagttgggggaacagcagaagattgcggacgcgttcttcaaggcggggttgttgcccaaggcggtggatgcccaggatgtgcagacctggaagccgtagcttaaaggctcgttcccacgctctgcgtggtaatgcatcacgtgacgctctgcgtcaccctactcagcgctcaagtttgccgggacgcagagcgtcccaaggtgcgctcccacgcagagcgtgggaacgatcaaacgacacatcaggttgttacgcctcagtgccgcaccacaccctggccgaagcggtggattgccaggcaatagccaatcaatgccagggccgccagtgcaccgcccgctgcgccgatccaggcgaagccgaagtggctgccgacccagctgcccatcagcgcgccgccgccgatgccgatgttgtagatgccggagaacatcgccatcgcgacgtcggtggcgtcgggtgccagcactagcaccttggattgcatggccaggccgaaacccatgattgccatgccccagaacacgctcaggccgacgaggtacgactcggcgccgctcaaaggcagcatcagtgccaggcacgcggcgagcaggaacaccgcgctgaccacgaagaggtgcgggttgaaacggtgcaccaggctgaacagcagcgagccgatgatgcccgcgccgccgaacaccagcaggaacagcgtcaccacattgccgctcaggccggcgacgccttcaacaaagggttcgatgtagctgtaggcggtgaattgcgcggtcaccaccatggcggtcagcacgtacagcgccaccagcgcggggcgcttgaacagcagcggcaggctgcgcagcgagccggagttctggctcggcagcagcggcaaggtgcgcgccagccagaacaccagggccgcggcaaacgccgcgatcaccaggaacgtggtgcgccagcccatggcctcgcccagcagacggcccagcggaatgcccaataccatcgccagggacgtgccggtggccagcaggccgagggcttgcacctgtttgccttccggcgccagccgcactgccagcgacgcggttatcgaccaaaacaacgcgtgggacaaggcgatgccgatgcggctgaccatcaacaggccaaaactggtggcgacgctggagaggatatggctggcgataaacaagccgaacagcacgatcagcagtttgcgccgctcgacgttacgcgtcagcagcatcaccggcagcgaggtcagcgacacgatccaggcatagatggtgagcatcaggccgacgctggcgatgggcatgtcgaagctggcaccgatggcgctgagcaggccgaccggcacgaactcggtggtgttgaatacaaacgcggccaacgcgagggcgatgaccggttgccagttggcttggggcgttgcggctgaaatgctcattgacgggcgaggtactctggcgatggtccaacggccgcgcagaacagcgccgccgctgggcattctataggtttctcgccccgctgttgacgcggatcgtcgccccgttgctcagggcgaggtcatggtgatgacgtagttgcccgacttgatcggctgaccggcgttgtccaccaacagataacgctgatcgtagtaacgcccgccgccgctgtccgcgaccagcagcacatgggccgcgttgacactggccaccggcgccacattgcgcacatcgaagcggctgccacggttggaaacggcgcagccggtcaactccattaccgcgccgctgcgcgcatttgtcgcacacccaggctcgacgatggcaccagtgaactgaatggtgccctgcccgactgtctgcgcggcgccacaagcgcccgcccataggcaaaacaggccggtaaacacggaaatacctttaaccttcatgccgacactccttattgggctctcaataagtgagtcgtctggccgggcattaacttgaggtgattcggcccagggtgtgatctagatcacggatccacctgccccatcatctcggggatgctttccggccgcttggcataacgctgcgccagcgccgcgcacaccatcaactggatctggtgaaacagcatcagcggcagaatcaacacgcccatggtcgccccggcgaacagcacctgggccatgggtacgccggtggccaggcttttcttcgagccgcagaacagaatggtgatgcgatcttcctggttaaagccaaaggccttgcccagaacggtcgacgccaccagcaccaaggccagcaacacgcagcaggccaccaccaggccgccgagttcccacagcgggatctggtgccagatgccctcgttgaccgcctcactgaacgcgccgtagaccaccagcaaaatcgagccttggtcgacgaacttcagccaggacttgttgcggccgacccactcgccaatccagcggcgggcgatctgcccggcgataaacggcagcagcaattgcacgctgatcttcaggattgcgtcgagggtcgaaccgccgtcgccgtgcacgttgagcaacaacgtcaccagcaacggcgtgaggaagatgccaaacaggctcgacgccgccgcgctgcagatggccgcggggatgttgccgcgcgccagggatgtgaaggcaatcgccgactgcaccgtggccggcagcgcgcagaggtagagcatgcccatgtacaggtctttgccgatcagcggcgacagcaccggcttgagcgccagccccagcaagggaaacagcacgaacgtgaggctgaacaccagcaggtgcaggcgccaatgcccggccccggcgacgatggcctggcgcgacagcttggcgccgtggaggaaaaacagcagcgcgatggccaggttagtcacccagccgaaggccacggcggtctggccgctggcgggcagcaatgaagcgaggaccaccgtggctatcagggtcagggtgaagttgtcaggcagaaaacgtgggcgggtcataagcaaatcttccaggggttgccaagcgcatcgctgcgactctaacgtaacggcttgttaccgactaacgccaatgagccagtaaatgccgcctaaaggacatgacaagacggttcgccgcagcgtgcccgggctttccagcttgccacggccggtgtatgggcgcaccgaatcgctgcccaatcgcgcgctgacccggcgccacagccatccgtgggtgcaattgtcttacgcgatttccggggtgctggagatccagaccagcgtcggccgctttgtcgcgccgccgcagcgcgcggtgtggattccggcgggcgtgccgcaccgggtgttcagttcgccgcacacggaaatgcgcagcctgtacctcgactgcagcgtcaccgcctgggcgcccgagcgctgccaggtgttggaggtgagcagtttgttgcgcgagttgatccgcagcttcagcgagctgccggtggaatatgccgaggacgggccggatgggcgtctggcccaagtggtgctggaccaactggccgctgcaccgcaggtggacttgatgctgccgttgccccacgacgcgcggttgcggcagatttaccgcagcctgagcctgcacccggagcagcagaccaccttgggtgactggagccgcaagctggcggtgagtgagaagaccctcagccggttgtttctcagtgacaccgggctgacctttcgcgcctggcgccagcgcttgcggctgctcagcgccctgcccgcgctggagcaaggtgagcgggtgacggatgtggcgttggggtgcgggtatgagtcgacgtcggcgtttatcaatgcgtttcgccagcagtttgaggcgacgccgggtgagttttttcgctgagtcttagacgaagagcttcaactgtgggagctggcttgcctgcgatagcggtgggccagttgacatgtttttaactgaaccaccgctatcgcaggcaagccagctcccacatcttttaaactgtatttcaaaaatggtgagggggcttagctgccgtcgccaccatgcgcctcttcaaaaaagtaatccttccaactcgccgccttgttcttcaacacgcccaattcctgcaatttctgcgcatagatataagtacgctgcggcacgatggtgaagtcgatttccgggtcctggacgattttttccaccaggtccagcggcagcttggattcctctacccgaatgtaggttttggccgcagcgggcttgtcggccttgataatctgctcggcctcggccagcgcggcgtagaacgccttgtaggtcttggggttttcgtcgtggaatttctcggtggtgtagagcacgttgaacgaggcctgaccgccgaggacgtcgtaggaactgagcaccttgtgcacgttaggattcagcagttcctggtactggaacggcgggctggagaagtgcgagttgatctccgaaccaccggcaatcaacgccgccgtggcgtccgggtgggccaggctgatggagatgtcgtcgaacttcttgaaattggcgtcgccgaactgcttggcggtttcgatctgcaaggtgcgcgattggaaacccacgccagcggcgggcacggcgatgcggtctttttcggtgaagtccttgagggtcttcacgttggggttattggtcagcaggtagttgggcatggagccaagggaagcgatggccttgacgttctgcttgcccttggtgcggtcccacagggtgagcatcggcggcacaccggccgagaccacatccagtgcaccggccagcagcgattcattcatcgcggtggcgccggaaatgctgttccattccaccttgatatccaggccctgttccttgccgtgcttctcgatcaagtgctggtcgcgcaccacgtcgaggatcaagtagccaatgccgaattgctgggcgatgctgatcttgccttcggcttgggcgccggggctgagcaaggcgcttgccgccgccagggacgcggccaggagagtcagggaggaacgcttgaaagtcatggggaatctgccgcgttttcgagaaggtgatggagcctagcggcgatttttaagacttgaaaagaatattgggatctattgttatgcaaatcgcccccaaattgccgcgcggctggtattgtgccgcgctttgaaagacacctgccgacctgcgaggaaatggacgttgaacactgacgataaaatgactggggacttgttcgaggtggataagcgcctgtcactcaagcccgtggtggacttcaacagctacctgcgcagcgcgttcggagacggcccctgcacctgcgtgcgctgcgccgccagccagggcgatgaaagcggctacgcgttccagcacaccttcaacctcgacggtaaacccacccaccgccgcttcgcctccacggcgggcagcgatgtgttgatgaagctcaagcaagcgtggctgtcgtacaccaaggccgaattgccgctcagtggcgtgctggtgttggacacggtgaaggagtttgtcgagccgcaactgcaccggcgtttggcgccgttgtttctggccagtgagctggtcaaggatgtggacggcgaactgcagatccagccgcaggccgcatagttccagcaccaccacagtacaaactgtgggagctggcttgcctgcgaagacggcggcactgccaacagagatgccgcccgacccaccgctttcgtagcctcgctgaagctcgacaactcccacagtggatttgtgggctcggaaagagcggtgttggcttctgaatccgccagtgccacagatcccacaaacaacagcgatcaaatgtgggagctggcttgcctgcgaagacggcggcactgccaataaagatgccgcccgacccaccgctttcgtagcctcgctgaagctcgacaactcccacagtggatttgtgggctcggaaa

SEQ ID NO: 72 - DNA, 39321 bp, Pseudomonas poae FL10F
agcttgctcccgttggggcgcgaagcggccccaaaaaaacgggagcgctgcgcactccagcgggagcaagctccctcgccacaggtgcgctgctaagccttgcgcaccctcaagcaacgccacaaagccccaaccatcagcacactgaccaccgcccaaccccacgcctgctggttaagcaaaccttcgcggtacagctgcggcgcaatccctgcaccgatgatgaaggccagcaacgctatctcccgacgcggcccggtcaccgggcgaaccaggtacaccaaggccggcagcaccagtgccgcgctcgggaagctgcgataacgcgggtcgaacaccagcgccagcatcatcaccgcgccggcaaacccggcgattgccaccagccagcctgcgcgttgctccagccagttgaacgcgcgctcgcgccatccttctcgtgcgccaagggccagcgcggcatgggccagcaccagcaggttcaacaccaccagcaaggctgcccatacccattcatcgttgaagcgtgcggtgacgcgagtcagttcggcccaggtgccgatggagcaggctgccacggcgccgagcaatggcagcaggaccgctgcgcgagtgctgcgaacacggccaccgagggccagggtacccaacaggataatcccgcctacgctcaaccacagtggccagtacggcacgttgctcaccggcccggcaagaatgcccttgtcctggcggtcggcatcaaacaggccccagtaaccgccaactgcgccttcactggcgcgtttccacggctggtcaaaggcttcgatcaggttgtagcgccagccattggcttcggccatggccacaaagccgcgcatgaacttggcttcgttgacccggctcggcacggccgtttcgcgctggcgaccttcgctgggccagccggtctcaccgatcagcacatctttaggcgcgaacttgttgccgaaggtctggcgcacatcaccgacgtgcttgagcgcctggtcgatgcccgacggatcatcttcccagtacggcagcaggtgaatggtcaggaagtccacggccggggcgatttccgggtgttgcagccagaactcccacacgtcggcataggtgaccggctgcttgatctggcttttgactttatggatgagcgtcaccaactgcttggcggtgacttccttgcgcagcagggcctcgttgccgacgatcaccgaggtgactacgtcggggttggcgttggccgccgcgatcagctcgtcgatttctttttcagtggccaccgggtcgctgctgacccaggcgccggccatcaacttcagcccgtgcttgcgcgccatgccgggcagggcttccaggccggtcatggagtaggtgcgaatgcagtcgaagcgggtggccagcagcgccaggtcggcgtccatgcgctcggggcgcagggtgaacggctggtcgaagggtgattggtccttgtcgaacggcgtgtaggacgcacattgcattttgtggctggcgctggcgacgtccggcaataccaccggccggccgaggccgtaccaatagccgacaagtgccagcacaccgaggatcaaggcgaaacaatagggcagggcagggaagcgggcagtcgcgggcatggtcggcttatctggaggagcaaaggcgcgcatcttacccggaattcgcccgtcccagtggggctgcataatttagacatgcaaagttcgggcgggattttgcagcgatgtcctacaaatcgccctgctggcgatgtgatgtcgtttcttgcttacctgaggtcgcagtcagagcaggtccaaggccccggcaggttgatgatcgaagtgtcagcactccactgatgtctgggccgccggatcgatgcgcgtgaagggggcgcggtgcaccatataacaacaggttgacgtcgctcggcatccgccgggcgcagcactttcggggaagtactatgaagatgcgacgactcttgggcgcagctgccactctggtagttgcgatgagctccacactggccagcgccgacagcaaaaccctgagcatcggctatgtggacggttggtccgacagcgttgccaccacccacgtggcggcagaagtgatcaaggaaaagctcggttacgacgtgaaactgcaagccgtcgccaccgggatcatgtggcagggtgtggccaccggcaagctcgacgccatgctctcggcctggctgcccgtgacccacggtgagtattgggccaagaacaaggacaaggtggtcgactacggccccaacttcaaggatgccaaaattggcctgatcgtgccggagtacgttaaagccaagtccatcgaagacctcaagaccgacaccaccttcaagaacaagattgtcggcatcgatgccggttcaggcgtgatgctcaagaccgacgaggcgatcaaggcctatggcctggactacaagctgcaagccagctcgggcgccgcgatgatcgccgaactgacccgtgccgaagacaagcaggaatccattgcggtcaccggatgggtaccacactggatgttcgccaagtggaaactgcgtttcctcgacgatcccaaagggatttacggcgctgctgaaaccgtcaacagcatcggcagcaagggcctggagaaaaaagcgccggaagtcgccgctttcctgaaaaaattccagtgggcctccaaggacgaaatcggcgaagtcatgctcgcaatccaggaaggtgccaagcctgatgccgcggccaaggattgggtcgccaaacaccctgagcgtgtggccgagtggatcggtaaataaccgctaaccctgtagaagttacgccgcaggcctaatgtgggagattctatggttgaggggcaaccctcaaccatagaatctcccacatttttttgcctgcattcaggctgttgtttatttgttgacttaaaaacttgcgaagtcgctatctcgttctactactaaggtcgtctggaacctgttccgcagccgcatacagtggatatgttccaaaataataaaaagctgtgctgcgaggataaaaacaatgaacgacagcatttacctctcgattcaaaacagcccgcgtttcaaggagctggtgagaaaaagggaaaggttcgcctggattctctcggcgatcatgctagggctttactccgctttcatcctgttgattgcctatgggccacaagtgctgggggccaaactcagccctggttcctcgattacctggggcattcccctgggcgtcggactgattgtgtccgctttcatcctgaccgctatctatgtgcgtcgggccaatggcgaatttgacgacctgaacaatgcgattctcaaggaggctgcgcaatgatccggcgtctattggctatattcggcgcttcgctgtttgctccggccgtttgggcggcggatgcattgaccggtgaagtgcacaagcaaccgctgaacgtctcggccatcgttatgtttgtcgcgtttgtcggtgccaccctgtgcatcacttactgggcatccaagcgcaacaaatcggcggccgactactatgcggccggcggcaagatcaccggtttccagaacggcctggcgattgctggcgactatatgtcggcggcgtccttcctggggatttccgcgctggtgttcacctccggctacgatggcctgatctactcgatcggcttcctggtgggctggccgatcattctgttcctgatcgccgagcgcctgcgtaacctgggcaagtacacctttgccgacgtggcgtcctatcgcctggggcaaacccagatccgcagcctgtcggcgtgtggctcgctggtggtggtggcgttctacctgatcgcgcagatggtcggtgcgggcaagttgatccaactgctgttcggcctggattaccacgttgcggtgatcctggtggggatcctgatgtgcatgtacgtgttgttcggcggcatgctcgcgaccacctgggtgcagatcatcaaggccgtgctgctgctgtccggtgcctcgttcatggcgctgatggtaatgaaacacgtcaacttcgacttcaacacgctgttctccgaagcgatcaaggttcaccctaaaggtgaagcgatcatgagtccgggcggcctggtgaaagatccgatctcggcattctccttagggcttgcgctgatgttcggtacggccggcctgccgcacatcctcatgcgcttcttcaccgtcagcgacgccaaggaagcgcgtaagagcgtgttgtatgccaccggcttcatcggctacttctacatcctgacctttatcatcggttttggcgcgatcctgctggtcagcaccaacccggcgttcaaggacgcggcaggcgccttgctgggcggtaacaacatggcggcggtgcacctggccaacgcggtgggcggcagcatcttcctgggcttcatctcggccgtggcctttgccaccatcctggcggtggttgccggtttgaccctggccggtgcttcggcggtgtcccatgacctgtacgccagcgtgatcaagaaaggcaaggccaacgaaaaggatgagattcgcgtgtcgaagatcaccaccgtagccttgggtgtattggccatcggcctgggtatcctgttcgaaagccagaacatcgcgttcatggtgggcctggcgttctccattgctgccagctgtaacttcccggtgttgctgctttccatgtactggaaaaacctcaccacccgtggtgccatgattggcggctggctgggcttgatcagtgccgtaggcctgatgatccttggcccgaccatctgggtgtcgatcctgcaccacgaaaaagccatcttcccgtacgaataccctgcgttgttctcgatgatcatcgcgttcgtgggtatctggttcttctccatcaccgacaagtcggcggcggcagagaaagaacgtgcgctgtacttcccgcagtttgtgcgttcgcagactggcctgggggcgagtggggcggtgaatcactaaacgttgtaacagctacaaaaaaatgccccggtcgcgagatcggggcatttttttgcttttattggtaacggatttcacaaaactgtttctcaaatcctgcaccaataaaactgccttgatcgttcccacgctctgcgtgggaatgtgaacccggacgctccgcgtcctgttgacaacgccagtctcaagccttgcgcggggtgacgcggagcgtcacaggaggcattcccacgcggagcgtgggaacgatcatcagaaacaaataaggcctccagaggaggccttattcggtgcaactaagcgcttgatggcttacttgcgatcttccagcttggtgatgtcacgcgactcgtagccggtgtacagctggcgcgggcggccaatcttgtacgggctggagagcatttctttccagtgggagatccagcccacggtccgcgccagggcgaagatcacggtgaacatgctggttggaatgccgatcgccttgaggatgatccccgagtagaagtcgacgttcgggtacagcgagcgctcgatgaagtacgggtcggtcagggcgatctcttccaggcgcatggccagttcgagttgcggatcgttcttgatgcccagttccttcaacacttcgtcgcacgtctgcttcatgacggtggcgcgtgggtcgcggttcttgtaaacgcggtgaccgaagcccatcaacttgaacggatcgttcttgtccttggccttggcgatgaacgtgtcgatgttggagacatcgccgatttcatccagcatggtcagcacggcttcgttcgcaccgccgtgggcagggccccagagcgcggcgataccggcggcgatacaggcgaacgggttggcacccgacgagccggccagacgcacggtagaggtggaggcgttttgctcgtggtcggcgtggaggatgaagatccggtccatggccttggcaagcgtcgggctgatcggtttgatctcgcacggggtgttgaacatcatgtgcaggaagttttccgcgtacgtcaggtcgttgcgcgggtacatcatgggttggcccatggagtacttgtaaaccattgcggccagggttggcatcttggcaaccaggcggatcgcggagatttcgcgatgctgcgggttattgatgtccagggagtcgtgatagaaggccgacagggcgccgaccacaccgcacatgacggccatcgggtgggcgtcgcggcggaagccgttgaagaaggtcttcaactgctcgtgaaccatggtgtggttctttacggtgctgacgaactgggctttttgctcggctgttggcaattcgccatttagcagcaggtagcaggtttccaggtagtccgacttttcagccagttgctcgatcgggtagccccggtgcagcaggatgccattgtcgccgtcgatataggtgatcttcgactcgcaagaggcggtcgacatgaagcctgggtcgaaagtgaaacggcccgtggccgtcaggccccgtacgtcgataacatcgggaccaacggtgccggttaaaatgggcagctcgacgggggctgcgccctcgatgatcaactgcgcttttttgtcagccatgtggcctcctatttatgcttcaaatcatcagacagaccccccacgcagggcccgcaccactatattgatataaatccagatgtcaatttgcctaaagtcttgctccagaaggctttaaccagactttttcgtcgaaattgactgccatttacgccttttatcccgccaacgcaatcagctattagggtgaggagcgcgcgttgtcattagtaacctaactgtctatactcggccaccgaccgccaagggcttttgggcttgctttcattgggggtcgcactccctgggtggtgcttacctgaccagtgcactccccaacaactttgccctgattgttaggggctcttcagtgtgaaaaaaagccgtgaatagccaacgacctgtaaacctagacctaaggaccatcaaactccccatcaccggcgttacgtcgttcctgcaccgtgtttccggcatcatcctgttcctgggcttgggcatcatgctttatgcattgagcaaatccctgggttccgaggaaggatacgccgaggtgaaggcatgcttgaccagcccgctggccaagttcgtagcatggggcctcctgtccgctctgctgtatcacctggtagccggtgtgcgccacttgatcatggatgcgggtatcggtgagacgctggaaggcggccgcctgggctcgaaaatcatcatcgccatttccgtggtgctgatcgttctggcaggagtttggatatggtaaccagcgttacgaacctttcgcgttcgggcctctatgactggatggcgcagcgtgtgtctgcggtcgttctcgcggcttatttcattttcctgatcggatacctcgtcgcaaacccgggcattggctatgagcaatggcacgggctgttttcccacaatgcgatgcgaatcttcagtctgctggcacttgtagccctgggcgcacacgcctgggtcggcatgtggaccatcgcgactgactacctgacgccgatggcgctgggcaagtccgcgactgcagtacgtttcctcttccaggcagtatgcggcatcgcgatgttcgcttacttcgtctggggtgtgcagattctttggggtatctgattcatggctaacattccaactatttccttcgacgccatcattattggtggcggcggtgccggcatgcgcgcagcgctgcagctggcccagggcggtcacaagactgccgtgatcaccaaggtgttcccgacgcgttcccacaccgtttcggcccagggtggcatcacctgcgctatcgcgtccgctgacccgaacgatgactggcgctggcacatgtacgataccgtcaagggttccgactacatcggtgaccaggacgctatcgaatacatgtgtcaagaaggcccggccgccgtgttcgagctggaccacatgggtctgccgttctcgcgtaccgagcaaggtcgtatctaccagcgtccattcggcggccagtcgaaggattacggtaaaggcggccaggctgcccgtacctgcgctgcgtccgaccgtaccggtcacgcgctgctgcacacgctttaccagggcaacctgaaagccggcaccacgttcctgaacgaatactacgcagttgacctggtgaagaacgccgacggcgccttcgtcggtgtgatcgcgatctgcatcgaaaccggtgaaaccacctacatccgcgccaaggcaactgttctggccaccggcggtgcaggccgtatctacgcgtccaccaccaacgccctgatcaacaccggtgacggcgtcggcatggccctgcgtgcaggcgtgccggtacaagacatcgaaatgtggcagttccacccaaccggcatcgccggcgccggtgtactggttaccgaaggttgccgtggtgagggtggttacctgatcaacaagcacggcgagcgtttcatggagcgttatgctccgaacgcgaaagacctggcgggtcgtgacgttgttgcccgttcgatggttaaggaaatcatcgccggcaacggctgtggcccgaatggcgaccacgtactgctgaaactcgatcacctcggtgaagaagtcctgcacagccgcctgccgggtatctgtgagctgtccaagaccttcgctcacgttgacccggtagttgctccagttccggttgttccaacttgccactatatgatgggcggcgtgccgaccaacattcatggccaggcgatcactcagaacgccgaaggcgtggacgagatcatccatggtctgttcgcagtaggcgaagtggcctgcgtatcggttcacggcgccaaccgtctgggcggcaactcgttgctcgacctggtggtattcggccgcgctgccggcctgcacctcgagaaggcactgactgacggcatcgaatacgatgacgccaccgacgccaacatcgaagcggccctggcgcgtctgaacgctctgaacgagcgcaccgatggcgaagacgtggctaccctgcgtcgcgagctgcaaagctgcatgcagaactacttcggtgtattccgtaccggcgaatacatgcagaagggtattgcccagctggctgatctgcgcaagcgcatcgccaacgtcaagatcaacgataagagccaggcgttcaacaccgctcgtatcgaagcccttgagctgcaaaacctgttggaagtggctgaagcgacggcgatcgccgccgaggttcgtaaagaatcccgtggtgctcacgctcgtgaagactttgaagatcgcgatgacgaaaactggttgtgccacaccctgtacttcccgggtgacaagcgcgtaaccaagcgtgccgtgaacttctcgccgaagacggtaccgacgtttgaaccgaagattcggacttactaagggtggctgccatgttgaaagtcagtgtttaccgctacaaccctgatcaggacgctgcgccgttcatgcaggaattccaggtcgataccggtggtaaagacttgatggtgctggatgtactggcactgatcaaagagcaggacgaaggtttctcctatcgtcgctcttgccgtgaaggtgtgtgcggttccgacggcatgaacatcaacggcaaaaacggcctggcgtgcatcacgccgctgtccgccgtggttaaaggcaacaagctgatcgttcgtcctctgccaggtttgccggttatccgtgacctggtcgtcgatatgagcatcttctacaagcaatacgagaaggttaagccgttcctgcagaacgacacgccggctccggctatcgagcgtctgcagtccccggaagagcgtgaaaagctcgacggtctgtacgagtgcatcctgtgcgcttgctgctcgacttcgtgcccgtccttctggtggaacccggacaagttcctgggtccagctgccctgctgcaagcgtaccgcttcctggcagacagccgtgacaccaagacgtccgagcgtctggcttcactggatgacccgttcagcgtattccgctgccgcgggatcatgaactgcgtcaacgtatgtcccaaaggcctgaacccgactaaggccattggtcacatccgtaacatgctgctgcaaagcggcgtgtaagcgacgttgtagcaaagcaggaccgttgtgcccgtaaatgctacggcgcaggcttcaaccggcgccgtagttttaacttgagcagcgacttacaaagccgcggctcttattttgaagaaatgagacaagcaggggcattcgggttggtacccgaactatcagcgtgatcctaagtggcttgttttggtcgctgcacttggccttttgcaagcaaactcggtgttttcgccggtggtgtccccaaatcgagggtgaccaagcatgcaagaaagcgtgatgcagcgcatgtggaacagcggctatctttcaggtggtaacgctgcctatgtggaagagctttatgagctctacctgcacgaccctaacgctgtgccagaagaatggcgcaccaaatttcagacgttgtcttcagacggcaacgctgccaccgatgtatcgcacgcaacaattcgcgatcagtttgtgctgctggcaaagaaccagcgccgcgcccaaccggtttccgccggtagcgtgagcagcgagcatgagaagaagcaagttgaagtattgcgactgatccaggcctaccggatgcgtggccaccaggcggcccagcttgacccgctggggctctggaagcgtcctgcacctgctgacctgtcgatcaatcattacggcttgaccaatgccgatcttgatacgaccttccgtgccggcgacctgttcatcggcaaagaggaagcgagcctacgcgaaattcacgaagcgttgcagcagacatattgccgcaccatcggcgctgaatttacgcacatcaccgattccgagcagcgccactggttccagcatcgcctggaaggcgtgcgtggccgtccggtattgtccgccgatgtgcgcagccacctgctggagcgcgtgaccgcagccgaaggcctcgagaaatacctgggcaccaaatacccaggcaccaaacgtttcggcctggaaggcggcgaaagcctgattccaatgctcgacgagctgatccagcgttccggttcctatggcaccaaggaaatcgtgatcggcatggctcaccgtggtcgcctgaacgtgttggtcaacaccttcggcaagaacccgcgcgagctgttcgacgagtttgaaggcaagaagaaggtcgagctgggttccggtgacgttaaataccaccagggcttctcgtccaacgtgatgaccaccggcggtgaagttcacctggccatggccttcaacccatcccacctggaaatcgtttctccagtggtcgagggttcggtacgtgctcgccaggatcgtcgtaacgatgccactggtgagaaagttctgccgatttccatccacggtgacgcggcattcgccggtcaaggcgtggtcctggaaacgttccagatgtcgcagactcgcggcttcaagaccggcggtacggttcacatcgtcatcaacaaccaagtcggcttcaccatcagcaacccgctggatgcgcgctctaccgagtacgcgaccgacgttgccaagatgattcaggcgccgatcctccatgtgaatggtgatgatccggaagccgtgttgttcgtgacccagctcgccatcgactaccgcatgcagttcaagcgtgacgtggtaatcgacctggtttgctaccgccgtcgcggtcacaacgaagcggatgagcctagcggcacccagccgttgatgtaccagcagatcaccaagcagcgcaccacccgtgagctgtacgccgaaagcctgaccaaggccggtgtggttgacgacgcgcgtgttcaggcgaaagtcgatgaataccgcaacgcgctggacaacggtctgcatgtagtaaaaagcctggttaaagagccgaacaaagagctgttcgtggactggcgtccgtacctgggccacgcctggactgcgcgtcacgacacctcgttcgatctgaaaaccctgcaggaactgtctgccaagctgctggaaatcccggaaggcttcgtggtgcagcgccaggttgcgaagatctacgaagaccgtcagaagatgcaagccggcggcctgccgatcaactggggttacgccgaaaccatggcgtacgcgacccttgcgttcgaaggtcacccgatccgcatgaccggccaggacatcggccgtggtacgttctcgcaccgtcatgctgtgctgcacaaccagaaagacgcgggcacctacatcccgttgcagaacctgtacgaaggccagccacgtttcgacctgtacgattcgttcctgtccgaagaagccgtactggcgttcgaatacggctactcgaccaccacgccaaacgcgctggtgatctgggaagcccagttcggcgacttcgccaacggtgcccaggtggttatcgaccagttcatcaccagcggcgagcacaagtggggccgtctgtgcggtctgaccatgttgctgccacacggttatgaaggtcagggtccggagcactcttcggcccgtctggagcgttacctgcagctgtgcgccgagcacaacatccaggtgtgcgtgccgactaccccggcccagatctaccacttgctgcgtcgccaggtgattcgcccgctgcgcaagccgctggtagtgctgaccccgaaatcgctgttgcgtcacaaattggccatctcgaccctggaagatctggccgacggttcgttccagaccgttattccagaaatcgacaccctggacgcggccaaggtcacgcgcctggtcctgtgcagcggcaaggtttactacgacttgctggaaaaacgccgtgccgaaggccgcgaagacatcgccatcgtgcggatcgagcagctttacccgttcccggaagacgacctgatggaggccatcgcgccttacaccaacctcaccaacgtggtgtggtgtcaggaagaaccgatgaaccagggcgcgtggtacagcagccagcatcacttgcgtcgcagcatcggtaaccacaagacaggccttggccttgagtacgccggtcgtgatgcttctgctgcacctgcgtgtggttatgcgtcgatgcacgccgagcagcaggaaaaactgctgcaagatgctttcactgtttaacgccttcgcgctgactgaaaccgaattttaaggacccacagataatggctatcgaaatcaaagccccgtcattcccggaatcggttgccgatggcaccgttgccacctggcacaagaaaccaggcgacgctgttaagcgtgacgacctgatcgtcgacatcgagaccgacaaagtcgttctggaagtgttggctgaagctgacggcgtactgggcgcaatcgttgccgaagaaggcgctaccgttctgtcgaaccagatcctgggttcgatcgaagagggcggcgctgctgctcctgctccggccgccgccgctgcaccggccgctgccgctgctgctccagccgccgctccggcggctgctgctggcgaagacccgatcgctgcaccggctgcacgtcagctggctgaagaaaacggcatcaacctggcttccatcaaaggcactggcaaagacggccgtgtgaccaaggaagacgtggttgccgctgttgaagccaagaagaacgctccagctgccgcacctgccaaggctgctgctccagctgccgctgcgcctgtgttcgctgccggcgaccgcaccgagaagcgcgtgccgatgactcgcgtacgtgccaccgtggccaagcgcctggttgaagcacagtcgaacatggcgatgctgaccaccttcaacgaagtcgacatgaccgaagtcatggccctgcgttcgaagtacaaggatctgttcgagaagtcccacaacggcgtgcgcctgggcttcatgtcgttcttcgtgaaagcggccaccgaagcgctgaaacgcttcccggcagtcaacgcttccatcgacggcggcgacatcgtttaccacggctatgcagacgtcggcgttgccgtgtccagcgaccgtggcctggtagtgccggttctgcgtaacgccgaactgatgagcctggctgaaatcgaaggcggcatcgccggcttcggcaagaaagcccgtgacggcaagctgaccatcgacgagatgaccggtggtaccttcaccatcaccaacggtggtaccttcggttcgatgatgtcgaccccgatcgtcaacccgccacaagctgcgatcctgggcatgcacaacatcatccagcgtccgatggccatcaacggccaagtcgtgatccgcccaatgatgtacctggcactgtcttacgatcaccgcctgatcgatggtaaagaagccgtgactttcctggtgaccatcaagaacctgctggaagacccggctcgtctgctgctggatatctgatagaagcagctgcaggcctcgagtgacaggctgccggataaggcagctgggctcggggcttgcggcttgaaagcttgctgctaaatagaggaactattttcatgtcgcagaaatttgacgttgtagtgattggtgcaggtcctggcggctacgttgccgccatcaaggccgcacaactgggcctctcgactgcttgcatcgaaaaatacaccgacaaggaaggcaaactggcactgggcggtacttgcctgaacgtcggttgcattccttccaaggcgctgctggacagctcctggaaattccacgaagcccaaagcggtttcgcgatccacggcatcaaccatgctggcgtgaccatggacgtgccagcaatggtcggccgtaaagccaacatcgttaaaggcctgacgtctggcgttgccaccttgttcaaggccaacggcgtcacttccctgcaaggccacggcaaactgctggccggcaagaaagttgaaatcaccaagcctgacggttcggtagaagtgatcgaagccgagaacgtgatcctggccccaggctcgcgtccaatcgacattccaccggctccagttgaccagaacgtgatcgttgattcgaccggcgccctggaattccaaagcgtgcctaagcgtctgggcgtgatcggcgctggcgtgatcggcctggaactgggttcggtatggtcccgtctgggttcccaggtgactgtgctggaagccctggacacgttcctgctggctgctgacaccgcggtgtccaaagaagcgctgaaaaccctgaccaaacaaggtctggacatcaagctgggcgcccgtgttaccggttccaaggttaacggcgaagaagtcgtggtgacctacaccgataaagaaggcgagcagaccatcaccttcgacaagctgatcgtagccgtgggtcgccgtccagtgaccaccgacctgctggcttccgacagcggcgtgaacatcgacgagcgtggcttcatccacgttgacgatcactgcgctaccaccgtgcctggcgtgtacgccatcggtgacgtggttcgcggcatgatgctggcgcacaaggcttccgaagaaggcatcatggttgtagagcgcatcaagggccacaaaacccagatgaactacgacctgatcccgtcggttatctacacccacccggaaattgcatgggtcggcaagaacgaacagcagttgaaagctgaaggcgttgaagttaacgtcggcaccttcccgtttgccgcttctggccgtgccatggcagccaacgacaccggtggttttgtcaaagtcatcgctgatgccaagactgaccgcgtattgggcgtccacgtgattggcccaagcgctgcagaactggttcagcaaggcgcaatcggtatggaattcggcaccagtgccgaggacctgggcatgatggtcttctcccatccgaccctgtccgaagcgttgcacgaagcagcgttggcagtgaatggcggcgccatccacatcgccaacaagaagaagcgctaagcgagataataagaaaccacggcggagttgcccgtcgtgagccttgcgcgcaagactcaccgcggaatatccgctggacgcagtcttgcgcagctttacgggcattaagccccgcaagctgcgcgagcagcagtcacaggtggcgcggcactcataatgagcgcagcgccgaatgcgcagtacctaacgaagacggtaaaaagcatgaatcttcacgagtatcagggtaagcagctgttcgctgaatacggcctgccagtatccaagggctacgcagtagacaccccggaagcagcagcagaagcttgcgacaaaatcggtggcaccgagtgggttgtcaaagcccaggtccacgctggtggtcgcggtaaagcgggcggcgttaagctggttcgcagcaaagaagacgccaaggccttcgcacagcagtggctgggcaagcgtctggtgacttaccagactgatgccaatggccaaccagtcaccaagatcctggttgaatcgtgcactgatatcgctaaagagctgtacctgggcgctgtcgttgaccgttcgagccgtcgcatcgtgttcatggcttccaccgaaggtggcgtggacatcgagaaaatcgctcacgaaaccccagaaaaaattctgaaagccactatcgatccactggttggcgctcagccattccagggtcgcgagctggctttccagctgggcctggaaggcaagcaagttgcccagttcgccaagatcttcgtaggtctggccaaactgttccaggatcacgatctggccctgctggaagtgaacccgctggtgatcaaggctgacggcgatctgcactgcctcgatgccaagatcaacatcgacgccaacgccatgtaccgtcagcctaagctgaagactttccacgatccgtcgcaagacgatccgcgcgaagcgcacgctgccaagttcgaactgaactacgtagccctggaaggtaatatcggttgcatggtcaacggtgctggcctggccatgggtaccatggacatcgtcaacctgcatggcggcaaacctgccaacttcctcgacgtgggcggtggtgctaccaaagaacgcgttaccgaagccttcaagatcatcctgtccgactccaacgtcgctgcagtattggttaacatcttcggcggcatcgttcgttgcgacatgattgccgaaggcatcatcggtgcagtgaaagaagtcggcgttaaaatcccggttgttgttcgccttgaaggtaacaacgctgaactgggcgctaaagtactggcagaaagcggtttgaacatcatcgcggctaccagcctgaccgacgctgctcaacaagttgtcaaagctgcggagggcaaataatgagcgtcctgatcaataaagacaccaaagttatctgccagggtattaccggttcgcaaggtagtttccacacccagcaagccatcgaatacggcaccaagatggttggcggcgtaacgccgggcaaaggcggcaccgagcacctgggcctgccagtgttcaacaccgtgaaagatgctgtagctgccactggcgccaccgccagcgtgatctacgttccagctcctttctgcaaggattccatcctggaagcagcattcggcggcatcaagctgatcgtttgcatcaccgaaggcattcctaccctggacatgctggacgctaaagttaagtgcgacgagctgggcgtagtcctgatcggccctaactgcccaggcgtgatcaccccaggcgaatgcaagatcggcatcatgccaggtcacattcacttgccaggtaaagtcggtatcgtttcgcgttccggcaccctgacctacgaagctgttaagcaaactactgacgccggtttcggtcagtcgacttgcgtcggcatcggcggtgacccgatcccgggttcgaacttcatcgacatcctgaagctgttccaggaagacccgaagaccgaagcgatcgtgatgatcggtgagatcggcggttcggctgaagaagaagcggctgcctacatcaaggcacacgtgaccaagccggttgtttcctacatcgctggtgtgactgcccctgctggcaagcgcatgggccatgctggcgcaatcatctctggcggcaaaggcactgcagacgagaaattcgctgcactgcaagacgcaggcgttaaaaccgtgcgttcgctggcagacatcggcaaagccctggctgagctgaccggttgggctgtcaagtaagcctcgcgcttaactgacgcttcaccaggcaaaggccaccttcgggtggcctttgtgctttctggacttgctgaagtagcgagactgatgaaggtcaaaatgtgggagctggcttacctgcgatagcatcgacttggtttacctgatgcgccgagtcgcccgcatcgcaggcaagccagctcccacattgttctctatgccaaatttaagtatgaaaatgcgacatccagatgtcgcttatcggacagttcgccccgcaacagtgcgtttgtcagcccaattctgtactctagccgcctctttatgcgtccgcatcccaaaaggaagccgcgcgctagaccggtcggtccccataaggaccggcagcagttccctcatccatagggaatccctctctaaattccgattcagtagtgtggtatttcctcaaatgaaagtgttgaaaagccaggatgtcctggcgttaggctttatgacttttgccctgttcgtgggcgccggcaacatcatcttcccgcctatcgttggtttgcagtccgggcctcacgtctggatggcagcgctgggcttcctgatcaccgcagtgggtctgccggtggtcactgtgatcgccctggccaaggtcggcggcggtatggacgcgttgagcagcccgatcggcaagatcgccggcggtctgctcgcggcggcggcgtatctggcggtagggccgctgttcgccaccccgcgtaccgcgaccgtttcgtttgaagtgggcctggcgccgctgaccggcgaaagcccgctggcgctgttcctctacagttcggtgtacttcctggtggtgttcttcgtctccctgtacccgggccgcctgctggacaccgttgggcgtttcctggcaccgctgaaaatcatcgccctggccatcctcggcatcgccgcgtttgccttgccggccggtgacgttggcgtggccacaccggaatacgtcgctgcaccgttctcccagggcttcatcaatggttacctgaccatggatacccttggcgcgctggtgttcgggatcgtcatcgtcaatgccattcgctcccgtggcgtcgaatcgccacagctgatcacccgctacgcgatcattgccgggctgattgccggcgtgggcctggcgttggtgtatgtcagcctgttccgcctgggctccggcagccacgccgtggccgccggtgccagcaatggcgcagccgttctgcatgcttacgtgcaacacacgttcggctccctgggcagcggcttcctggctgtgctgatctccctggcgtgtctggtcaccgccgtgggcctgacctgtgcctgcgccgagtacttcagcaagatcctgccgctgtcctacaagacgctggtggtgatcctcgcgctgttctcgctgtttgtgtccaacctgggcctgaccaagctgattgccttctcgatcccggtgctcacagcgatctacccgccgtgcatcgtgctggtggccctgagcttctgcaaagacttctggctggagcagggccgcatcgttggcccggtgatgctggtgtcgttcatctttggctgcattgacgcgctcaagggcgcaggcctggccgattggatgccgacgcagttggcgcacctgccgctgagcgagcaaggcctggcttggctggtgccgtcggtgatgacattggtcgttgctgtcgtggttgaccgcatgctcggcaagcgtagcgaagcgatcgcttaacgaagggtttcgcgcttcactgaaatgcctcgtatcaatcgatacggggcattttttatgcctgtgagacaacaaccttctagagttggaactcggtcaatgtgggagctggcttgcctgcgatagcgcagggtcagacggcgcagtagtgactgagcaggcgccatcgcaggcaagccagctcccacattttgaatcacgtttgtccccatccgctgtgtttaaggacccgcatgtcgttcgttgaaaccaatcagatccatctgctcgccgccctctggttcgtgctgtgttggggtggctacacccgttacgcgctctggaaagcccgcgacaccgcctgcctggccagcgtaatgcacctgtaccgcgaagactggatgcgccgcatgctgctgcgcgacaaccgtatcgccgacgccagcgtgatcggcaatctggagcgtaacgcttcgttctttgcctccagcacgctgatcatcctggcgggtattctcaccgtgttaggggcttccgagcgggcagtgttgttgttggcggacattcccatggtgcagcaggcttcccagggcgtgtcgcaaatcaagctgctgtgcctggcactggtgttcgtctacgcgtttttcaccttcagttggtgcatgcgccaatacaactttgcggcggtgctggtgggctctgcaccgatggtcggtgagcggcaggtgtcggagcaggagcgcagggcgtttgcactgagggcggcgcgggtgatttcgatggcggccaaccaattcaactttggcctgcgggcttattacttcggcatgaccatgctggcttggtttgtcagcccctggttattcatgttgatgagtagcggcgtcgtcgtggtgctgtatcgccgagagtttcattccgacgtactgcaggtgatggtctataccccgactgacagcctagtgaccgagtcggcgaaggaaccttagtgagaggctttagaattagtgcaactttctggcgccgaacaagacggcggacaacaaaaagcccgctatataagcgggcttttttttgcagcaacaaccaggcgattaaggcttggcaggtgctgttggtgtggcggtgccgtcttcttttgctttttcagcgttcgcatcagcctgagctttggcagcatcggcgttttcttttgcagcgtcgttcactttatcctgagctttggccatgtctttctgagcttgctcagaatgcgcttgggcatcttgggctttgtcttcggattttttatcgcaggcagcgagaccgagggcagcggcgaacatcatggaaatagctaaagtcttgcgcatggggtgtttctccttattgaagatatctactggcctttcgagcctgggcgttcagcattagttccttttattcctcagatatataaacgcgggtgttcaaggaactttcacccgcaccgcacactccgcgaatcaacactaataagagtcgagaacatatgaccgaaaatcccctgttagcgcgtgccacacgctttgtttcggccctgcgccattgccaggtgcttggcatcagcgtccatgccgcgagcgaggagggcatgacgctggcactgccgtacggcccgcatatcgtcggtgatcctcaaaccggggtgattcacggcggcgcgctcacctcgttgatggacacggcctgcggcatggccaccctgtgtgtgttgcccgaattcgaggtgtgcccgaccctcgacttgcgtgtggactacatgcatcccgccgaaccgcacaaaccggtgtacggctttgcgcagtgctaccgggtcaccactgatgtgatctttacccgtggcttcgcctatcaggatgacccgcaacagcccatcgcccacgtggtgggcacgttcatgcgcatgggcaagcgcctcaagggcgcacaaggactgggcagcaccatcaagggagaacaggcatgacgcatcgattcaagactcgcttggagcaggcccatgaacgcggtaactacgaagcgctgctcgacctgattccctacgccaagctgatcggcattgaatgcacgcgtttgggcgatgaattgctgtttcgcctgccggctaacaaggacaacattggtaacccgatattgccggcgctgcacggtggcgtgatcgccgggttcatggagctgtcggcggcgttacatttgctggtatttaccggctcgccaggcatcccgaaaatcatcgacttttctctggattacctgcgcgccgggcagtttcgcgacacctacgccaaatgccaggtgtggcgccagggccgtcgcgtggcgaatgtggcgatcaccgcctggcaaagcactgcggccgaaccgattgctaccgcccgtgcacatttcaaaattgaggaatcggcccgcccttgaaatcctggtcttagcccccaactttgatgacaacccgccgccaaccctcaagggcgcggccactgccatccaattggagtttgatgaccatgagtgtggaaactcaaaaggaaaccctgggcttccagaccgaggtgaagcagctgctgcacctcatgatccattcgctgtattccaacaaggaaattttccttcgcgaattgatctcgaacgcctctgacgctgtcgacaaattacgtttcgaagccctgtccaagcctgagttgctggaaggtggcgccgaactcaaaatccgtgtgagcttcgacaaggacgccaagaccgtcaccctcgaagacaacggtatcggcatgagccgcgaagacgcgatcacccatttgggtaccatcgctaaatccggcaccgccgatttcatgaagaacctgtctggcgatcagaaaaaagattcgcacctgatcggccaattcggcgtgggcttctactcggcctttatcgttgccgacaaagttgaagtattcagccgccgcgccggccttgccgccagcgaaggtgtgcattggtcgtccaaaggtgagggcgagtttgaaatcgccaccctcgacaaggctgaccgtggtacccgcatcgtgctgcacctgaaatccggtgaagacgaattcgccgacggctaccgcctgcgcaacatcatcaagaaatattccgaccacatcgctttgccgatcgagttacccaaagaacaagcggccgctgaaggtgaagagaaacctgcccaggaatgggaagtggtcaaccgtgccagcgccttgtggacccgccctcgtaccgaagtcaaagacgaggaataccaggagttctacaagcacatcgctcacgactacgagaacccgctgagctggagccacaacaaggttgaaggcaagctggaatatagctcgctgctctatgtgccagcccgtgcgccgtttgacctgtaccagcgcgaagcgccaaaaggcctgaagctgtacgtgcagcgcgtgttcgtgatggaccaggcggaatcgttcctgccgctgtacctgcgcttcatcaaaggcgtggtcgattccaacgacctgtcgctgaacgtgtcgcgggaaatcctgcagaaagacccgatcatcgattccatgaagtcggcgctgaccaagcgtgtgctcgacatgctggaaaaactggcgaagaacgagcctgagcaatacaaaggcttctggaaaaacttcggtcaggtcatgaaagaaggcccggcagaagattttgccaacaaggaaaaaatcgccggtctgctgcgcttcgcctccactcagggtgaagacggtgagcaggtggtgtcgctggccgagtacttggcacgcgccaaagaaggtcaggacaagatctactacctgaccggcgaaacctacgcacaggtcaagaacagcccgcacctggaagtcttccgcaagaaaggcatcgaagtgctgctgctgaccgaccgtatcgatgagtggctgatgagctacctcagcgaattcgacggcaagaccttcgtcgacgtggcccgtggtgacctggacctgggtaacctggactccgaagaagagaagaaagaagccgaagaagtcgccaaggccaaagaaggcctggttgagcggatcaagaccgctttgggcgacgcggtcagcgaagtgcgggtttcccaccgtctgaccgattccccggcgatcctggccattggcgagcaggacctgggcatgcagatgcgtcagatcctcgaagccagcggccagaaggttccggattccaagccgatctttgaattcaacccggctcacccgctgatcgagaaactcgacggcgagcagagcgaagagcgctttggcgacctgtcgcacatcctcttcgaccaggcggccctggccgctggcgacagcttgaaagacccggcggcctacgtgcgccgactgaacaagctgttggttgaactgtcggtttaacaccgttgtagaaaaacccgcttcggcgggttttttcgttctaacgcacttcaactggagtaaatgatgagccaagtcactgtacgttccgtggtctatcagattgatggccagtcttacgaaagccgcctcgcgttcgatgccggccaccaaggcccattgccgggcctgctgatggcgccgaattggatgggtgtgagtgcgggtgccgaagagatcgccaaaagcgtggccgccaagggttacgtggtgctgatcgccgacctgtacgggcaaactgtgcgcccctcgaatggcgatgaggccggcgcggcgatgatgccgttgaagaacgacaacccggcgctgatcaaacgtctgcaggcggcattcgagcaactgcaaagccagaccgaagcggcggttgatacctcgaagctggcaaccttcggcttctgctttggcggtttctgctcgctggagcttgcgcgtaccggtgcgccgttgaaggctgccgtatcgttccacggcactatcgacacgcagaacccggcaggcgccaagcacatcaagggctcggtgctggtattgcacggtgcttccgacccgctcgtgcccaaagagcagttgccggcgtttgaagctgaaatgaatgcggccggggtggattggcagttgctgagctacggcggtgcggtgcattccttcaccgacccgcacgccaatgtgccgggcaagatgatgtacgacgccaagaccgccaagcgggcgttcaagtcgatgcatgacttgctggatgaagtgttcaagggctgattgcctcatcgcgggcaagcccgctcccacaggttgattgtgaatacattcaaaagtgggagctggctcgcctgcgattgatcgttctcacgctccgcgtgggaatgcctggctggacgctctgcgtgcgctctttgtgacgcgcagcgtcacgggctgtgttcccacgcagagcgtgggaacaatcatctcaccggcaactcgattctttctgtttcccccggcaccgtcggccaatccccagccgcccaacgctgtcgcgcctgttcgatcatggccgggtcgctcgccacaaaattccagttgatccgccgtggcccatccagcggcgcgccgccaaacaccaccacgtggcaatcgctatcagcaaacagcgtcatgtcctgcccggcaggcaacaccaccaagctatgcacctccagcgcctcgccgtccaactgcgcctcaccctccagcacatacaccgcgcgttcctcatgctcatccgggatcagcagcgtcgtggccgtctgcatccgcacctcggcgtacagcgtgggcgacagcaccggcaccggcgatttgaggcaaaaaccgctgccggcgatcaggcgaatctgcacacccaggttgtcactcaccggcaagctcgccgccgcgtgatggctgtagtgccccggcccggtctcgtggtctttgggcgaggccagccacacttgcaggccatgcaggctgaaaccgtcggccctgagcgcctcgggcgtgcgctcgacgtgggcaatcgcactgccggcggtcatccagctgacgtcgccggcctgcaccacctggtccgagccgaggctgtccttgtgttgcaacgcgccttcaaacagataagtcagcgtggacagcccgatatgcgggtgctggcggatattcatgccggtgcccggcgcgtagcgggtgggcagcatgtggtcgaaaaacacaaagggcccgacactgcggcattcacgcgacggcagtgggcgcaggatcggctggccttcgacatcttcggcgcgcgggcggatcacggtgagggtggtcatggtgcgtccctgtctgagcgggttagaggctgcttgagcataacccgctcggcgggagagtggcgctattggctgaaggcgccttcggacaatttcgtctcgatggtgacctcggcagtggtcatcagtttgtgtaccgggcagcggtcggccacgcggtgcagctcgtcgcgctgtgcatcggtgagcacgcctttaagggtcagcttgacgttgagcttgtacttgccctgctgctcctcgctgctgtcgtgggtgacttccacggtcacgccggtcagcgggatgtctttcttctgggcgtagagtttgacggtcagggccttgcaggacgccagggcggcatcgaagtagtcgtggggggagggcgccgagtcgtcgccgcccaggctcttgggcaggtcggtgaacagttcgtgattattgatattcacactgtggcgaaagttgtcgtggttcagggtgttgacggtaacaggcatggtgaacctcacggtttggcaggatgaaggtcatgcagttatagaacatgctggcacttatagaacatgctggcgctggggtgttccgtgttttttgacggatgaacccctgggtcgcgcgcaaggtctacccgtattagccgatatcgaggtttaccgtgccctggaaccgcctgagtctcgccttattgcttgccgccagcagccttgctgcgcaggcgcgcgactatgcctacagcgatgcgcacctgcattacgtggattttttccaggaaaccgccggcatggataaattgctcaaggcgatggccgacgcgcgcatcgagcatgtgatgatttccggcattcccgtggcaaagaaatggcacgaagacgaacccaagcgcccgcgttactacgccggtgatgatgccgatgcctattggtacagcgccactgacgtgatcgttgccgctgcggtaaataagctcacgcccgagcagcgccagcatttccatccgtttctgtccgggttcaaccctaacgacaagaactctgccgcgcatatccagcgcatgctcgatctcaatcccgggctgtggcagggcatcggcgaagtgtttacgcgccacgatgacctgacggccttgaccgctggcgacaccccgcgcgccaataacgaagccatggcagccatttatcaccttgccgccgaaaacgacctgccggtgatgctgcattccaatatcacctccaagcgcgagcgcaacccgctgtacctggcggaagttgaagaatcgctgcgcaaccacccgcacacccggtttatctgggcgcatgccggcaccagtaaagagatccaccgacatcaggtgcagatggactttctactgccgaccttgagccgactgttggaggcctatcccaatctgtacatcgacctgtcctggagcatgctcacgccgtacttgctcgacagtgcgggcaagcccaggccggagtgggtaaagctggtggagcgcttcccggagcgctttatgctgggttcggacgtggtagggcgcttcaacaaactcggtaaggagatgcgccgcttcgatcctttcctcgatgcactgcccgaggccgtagcccgcaaagtcgcacgcgataacttcctggcgattctgcccaaaccccctcgcgatgagcaggcagattgatatcgccttttcgtcttacgcaaagtcgataaagcgccgatacctttcaggagacccgctgcaggtggatgcagcgcattttggaaggaatccaggcaatgagtagtatccgtagtctgaatattgccccccgcgccggcttgggctttggcgtactggcgttgatggtgttcgtcttgggcggcttcgccctgctgcagatggccaatatgcgccagcagtcggaccaggtcgaaaacaactggctgcccagcgtgatggcggtgggggagatgagccaggacctgttgcgggtccgcgcgctgaccctgcgcttgctggttaaccgtgacccccaggcgctggcgcagaacgagcagaaactcaccgacctcaaaaatggcctgcaccaagcgcaaaccctctatgaagggctgatcgtgctgcccgaagagcgcacgctgtttgatcgcttcaaagcgcaggagcagcagtacctgcaacgccaggagcaggttatggcgttctccaaggccaatcagctggaggccgcgatcaagatcgtcaacggcgagatgaaccaactcgccgatgagatggccggcacgctgcacgacctggtcgccttgaacaaggccagcgccaatcaggctgcgaacctggcgcaaaatgtgtttacgcagtctcgcacgtgggtggtcggcatgattgtgctcactgcgctgattaccatcgggctggcggtgtggctgacgcgcagcatcgtgctgccgttggcgcagtcattgagggtcgcccagggcgtggccagtggtgacttgaccggtgagatcagtgtgaccggcagcgacgagcccgcgcgtttgcagcaagcgctcaaaggcatgcaggagaacctgcgcgacaccatccggcgaattgccgaatcctcgaaccaattggcttcggcgtccgaagaactcagttgcgtgaccgaggacgccacccgtggcttgcaccagcagaaccaggaaatcgagcaggcggcgacggcggtcaaccagatgacggcggcggtggaggaagtggcgagcaatgcagtggccacctcacaggcctcacgtgaatctgaccgcattgcccagcacgggcgtgagcaggtgcaccagacggtggaatcgattgaggcgctggccacggacgtgaccgccaatgtgacgcaggtcgaggacctggcgcagaaggtctatggcatcagcaaggtgctggatgtcattcgctcgattgccgagcagaccaacttgcttgcgctgaatgccgcgatcgaagcggcgcgcgccggcgatgccgggcgcgggtttgcggtggtggcggatgaggtgcgggccttggcccatcgcacgcagcagtcgacccaggaaatcgagcagatgatcagcgggattcaacagggcaccgatcaagcggtcagctcgatgcagcagagcaatacgcgggcgcggtctacgctggacatcgccaaggcggcgggcaccgcgctggaagaaattgcgtcagcgttcaccttgatcaacgagcgtaacctggtaattgccagtgcatcggagcagcaggcggcggtggcgcgagaggtggatcgcaatttgatgaatattcgcgatttggcgcatcagacctcgaccggggcgaaccagaccagtgcggcgagccaggagctgtcgcggttggcggtggacctgaacaccatggtggcgcggttttcggtgtagggcgttacaccgaggtggcgctatcgcaggcaagccagctcccacagttgactgtgttcacacatcaaactgtgggagctggcttgcctgcgatgaaagcgactcggtcttgattccgtcacccataaaaaagccccgaaccagtcggggctttttcatgcgatcaacctgcggggcttatttaccctgccagcgtttcagtaccagggtggcgttagtgccaccgaagccgaagctgttgctcatcacggtatcgattttggcgttttcaacagtcttggtcaggatcggcatatcagccaccaccggatcaatctcgtcgatgttggccgagccggccatgaagttgccttccatcatcagcaggcagtagatcgcttcgtgaacgccggcggcgcccagggagtgacccgacaagctcttggtggagctgatggccggcgccttgtcgccgaataccgcacgcacgccttccatttccttggcgtcgccgaccggagtcgaggtgccgtgggtgttcaggtagtcgattggggtatccacggtggacatcgccatctgcatgcaacggatcgcgccttcgccgcttggcgcaaccatgtcgtagccgtcggaagtggcgccgtaaccgacgatttccgcatagatcttcgcgccacgggccagagcgtgttccagctcctcgaccaccaccatgccgccaccgccggcgatgacgaaaccgtcacgcttggcgtcgtaggcgcgggaggccttttccggggtttcgttgtactgggtggacagcgcgcccatggcgtcgaacaggaacgactggctccaatgttcttcttcaccgccgccggcgaatacgatgtcctgcttgcccagctggatctgctcaaccgcagtaccgatgcagtgagcactggtggcgcaagccgaggaaatcgagtagttcacgcccttgatctggaacggcgtggccaggcaggccgaaacggtgctgcccatggtccgcgttacacggtacgggccaacgcgcttcacgcctttttcgcgcaggatgtccagcgcttccatctggttgagggttgatgcgccgccggagccggcgatcaggccggtgcgtacgttcgatacctggtcttcgctcaggccggagtcggcgatggcgtctttcatggccaggtaggcataggcggcagcgtggccgacgaagcggtagatcttgcgatcaatcaattcttcgagcggcaggtcgatggagccggaaacctggctacgcagacccatttcggcatattccgggttgaaacggatgccagggcgacttgcacgcaggttagcggtgacggtctctttgtcattgcccaggcaagaaacaatgcccagaccagtgataacgacgcggcgcatgcggataacccttaaaagttgtcagtggaagtgaatacgccgacccgaaggccttcggcagtatagatctcgcgaccgtcgacagtcaccgaaccgtcggcgatggccaggttcagcttgcccttgaggacgcgcttgatttgaatgttgtaggtgactttcttggcggtcggcaggacctggccaaagaacttcacttcgcccgaacccagggcgcggccgcggcccggcaggccttgccagcccaggtagaagccgaccagttgccacatggcgtcgaggcccaggcagcccggcatcacagggtcgccttcgaaatggcaggcgaagaaccacaggtcaggggtgatatccagctcggcgaccaattcacctttgccgtacttgccaccctcttcgctgatatgggtgatgcgatccaccatcagcatgttcggggcgggcagttgcgcgttacctgggccgaacagctcaccgcgactgcagcgcagcagatcttcccgagtaaaggcgttttgtttggtcatgcgagctcctcaataatcccatgcggcagggtagggcaaatcttcccgaaccgaatgaagcgttcatgcctcatgtcggcagcctacacatagactattgcgttgtagtgaaagtcacagcgataaggtactgaatgtacacttgttcactgaaattttaaaccaggcctgtttatgggcccgttcgggtgcctaagactgccgcactttcgtctttcacgccagtcgcagttggttgatggcgcggggctattgcacccaacgctgcaggatttgctgcaaatccgtgcgtttgaacggcttggccaggtaatcgttcattccggccgccatgcaggcttcgcgatcgccctgcaaggcgttggcggtgagggcaatgatcggcagatcggcgcagccgggcagttggcgaatctgacgggtggcctcgtaaccatcgatcaccggcaagcggcaatccatcaaaatggcggtgaatatcaggctctcggcactgcgtatggcttcggcgccgtcggtggccaggctcacttcaaagcccaggctgcgcagcatcgcttcgaccaccgtgcggttgaccgggttgtcctccaccagcagtacatggcggccatcgccggcgctgctcttgccttcggcgtgcggggcaatcgccggcaagctctgctggtcgatggccaacgggatttccagggtaaacaccgagccccggccttcctcgctctgggcgcgcagcgtgccgcccatgcgttcggccaatgtgcgggcgatcggcaagcccaggccggtgccgccgtaacgtcttgaaatggaactgtcggcctgctggaacgcgtcgaacatcaattccaggcgttcggcggaaatcccgatgccgctgtcgcgcacggtgcaggtgaaccacaccaactcatggtcgagggtttgccaatggggctcgacggtcaccgtgccgtgctcggtgaatttcaacgcgttgccgatcaggtttaccagaatttgccggatacgcgtcgggtcgccctgcacccgcaacgcatccatgcccagtggaatcggcagctccagcgccagaccgcgttgctgggcgctgtgctggaaggcctgggcgcaactgctgatcaggtccgcgaggttgaacgaaatatgttccagctccagcgctgcgcgttcgatgcgcgagaagtcgaggatatcgttgatcaccttgagcaaatgctcggtggactccgaagcgagtgccgcgtactcggtctgctcctcggtcatctcggtggtttccagcagttgcaacatgcccagtacgccattcatgggcgtgcgcaattcgtggctcatcatcgccaggaaatccgacttggcattgttcgcccgctcggcttcctcgcgggtctggatcaactgtgccatggcctggtgctgctcgcggctggcctggttgaggccctcggcgaggttgttgatatgccgcgacaggtcgcccagttccgagtcatccacaatcggcagcggcgttttgtagtcgccttgctggatggccttaaccgcgtggcccatcgcgctgatcggctgcgacaggctggcggccaggcgtcgtgcgagcaggaaggtgaacagcagcgcgaacagggcgaggataccggccttgaacaggatctcctgttggcgctggctgaacgcatcgttggacatgccaacgatcacccggccgaggtagtccgcacgcggtgccttgggttcgttgaggttgtcctggaagaagtcattgcccaactggatgtgttgcaggcggatgggcgcctggaacactttcaccgacagcgagcggtcgtgtttttccgacggctgctcgacgtacaacaggattttttcggcgctgtcctgaatctccaggaagcgcacgtgcggcgtagccagtgtcgcgcgcagcaagctgtcgagcacgtcgatgttgccggaaatgacgccgtattcggtggcgggggccaattggttggcgatcagttggccggtgtggtccagttcctggcgcaggtcctggatacgcacgaaggtgaagaagctgatcaacagcaaggtcagcaacagcgccgggcccagggtgatgagctgggtgcgggtgttgatgtcccaacgacgacgcaaggtcatgggcgtttttctccttcggccaatcgggcggcgacggcgacttcgtcaacctgttcgattcccagtgagcgtgcgacttgcgggttaccgacgactttaaaatgttccgggtacaacgaacgcggccagctggtcggcggatgatccagtagccggtcgagcacatcgagccagtcggcctgatcgctgtaggtgctggccaggctgccggccttgacgaaccccgcattggggcccaccagcggcagttgctgggcgtagctgctgagcaacaggttcttcacggttttggggttgtacaactgcgggtcatcgaggccgagcagcacatcactgttcttgaacagattctgcagcgggcggctgtcattaatgttgtcccagagctgcggcacgatctccagccccatcggtgtcgcatactcgcgcagctccggcagcaggaattcactgtcggtgccatagagcacgccgatgcgcttggcctgcggcaggatgctcgcgatcaggttgagctgacgcgcaagcggcgggtcactccacaacaggctgattttcgccggatgagtgtggcccaggcgctgccgggcttgcaggcggctgatgcgcagcaccagggtcggcgggccctgggcatcctgcaggcgccaatcaagaccgggcaggtccagcacgatcaggcgggtattcgccggcaaacggctgggtgccggcaggtctttgagcggggtaaaagtcacgtggtcttcgggacgctgctgggcaagggcctgcgcaaacgcttgtacaccggccccgtcttcggcagaggtcagcagaatgtcggcgctccaggccggcgcggccagcagcaggcacacccataacaaggcgcgcctccagaagcgtaagacaagcaggagggtcatccgtgactgagcgcccatgtcagaactctaactccgcgctgaagtagaggacgtggcgactgtcgtaatggttgtcgacaaaggtggtgggctggttgtcgaggcgttgttgcaacatgccggccagctccacgttggctttgcccagggcaatgcgcttggctacgcgcaggtcgacccgttcgaagcgataggtgttgagtgcgtcgtcaccataatagaacagcgcgctcgaccagccgtggccccattcacgcagccagccggccgagccgctgttgcgcgcggtttgtgccttgtcgagcgggttgctggaggcggcgtcgacgtaagcataggtcagccgcaggcggtcggcattgctcatgcgccaatcgaactgcgattcggcaccggtaaaccgcgcgctgttggcgttgctggcaatgtattggttgttgcgcagcggcgagctgatcatgtcggtgatttcgtcgtagaacagtttcacgtcgacattcagcccgaggtcggcaaagaagccgttgtagcccagctcgcgcgagcgcatcaactctttatcaaggttgccggggccgcgtgttaccacaaaatattgcccggagttttgcccgaaggtcggggagctcaggttggtgacgcggtagctccagttgacgttgttttcgaacatgtccggcgagcgaatcgcctcggaatacaccgcccgcaaaccatggcgcgggttgatcaggtagttgaccgccacccgcggcgtcagcgaattgccgctcaagtgggtgtcttcgtacattgcaccgccctgcaacagccagtgttcgctggcgcgccattccaggtggccgaacaggcgccaggtggtgtcgtcgagggtgccattgaagtaggtgtcggagtcggcgcggtcgtagcgataattcatgccgctgaccaggcgcaggctgtcggacaggctcagggtgtcctggatctcaatgtcatagcgactctcgcgggtgctctggtcgatatcgccacacacgctctggctggcgccctggcgccactggtccagcacctgattgccgagtgcttgttcggcagcgctgccgggcggcgcggtgccctggctgtaggtgtccatgtggcgggccaacttttcggcgtagttggggttgagctgccacagttgggtcagttccgggctgaacgacaccttggcgtcacaggctttccagacctgctggcggtcccattgctgggccgaaccctgcacgtacaggctgtgttcggggttgaactcgatgttccagcgcatcgagccggcatagtctttggcggtaacgtcggaattggtgccgccttcggtaatcccggcgaataccggcgtgtaggtataagggcgttgattgctgccttccttggcgtccaactgccagtcgatgctctgctgcgcgttcagggtctggctcaccgccaggctgaaacggctgaggcgacggctgtcacggcggtcggcaccgagcttgtcgctgtcaaacccatcgtcctgttgcccggacagcgacaggcgcaagtcgccggtctcccagcccataccctggctggcgtagaagtcattgatgccgcgttcgccacggatcactttaacccgtgaaccgtggctgttggacggcgagcgcgtaaggatattgaccaccgccatcaaggcattcgcgccatagctgaccgtgttggggccgcgaaacacctcgatacgctcgatgtcttccatggccactggaatatcgctccagtccaccgtggccaggcccgcgcggtacaccgaacgcccgtcgatcaacacctgcatgcgccgtgcatcactggcgctggtgccgtggtagttcacggctgcctggttgcctgtggtgtaaccgaccatcatccccggcaccaaacgcagcaactcggcgatgtcgcgcgcaccgctggccttgatcagctcactgtcgatgacggtcatgctgccaggcacggcggcggccgattgcttgaggcgcgtggcggtgagtacctggggcaatggctggctgtcgaggaacaggtcatccgccaacgcaggtgcgctgcacaacagcatcaataatagagatgagcgaggaggagggcccaaatacacggcacggccttgataattacgaatagccgcccatgttaactgaggtggggccatttgccagtcgccgcacttgcaattacttcacacagacgtggcattttccgacaagcgtgtgaattgacacgggggctggccgcaagcgggtcgccccgtataatgccgccatcgccactggtatggattaacggattgcatatgactgaacagcgccctattgcggtcctgggaggcggaagttttggtaccgccgtggcaaacctgctggctgaaaacggccacgcggtacgccagtggatgcgcgatcccgagcaggccgaggccattcgcgtccaccgtgaaaacccccgttaccttaaaggcatcaagattcacccggcggtcgagccggtgaccgacttgttggccaccttgactgactgcgacctgtgctttgtcgcgctgccttccagcgccttgcgctcggtgctggcgccccacgccgagcgtctggcgggcaagcaactggtcagcctgaccaaaggtatcgaggcccacaccttcaagctgatgagcgaaatcctcgaagagatcgccccgcaggcgcgcattggcgtgctgtccgggccgaacctggcgcgggaagtggctgagcacgcgctgacagccaccgtggtcgccagtgaagacgaggcactgtgcgagcgcgtccaggccgtgctgcatggccgtacctttcgcgtctacgccagcagcgaccgctttggcgtcgagttgggcggggcgttgaaaaacgtctacgccattattgccggcatggccgtggccttgggcatgggcgaaaacaccaagagcatgctgattacacgcgccttggcggagatgacgcgttttgcggtgaaccagggcgccaacccgatgaccttcctcggcctggcgggcgtgggcgacttgatcgtcacctgctcgtcgccgaaaagccgcaattatcaggtcggttttgccctcggccaaggccttagcctggaagacgccgtgacgcgcctgggtgaagtggccgaaggcgtcaacacgctcaaagtgctgaaggccaaggcccaggaagtcggtgtgtacatgccgctggtcgccgggctgcacgcgatcctgtttgaagggcgcaccttgaaccaggtcatcgagttgctgatgcgcgccgagcccaagaccgatgtcgactttatttccaccagtggtttcaactgaggaacgcgccatgaacgatccgaaagcaggccctaaatacgagtccatcctcctgcgagtcctgtggatgctggtgtttgccctgatctggcaagtcgcgcagttcctgctcggtattttggtggtggtgcagttggtgtatcgcctgttctacggcgcgccgaacctgggcctgatgaattttggcgacagcctcagccagtttcttgcgcaaatcggccgtttcggcagcttccacactgatcaaaagccgtggccgttcgcggattggccgaccccgcgcgcaccggagggcgaagccgcccacagcgtgccaccggcgccgcacccggtgcgcgatgaggagcccaaactgtgaagctgtggattttgcgtcacggtgaagccgaagcccacgcgccttccgacgctgagcgcaacctgaccgaacatgggcgcggcgaagtgttgcgcagtgctgcgcagctgatcggccagccgatcagcgccatcatcgccagcccgtatgtgcgcgcgcagcaaactgcgcaactggtgcgtgaggcgttggggtttgagccgcagattcgcacggagccgtggttgacgccggacagcagcccgttgcaggtgctggaaaaactcgacacggatgacaatgtgctgctggtcagccaccagccattggtgggcagcctgatcagctttttgcagcatggtcatctgcgtcagccgcaaccgatgcacacggccagcctggcggagttggaaggggactttccgttggcggggttgatgagcctggtgggtgtgaaaaacccgtaggcgatgggccttctgcgcgcggccatcgtggtcaacggggcctgtcagatcaaaatccgttctgctctgctgtgggagctggcttgcctgcgatgcagacacctcggtactgcagggagatgcggtcgatgccatcgcagcataggtacgggttgagtactttagttggcgcggggccgctgggtacatatccgttatttggatcacggctgctatgggttccgcccttacggcggctcacttttgaacagcgtgtatggaccggacacatggttgacacctgtgcgaggacatagtggacacatcatgccccgtagtcagggttatttacgtcgaaggtccgtagaaattgatgacagaagtagacatcaaataagccatct

SEQ ID NO: 73 - DNA, 38324 bp, Pseudomonas poae FL10F
caggccgcctcggccttgcttttgatctaaccactcaggtcggctactaggccgccgtgctcttgcttttgatcttgcttttgattttgatcttaggcgccccatcaaccacgctggccgaacgcaggctttggagcgggggtaaaccggcaggacgccggtttagccgcgctgggccaaggatggcccatcgcggcggcccccgctccaaagccggagtgagggcacaccgagcctaggcgaggtgccgagtggtggggcaagagcccttttggttacttttggggctcttttccaaaagtgacccgctgtaagagcggaaccgatctgagccatcacccaaataacggatatgtacccagcgaccccgcgcccaactacattccccaaaacgcaaaaacggcgcccaaaggcgccgttcttttactgcatattgctaagcgatcaaacgcccagtaccgcgtgctgcaccagggtgagcaacggctgtgggtacacgcccaagaagaacgcgagcagggcaatcgccagcagcatcacgccaccggctttctgttcccagtgcagctcggcatccacacggcgcaggtttggctcgatcagatacagggtgaccatcacacgcaggtagtagaacacgccgatggcgctacccagcacgagggaggcaaccaaccaccattcgtgagcttcaacaccggtcgcaacgatgtagaacttaccgataaagcctgcggtcagcgggatacccgccagggacagcatcatcacggtcagtacggcagtcaggtaaggacggcgccagaacaggccgcggtattcgtacaaggcgtcagcgtcacggcctttgaacggcgaggacatcagcgtgatcacgccgaacgcgccaaggctggtgatcacgtaggtgaccaggtacacgcccatcgcttccaccgccaggcctttgctcgccaccagcgcgatcagcaggtagccgaagtgcgcgatggaggagtaaccgagcagacgcttgaggttgttctgggtcagggccagcaggttaccgaacaggatcgacgcaatggcaatcacggtcagcacgttgctcagcacgccggtgttggccgcaggcgagatctggaacagacgcaccatcaccgcaaacacggcaaccttcgacgccgtggccaaaaacgccgccaccggcgccggggcgccttcgtagacgtccggggtccacaggtggaacggcaccagggagagcttgaacgccaggccgatcagcatcatggccaggcccagttgggcaattggcgcaggcatgctggtggttgccagggcgtgaccgataccggtgaagctcaggctgccggcttctgcgtagagcagggccataccgaacaacaggaacgcggaaccggcggccgacagcaccatgtacttgatgccggcttccagggagcgcttgttgaagaaggcatacgccaccaggccgtaggtcgggatcgacagcagttccaggccgatgaacaagccggccaggtgctgtgcgctgaccagcacgatgccaccggccgcagccagcaggatcagcaggtacagctcttccttgttgcccgggtagcccgtgccgccttcgccgaggtaggcgtgggcgagggtgacgcaggccagggtggcgaccaggatcaacgcgatgtacagcagcgcgaagtcatcgatcatcatcagcggggtcacggccaatggcgcgaccttgagggctggaatgatcgacagcagggccaggttcaaaccggcacaggacagcaggaacgtttgcgagtgattgcggcgccaggcgatcgccagcatcaccaccacgatggtgaggctggtgatcagcagcggcgcaagcgcgataaagtgttggatcgtgaattccatagcgctcttaccgtgccgaagcgagttgagtgaaggcggtgctgaaccactgctgcacgccatgcatcgtcgcggcagaagtgtccaggaacggttgcgggtacacgccgatgtagatcagcagtaccgcaaggccgagcaccatgatcagttcgcgagcatccatcccttgcaggacggtgtcggacttggccgggccgaagtaggcgcgatggatcatgatcagcgagtaaaccgaaccaaacaccaggccggatgtagcaatggcactgatccacggcgtgtgcacgaacgaacccatcaggatcaggaactcgccgatgaagttgccggtgcccggcaagcccagggacgccgcagcgaagaacaggctgatcgccggcaggtaagcgatgcgcgaccacacgccacccatttcacgcatgtcacgggtgtgcaggcgctcgtacagctggccactgaggataaacagtgccgcggccgaaacgccgtgggccaacatctggatcacggcgccttgcaacgccagctggctgccggagtagatgccgatcagtacgaaacccatgtgggaaacggacgagaaggcgatcagacgcttgatgtcggtttgtgcgaaggccaggaacgcaccgtagaagatcccgatcagacccagggtcatggcgatcggcgcgaactcggccgaggcattcgggaacagcggcagggcgaaacgcagcaggccgtaagcagcggtcttcagcaggataccggccaagtccacggaacctgcggtcggcgcctgggcgtgagcgtcaggcagccaggagtggaacggcaccaccggcagcttcaccgcgaaggcgatgaagaagccgagcatcaggatgtactcggtggtcagcgacatcttggttttcaacaggtcggcgtagttgaaagtaatcacgccggtgttgttgaagttgaccagtaccagacccaggatcgccaccaacatgatcaggccggaagcctgggtgaagatgaagaacttggtcgccgcgtagatccgggttttcttgccgtccgaagaactgtgaccccagagcgcgatgaggaagtacatcggcaccagcatcatttcccagaagaagaagaacatgaacaggtccagcgcaaggaacacgccgacaacaccgcccaggatccacatcaggttcaggtggaagaagcccacgtgacgctgaatttctttccaggagcagagtaccgagaggatacccagcaagccggtcagcaggatcatcaacagcgacaggccgtcgagggccaggtgcacattgatgccgaagcgctggatccacacgtgcttgaattcaagcgcgaaggttggatcgacacccggtgccggagcgaatgaatagtcaccgtgggcccacagccagaggccgagcgcgagttccagggacatggtcagcaacgcaatccagcgggggagggtggcgccgaagcgttcacccatccagcagagcaggccgccgataaaggggatcaggattagccagggcagaatcatgacgggctcgtttcctttcgcaagttcgcaaagttcgcaatgtacatagttacaccgccacgacgacgatggcgccgatcaccagcacggcaccaacggccatggaggcggcgtaccaacgcaattggcccgtctcgctgcggctcagggcggtgtgaccggccttggcggcgcgcgggatcaaaccgatggtctggtcgagcgggtctttgcgcagtacatggctgatcgcaaggtaaggcttgacgaacagtttgtcgtagatccagtcgaagccccaggcggcgaaccaccaggccgacaggaagcggccgatgccactgttggcaacagcggtaacgaagcgacgcttgccgaggaacagcagggctgccagcaggataccggccagggcgatggcgcccgaggcgatttccaggctctgcttggcggcgccgccggcatggccagcgctttccggcagtacgccggccagtggcggggtgatcatggcgccgatgaaggtcgacaggatgatcagcaccgacagtggcaaccagtgggagatgccgtggcctgcgtgtgcttcggtcttggcttcaccgtggaaggtgatgaagattaggcggaaggtatacagcgaggtcatgaaggcaccgaccaggcctgcgtacagcaggttctggttaccgctggcaaaggcttcccagaggatttcgtctttcgagtagaaacctgcggttaccagcggcagggcagccagggcggcaccaccgacgatgaagctggcgtaggccaacggcagtttcttccacaggccgcccatcttgaagatgttctgctcgtggtggcaggcaacgatcaccgcaccggaagcgaggaacagcagcgccttgaagaaggcgtgggtcatcaggtggaagatcgccgcgtcccaggcgccgacgcccagggccaggaacatgtagccgatctggctcatggtcgagtaggcgaggatccgcttgatgtcggtctgcaccagcgcggcaaaaccggccagtaccagcgttacgccgccgaccaggcccaccaggtgcaggatttccggcgccagggtgaacaggccgtgggtacgcgcgatcaggtagacaccggcagttaccatggttgccgcgtgaatcagtgcggaaaccggcgtagggccggccatcgcatccgccagccaggtttgcagtggcagttgcgcggatttacccacggcgccgcccagcagcatcagggttgccagggtgatccagaagtcgccgacctggaatttctgcggtgccagcaccagcagttcctggatgttcagcgtgcccacttgttggaacaggatgaacaggccgatggccatgaacacgtcgccgatgcgggtaacgatgaaggccttgagtgccgcgttgccgttgttgcggttgctgtagtagaaaccgatcaacaggtacgagcacaggcccacgccttcccagccgaagtacaggaacaacaggttatcgcccaataccaggaacagcatgctggcgataaacaggttggtgtacgagaagaagcgcgagtaaccggcttcaccgcgcatgtaccaggatgcgaacaggtggatcaggaagcccacaccgaccaccacgccgagcatggtgatcgacaggccgtcgacgtagagggcgaagttcggcttgaagccgtccaccgacatccactgccacagcaccagggtgtagtggccgccttccggcggcgccacgttgaattgccagatgacgtaggcggcgacgatcgccgacaggccaatggaacccacaccgatcagggcagacaggttttccgaccagcgtccacgggagaacgacagcagcaggaaaccgatcaggggaaatacgaaagtcagaaagatcatgttcatccgcgcatctcactggcagcgtcgatatcaagcgtgtggaagcgacgatacagttgcagcaggatcgccaggccaatactggcttcggcggctgccaggctgatcaccaggatgaacatgacttgtccatccggctggccccaacgtgcacctgcaacgatgaacgccagtgctgcagcgttcatcatgatttccaggctcatcaacacgaacagaatgttacggcgaaccatcaggccgaccaggccaaggcagaacaggatgccggcgaccgccagaccatgctccaaagggatagcaggcatcgtcattgctccttggcttcgttgcggcccaagtggaaggcggtgatggctgcagcgagcagcagcatcgaagccagttcgaccaccagcaggtacgggccgaacaggctgatgcccacggctttggcgtctacggtggtgtggccgatggcctggccgctctggtgagcgaacagcacatacagcagttcacccagcagcagcgctgccaggacaaccgggccgagccagatgccgggcttgagccagacgcgctcctgggcgaccgaagccggccccaggttgagcatcatcaccacaaacacgaacagcaccatgatggcgccagcgtaggcgatcacttccaggacaccggcgaacggtgcgccgaggctgaaaaaggtcatggccacggcgatcagcgaaatgatcaggtagagcagggcgtgcacggggttggtgttggtgatcacgcgaagcgtggacaccactgcaatacccgacgcgaaatagaaagcgaattccatctttcttccttaaggcagcaagctcttcacgttgatcggctcggcttcgttttgtgcggcgcctttcggcttaccggcaacggccatacctgcaacacgatagaagttgtaatcagggtttttaccgggaccagagatcagcagatcttctttctcgtacaccaggtcctgacgtttgaactcggccatctcgaaatccggtgtcagctggatcgcggtggtcgggcaagcttcctcgcagaggccgcagaaaatgcagcgcgagaagttgatgcggaagaagtccgggtaccagcgaccgtcttcggtttcagctttctgcagggagatacaacccaccgggcacgccacggcgcacaggttgcaggctacgcaacgctcttcgccatcggggtcgcgggtcagcacgatacggccgcgatagcgcggcggcaggtacaccgcttcttccgggtattgcagggtgtcgcgtttgcggaagccatggccgaaaaccatcaccaggcttcgcaactgggtaccagtacccttaacgatgtcgccaatatatttgaacatgggtcaaatcctcactgaaccgcgccggctggcgtgttcaacaacacaacagcagccgtcaccagcaaattgatcagggtcagcggcaggcagaatctccagctgaaatccatcacctggtcatagcgtgggcgcggaatagaggcgcgcagcaggatgaacagcatgatgaagaacgccgtcttcaagaagaaccagaagaacgccagttgcggcaggatgttgaacgggccgtgccagccgccgaagaacagcgtgaccagcagtgccgagatcaagatgatgccgatgtattcgccaacgaagaacatgccccatttcatgccggcgtattcaatgtggtaaccgtcagccagttcctgttccgcttccggttggtcgaacgggtgacggtgagtcacggcgacgccagcgatgaagaaggtacagaagccgaagaactgcggaatgatgaaccacaggttctgcgcctggtactcgacgatgtcgcgcatgttgaacgagccgacctgcaccacgatgcccatcagcgccaggcccatgaacacttcgtaggacacggtctgggccgaagcccgcaagctgcccaacagggcgaacttgttgttgctcgaccaaccggcgaacagcaccgcgtagaccgacagaccggccatggcgaagaagaacagcaagccgatgttcaggtccgccacgccccaggtcggggtgatcgggatgactgcgaaggcgatcagcaaggcgctcatggccacgaccggtgccagggtgaagatcaccttgtcggcaaacggcggggtccagtcttccttgaagaacattttcagcatgtcggcagcgatctggaacatgccgaacgggccaacgcggttcggaccgtaacggtcctgccaccagcccagcaggcgacgttcgacgaagctgagcagggcgcccgcaacgaccacggccaacaggatcacgatggccttgacgaccgagatgatcacgtcgatcacttcaggggtgaaccaggtcattgcgctgcctcctgcagaccgtcaacggtttggccaaagatcgccggcggaatgcccgcgaggcctttaggcagtgcaaccaggccagcccccaactcttcgttgatgcgcagcggcagacgcagggtctggccgccgacggtcaagctgagcagggcaccgtcgttgacgcccaggcggtcggcttcggacttggccacggacacgtaagcggccgggatgcgctcttgtaccggtgcggctttggaagaggtttcttcgctgccgaacaggtggaagaacggcacaacctgccaagtgccctgggccgggttgaacggacgcggtacggcagcgaaccagttcagcgcatcaccagtgctttcgatcaggcgggtgcccgggtcgccagcgcggatatgaccaccaacttcgtcctggaacttgttccaggcctgtggcgagttccagcccggcgaccaggcgaaaggcacctgctgacgcggctcgaccgaacccgagtaaccttccatggagaaggcgaacgcggtgtcggggtcttgcggggtacgcggttcgtgcacgctgatgtcggcgcgcatggcggtacgcccggagtaacgcagcggttcacgggccagtttcaagcccttgatgcggaacgaggcggacggtgcagcgtcgacgatgcgtgccaactgcggcgcgctcgcggcggcagcggccgtcacgtggtcgagctgggtccagtcgatcggctggttcagcaaggtggcgcgcagggcatgcagccagcgccagccttcgtgaaccaggatgctggcgtccatgtacttcggatcgaacacctggaagaagcgctgggcgcggccttcctggctgaccagagtaccgtcgccttcggcgaaagtagcggctggcaggaccaggtcggcacgttcgctggtggcggtcttctggtggtcggcaacgatcagcactttggcggcgttcagtgcagcgtcaaccttggcagcgtcggtgcgggtgtacaggtcgttttccagtaccacgatggcgtcggctttaccgtcagtcacggcttgcagcgcggcatccagcgattcgccaccgagcatggccaggccaaggctgttggcttccggcacgaccaggctgatggagccgttcttgtcgcgcagcttcaaggctttggcgatgttggcagcggcttcgatcagcgctttggaacccaacgaggtgccggcaatgatcaatgggcgcttggccgccagcagggcgtcggcgatgcgctgggccagttcaccggcttcagtgtccaggccttcgacggcaggcgcgctggcatccagggcatgcgccacggcgaaaccgatgcgggccaggtcgtccggtgcagcgtggacgcactcttctgcgatgtcgtcgagcttggtttctgccaggcttgcaataaacagcgggttcagcgcgtgctggccgatgtttttcaccgcagcgtcgagccaaggctggacgcgcatggcatcggccatgtcttcagccttgcctttgaccgactgacgcagcgacagcgcgatacgcgcggcagtctgggtcaggtcttcaccgagcacgaagatcgcgtcgtggtcttcgatgtcgcgcatgttcggaaccggcagcgggctgtcgttcagtacttgcaggaccaggcggatgcgctccaattcaccggcttcgataccggagtagaagtgctcggcgccgaccagctcgcgcaacgcgtagttgctttcgaggctggcgcggggcgaaccgataccgacgatgttgcggccgcgcagcaggtcggcggctttatccagcgcgtcgtccaggctcagcttggcgccaccggccagcagtggctggcgtgggcggtcttcgcggttgacgtagccatagccgaaacggccacggtcgcagaggaagtactggttgaccgaaccgttgaagcggttttcgatccgacgcagttcaccgtagcgctcgcccggggagatgttgcaaccgctggagcagccatggcagatgctcggcgagaactgcatgtcccacttacggttgtagcgctcggagtgagtcttgtcggtgaacacaccggtcgggcagacctcggtgaggttgccggagaactcgctctcaagcacaccgtcttcaacgcgaccgaagtacacgttgtcgtgggcgccgaatacgccgaggtcggtgccgccggcgtagtctttatagaaacgcacgcagcggtagcaggcgatgcagcggttcatttcgtgggaaatgaacgggccgaggtcctggttctggtgcgtacgcttggtgaagcgataacggcgctcgttgtggccggtcatcaccgtcatgtcttgcaagtggcagtgaccgccttcctcacagaccgggcagtcgtgcgggtggttggtcatcagccattcgacaacgctggcgcggaacgccttggattcttcatcttcgatggagatccaggtgttgtcggtggctggggtcatgcaggacatgacgatacgaccacgggtgtcgttctcgtcggtgtactgcttgaccgcacactggcgacaggcaccgacgctaccaagagcggggtgccagcagaagtaagggatgtcgaggcctagtgagagacatgcctgtaacaggttgtctgccccatcgacttcgagcgctttgccgtctacgtggatagtggccatggttcaaagttcttcgttggcccgttgtcagcgggcgtggctaatggaatcttgttattcatgtgcatctacacagccataaaggcgtcagcacatgagaaagcgaagggcacggacccttcgctctttaagcgttacgcaccaaccatggttggtgtgaccacctgattcagatcgccagcgcgcgcagatgcgatgccagcctcgaattcagagcggaagtatttgattgcgctgcccaatggttccacggcgcccggtgcgtgagcacagaaggtcttgcctgggccgaggaagccgaccagacccagcagggtctcgatgtcgcctggctggccttcgcctttctcgatcgccatcaagagcttcacgctccagggcagaccgtcacggcacggggtgcagaaaccgcaggattcgcgggagaagaactgctccatgttgcgcagcagcgagaccatgttcacggtgttgtccaccgccatcgccaggcccgtacccatccgggtgccgaccttgccgatgccgccggcatacatttgtgcgtccaggtgctcagggagcaggaagccggtgccggcgccgcctggttgccaggctttcaaggtgtagccgtcgcgcatgccgccggcgtagtcctcgaacagctcgcgagcggtcacgccgaatggcagctcccacaggccagggttcttgaccttgccggagaagcccatgagcttggtgcccatgtcttcgctgccttcgcgggccaacgatttgtaccagtccacgccgtcggcaatgatcgccggcacgttgcacagggtttcaacgttgttcacgcaagtcggcttgccccatacgcccacggcggcagggaagggcggcttggagcgcgggttggcgcggcggccttcgagggagttgatcagtgcggtttcttcaccgcagatgtagcgcccggcgccggtgtgcacgaacagttcgaagtcaaaaccggaacccaggatgttcttgcccagcaggcctgcagccttggcttcttccacggcacgggtgaggtgcttggcggcggtggtgtattcgccccgcaggaagatgtagccacggtaggttttcagcgcgcgggcactgatcagcatgccttcgatcagcagatggggcagttgctccatcagcatgcggtctttccaggtgttcggctccatttcatccgcgttgcacagcaggtagcggatgttgatggattcgtccttgggcatcaggccccacttcacgcccgtggggaagccagcaccgccgcgacctttaaggccggcgtctttcacggtctggacgatatcgtcctgggccatgtcggcgaaggccttgcgtgcagcggcgtaaccgttcttggcctggtattcgtcgagccataccggctcgccgtcgtcacgcaggcgccaggtcagcgggtgagtctcggccgaacgcttgatcaggttggccgggccgaaagatgtaagggtcatgggtagccctcaagcaattgggtcacgccagcaggctgcacgtcaccgaatgtgtcgtcgtcgatcatcaacgccggcgccttgtcgcagttgcccaggcagcacaccggcagcagcgtgaagcggccgtccggggtggtttggccgaggccgatgcccagcttgttctggatctcgctgaccaccgactcgtgaccaccgatgtagcagaccatgctgtcgcacacgcgaataatgtggcgacccaccggctggcggaagatctggctgtagaacgtggccacaccttcaacgtcgctggccgggatgccaaggatctcgccgatggcgtagagggcgccgtccggcacccagccacgttccttctgcacgatcttcaaggcttcgatcgacgccgcgcgcgggtcttcgtagtgatgcagctcgtgctcgatggccgagcgctcggtttcactgagggtgaaacggtctgtctggataagcgtgctgttcatgcttagcggtccacgtcggccataacgaaatcgatactacccaggtacgcaatcaagtccgcgaccatctcgcctttgatcaccgaagggatctgctgcaagtgggcaaagcttggggtacgaatccgggtgcggtagctcatggtgccgccatcgctcgtcaggtaataactgttgatacccttggtcgcttcgatcatctggaaggattcgttggccggcattaccgggccccacgaaacttgcaggaagtgcgtgatcagggtttcgatgtgctgcagcgtgcgctctttcggcggcggcgtggtcagcgggtgatccgccttgtacgggccggccggcatgttgcgcatgcactgctcgatgatcttcaggctctggcgcatttcttcgacgcgcacgatgcaacggtcgtaggcatcgccattcgcggccagcggcacttcgaattcgaagttctcgtagccggagtacgggcgcgctttacgcaggtcgaaatcgcagccggtggaacgcaggcccgcaccggtgacgccccattccagggcctctttggtgttgtactgggcaacgccgatggtccggcctttgagaatgctgttgtcgagggcggctttctggtactcgtccagacgcttgggcatccagtcgatgaattccttgaccaggcgctcccagccgttcggcaggtcgtgcgccacaccgccgatgcgataccaggccgggtgcaggcggaaaccggtgatggcttcgatgaccttgtaggcgcgctgacggtcggtgaaggtaaagaacaccggggtcatggcgccgacgtcctggatgtaggtacccaggaacagcaggtggctggtgatccggaagaactcggccatcatgatgcggatggtgtcgacgcggtccggcactttaatgccagccagcttctcgaccgagagcacgtacggcaggttgttcatcacgccgccgaggtagtcgatacggtcggtgtacgggatgaagctgtgccaggactggcgctcggccattttttcggcaccacggtggtggtagccgatgtccggtacgcagtcgacgatttcttcgccgtccagttgcaggatgatacggaaggcaccgtgagccgaagggtggttcgggcccaggttgaggaacatgtagtcctcgttggtgccggagcgtttcatgccccagtcttccggacggaagcgcgcagcctcttcttcaagctgttgcttggcgaggttgaggctgaacggatcgaattcggtggcgcgcgccgggaagtccttgcgcagcgggtgaccttcccaggtcggcggcatcatgatgcgcgtcaggtgcgggtggcccgggaagtcgatgccgaacatgtcccagacttcacgctcgtaccagctggcgttcggccagataccggtcacggtcggcacgctcaggtcgctctcggacagcgcgaccttgatcatcacgtcgctgttacgttcgatcgacagcaggtgatagaacacggtgaaatcggcgccgctcggcagcccctggcgcttggtgcgcagacgctcgtccacgccatgcaggtcatagagcatgacgtacggcttgggcaggttgcgcaggaaggtcaggacttcgacgagcttggcgcgcgccacccacagcaccggcataccggtgcgtgtggcctgggcggtgaaggcgtcagggccaaaacggttattgagttcgacgaccacatcctggtcgtctgccttataaggcgggatgtacagagcactgcctgtagtcatggttttttatcgctttcggtcaacgtaaagaatgaagccaggttttcgttctataaaagaagcggtgctggatcagacttcgtcggggctgcgcaggttggtgactgcgattcgctgttcgcggcgctgttccttttgcgacggcatctcggcgcggtacacgccttgatcaccgacgacccaggaaagcgggcgacgctccttgccaatcgattcctgcagcagcatcaagccttgcaggaatgcttcagggcggggcgggcagccaggcacgtagacgtccacgggcaggaacttgtccaccccttgaacgacggagtagatgtcgtacatgccaccggagttggcgcacgaacccatggagataacccacttcggctcgagcatttgctcgtagagacgctgaatgatcggcgccatcttgataaagcaggttccggcgataaccatgaaatccgcctggcgcggtgatgcccggataacttcggcgccaaagcgcgcgatgtcgtggggcgccgtgaaggcggtggtcatttccacgtagcagcacgaaagaccgaagttgtacggccacagggagttcttacgtccccagttgaccgcgccactcagcacgtcttccagcttgcccatgtagatgtttttgtggacttggtcttctaacgggtcggaaacggtttcgcgttcgccgattgggtactgctcgttaggagcatccgggtcgatcctggtgagattgtattgcatcgccaaagcctcattgtttcagcttcgcttgccgcttgcgacgagcttccggagcccaatcaagggcgcccactcgaaataggtagacaaggcctgccaacagaattgctatgaaaacgagggcttcgacgaatccggtccagccgctttcgcggacggacacagaccaggcaaagagaaagagggcttcgatatcgaagatcacgaacagcatcgcgaccagatagaatttggctgagagccgcaagcgggcgccacctgtaggcagcatgccggactcgaacggttcatttttgctgcggccccaggcttttgacccgaggaggctggagacaccaagcatgaaggcgcaaaggccgacaacaccgaggaggaaaatggcaaagccccagttgtgggccatgagtcctgtcgcttcggtcatgctggaaatccttaacagagagcaaaggtctctgagctcgaaaaagtaacgatgcagtgacgatatgtcgcactgcaatcaatcgcggtgattttatggctaaacaccgggcaagtaaaattcctatagcgaaattattcgatggaataagcacatagtgcaccttcttggggctgtagcccttgcgtggcgggcattagcggcctttttatcaaatatgttttgtttaaccagtaacgaagttttcatggtctaaatgataatgaatattgtttgcgtgggttttaagcggatgggtgtggtgtaacgggggaagttgctgttacttgctagagtgccgctagttcatgcaggggatcttttaaccgattttattcaggtgaataccgctctggatcaatgttttgccagaaaccgggtggcaaggaactcaatcaccctctcggcccccgactgatggctattgtcagaaaattcccacaagagtacaaatgtactccatgacgactctgactccccgccgcaccgccatcctgacctttatccgcgaccgcatcgcgcaacaaggccaaccgcccagcctcgccgagatcgccgaggcgttcggcttcgcctcgcgcagtgtcgcccgcaagcacgtggtggcgctcaccgaagccggcttcatcgaggtcaaccccaaccaggcgcgcggtatccgcctgctcaaccaaccggctcgccccgaatggctggacgtgccggtgctcggccgtgttgcggcgggcttgcccatcggcgccgacgccgaagtgcacaaccgcctgcaactcgaccccgccaccttcgcgaaaaccccggactacctgctgcgcgtccagggcgattcaatgatcgaagacggcatcctcgacggcgacctggtcggcgtacgccgcagtgccgaagccttgaacggccagattgtagtggcgcgcctggacggcgaagtcaccatcaaacgctttgaacgccatggcgagcatgtgcgcctgctgccgcgtaaccccgcgtatcaacccatcgtggtcgggcctgatcaggacctggccatcgaaggggtgttctgcggcctggtgaggcaaggctgatgggcgccgtcgttgccctggacgcgctgttcaatggcggccgcgtctggaagggccggcctgctgcgccaccggccagcgtgcaccccactgggctggcggcgctggacgcggtgctgcccacgggcggctggccggaatcggcgttgagcgaaatattgatggccaaggaaggtgtcggcgaactgcaattggtcttgccgaccctggcgcggctgtcggcggcaggcgagcgcattgtgctggtcgcgccaccttatacgccgtacccgcacgcctggcagaacgccggggtggacttgcgccagctctcggtgatccaggccgaagagcgcgatgccttatgggccgtcgagcaatgcctgcgttccggcagttgcggcgcggtgttgtgctggccgcgcaaggccgatgaccgtgctttgcgccgtttgcaggtagcggccgaaaccgggcagaccctggcgtttgcctggcgcgctttaaatgaagcggtgaatgcctcacccgccgccttgcgcctggccgttgaggcaaggccggcgcaagtgcgcgtgctcaagtgccgcggcgggctggcccatccggcgccgattgcgctggcggggcactgaggttgccatgcgctgggtgtgtattgtcttcccgcaattggcgctggacggggtgcagcgcctgcaccccgagcccgaccaacccctcgcgttgctggccggcacgccgcagcgccgcgtgctgcaaaccgtcaatgaagccgcccgcgccttgggcctgcgccccggtcaatcgctgacagcagcgcatgcgctggccaagaccttcgccagcgccgaatacgaccccgccgagatcgagcgctggcagcagtttctcgcggcctgggcctaccgtttcagttcccaggtcagcctgtattacccgcgcgccttgctgttcgagatcgaatcgagcctgggcctgttcgggccgtggccgcagttcgaggcgcggctgcgcaaggagttgaccgagctgggctttcgccaccgtatcgtcgccgctcccaacccggcagcggcgcgggtgctggcgaatctttacgatggcctggccgtggccgacgatcacgccttgctgcaagccctggcaccactgccgattgaccgcgccggcctcgacccccacgccgccacggccttggcacgcatgggcctgcgcagcctcgcccaagtgcaggccttgccccggcacaccctggcgcgacgctttgacgccagcctgctcaaacacctggatgcgctgaccgggaaacgcccgctggcgctggcgttctatcagccgccggaccagttcgatgtgcgcatcgagctgaatttcgacgtgcaatcgcaccaggcgctgctgtttccgttgcgtcggttgacgggcgacctgtccgccttcctctgcggccgcgacagtggcgtgcagcgcttcgacctgcacctggagcacgcccaggcgtccgacagcgtgatcaaggtcggcctgctcagcgccgaacgcgaaccggcgatgctcttcgagctggcccgagggcgcctcgagcaggtgcaagtgacctcgccggtacgcggctttcgcctggtggcccaggacttgccggtgttcgtgccacagcgccaggacctgttcgacgaccgcccgcaacagaccttgccctgggagcaactgcgcgaacgcctgcgcgcgcgccttggcgatgaggcggtgcaaggcttgcgctttcatgccgaccaccgccccgaatgcgcctggcaagcggccgccgataatcgtgtgtgccccaccttgaacaaggtgcaacgcccgggctggttattgcccgaaccgactttgctggccgagcagggcgtacagattctgatgggccccgagcgcatcgaatccggctggtgggatggcgccgatgtgcgtcgcgactattacctgatccagacccgcgccgggcagcaaggctgggcctatcgccacgtcggtcaaaacgacgggctgtggctgcaaggctggtttgcatgagctacgccgagctgcattgcctgtccaatttcagtttccagcgcggcgcgtcgagtgcgctggaattgttcgagcgggccaggcgccaaggctatagcgccttggcaatcaccgacgaatgcaccttggccggcattgtgcgggcctggcaggcggcgaaggcggtggacatgccgctaattatcggcagcgaggtgcgcatcgagaacggcccgaaactggtgttgctggtagaaaacctcagcggctaccagcacttgtgccggctgatcactgtggctcgacgccgcgccgaaaaaggcagctatcgcctgttgcaggaagacttcgagcagccgctgcccggcctgttggcgttgtgggtggccgaagacagcgacacccaagcctcgatccaatggctgcgccgcacgtttgccgaacgcctgtggctggcggtgcagctgcattgcggccaggacgacgcgcgccatctgcagcagcgcctggccttggccgccagcctgaacattcgcgcagtggcctgcggtgatgtgcatatgcatgcgcgtggccgccgcgccctgcaagacaccatgaccgccatccgccatcacgtcacggtggccgacgccggcacgcgcctgcatcccaatggcgagcggcacctgcgcagcctcgacgccctggccgcgctgtacccgcaagccttgctcgacgaaaccctggccatcgcgcagcgctgcaccttcgacttgagccagttgcgctaccactacccgcgcgagttggtgcccgaaggccaggatgcgcaatcctggttgcgtcaacttactgaagagggcatcgcccagcgctggccgcagggtgtcgacgccaagaccttgcagcagatcaaccatgagctggcgctgatcagcgaactgggctacgaaagttatttcctcaccgtgcacgacatcgtgcgcttcgcccgcagccgttcgatcctgtgccagggccggggctcggcggccaactcggcggtgtgttttgccttgggcatcaccgaaatcgacccgagcctgatgaacatgctgttcgagcgcttcctgtccaaggagcgcaacgagccgccggatatcgacgtcgacttcgaacatgagcgccgtgaggaagtgctgcagtacgtgttccagcgctacggccgcacccgcgcggccttgacggcggtggtcagcagctaccacgcggccggtgcggtgcgcgatgtggccaaggccctcggcttgccgcccgaccagatcaacgccttggctgaatgctgcgggcgctggagtgaagatgcgccgcctttggagcgcttgcgcgaaggcggcttcgacccgcaaagcccgatcctgcgccgcgtgcttacacttacccaacagttgatcggcttcccccggcacttgtcccagcacccgggtggctttgtgatttccgaacacccgctggacaccttggtgccggtggaaaacgccgccatggccgaacgcaccattatccagtgggacaaggacgacctcgacgccgtcggcctgctcaaggtggatattctggccttgggcatgctcagtgcgatccgccgctgcttcgatttgctgcgtcgtcatcgcaacctggatttggccctggcgaccatccccaaggaagacgccgcgacctacgcgatgatcagcaaggccgacaccatcggcgtgttccagatcgagtcgcgcgcgcagatgtcgatgctgccaaggcttaagccgcaaaccttctacgacctggtgatcgaggtcgccatcgtgcggcccgggccgatccagggcggcatggtgcacccgtacctgcgcaggcgtaataaagaagagccgacgacttatccatccccgcaactgaaggcagtgctggagcgcaccctgggcgtgccgctgttccaggaacaggtcatgcagatcgcgatggtcgctgccgactacggccccggagaggccgaccagttgcgccgctccatggccgcctggaaacgccacggcgggctggaaccgcatcaggaacgcctgcgcaccggcatgctaaaaaacggctacagcgaagcctttgccgcgcagatcttcgagcagatcaaaggctttggcagctacggctttcccgagtcccacgcggccagttttgccttgctcacctacgccagttgctggctcaaatgccacgagccggcggcctttgcctgtgcgctgatcaacagctggcccatgggcttctacagcccggaccagatcctgcaggacgcgcggcggcatcgcctgcagattcgcccggtggatgtgctggccagtgattgggattgcagcctggaacccatcgacggccagcaaccggcgattcgcatggggttgcgcatgatctcggggtttcgcgaagaggatggacggcgcatcgaggcagcccgccagcgccgcacgttcagtgacattgccgacctcgacgagcgcaccgggctggatgcgcgcgcccaggcgctgttggcggactcgggcgccttgcgcgccctggcgggcaaccggcacaaggcgcgctgggacgtggcgggcgtgcataaacagcttggcttgttcgccggcttgcccagccctgacgaagcggcggtggcgctgccggcaccgacggtcggcgaggacctgcacgccgactacgccacgctcggcaccaccctcggcccacatccgctggcgttgctgcggggtgaattgcgcaagcgccgctgccgcagctcccttgagctgatggcggtggagcatgggcgcaatgtcagcgtcgccggcctggtcactggccggcagcgcccaggcaccgccagcggagtgaccttcgtcaccctggaagacgaattcggcaacctcaatgtggtggtctggcgtgatctggccgagcgtcagcgccaggcgttggtcggttcgcggctattgaaagtcgatgggcgctgggaggcggtaggcgaagtgcggcacttgattgccgggcgcctgaccgatctgacgccgctgctggagggcattaatgtgcgcagccgggattttcactgaggggagttgctcaggtctccacggataagctatatgcaatgaaacgatttattaccgccaggctccaagtttttatcagtggaactgcgccacgactccatctttctcttcgccacgagccaattgatgcattttttatccaacacccatggctgcgaaggctggggcggtgaaatggcccagcgaattcgcgccttcgattggtcgaccaccgacctcggcccgatcgacgcctggcccaccagcctggtcagcgccgtgcagatgctgttggcatcgcccatgccgatggtgatgctgtgggggcaggcggggtacatgatctataacgacagctactcggtatttgccggtgggcggcatccgtatctgctgggcacgcccgttgagcagggctggccggaagtcgccgatttcaaccggcatgtgctggacacctgcctggccggcggcaccttgtcgtataacgacaaggcgctggtgctgctgcgcaatggccagccggaagaggtgtggatggacctctactacagccctgttgccggggataaccagcaaccggccggcgtgctcgcgattgtggtggagaccaccgcccacgtgcagtccgaacgtgtgcgccaggaattgacccataacctggagcagcgcgtggccgccgaagtacaggcgcgttccgccgccgaagcgcaactgcgccaatcgcaaaagcttgaagccatcggcgggctgaccggtggcgtggcccacgacttcaataacctgctgcaagtgatcgccggcaacctgcacctgttggcccggcatgagccggaaaacgcccaggtacagcggcgggtctcggccgccattgcggcggtggagcgcggtgccaaactgtcgtcgcagctgctggcgtttgcacgccgccaacccttgtcgccggccgtctataacccgcagcgcatctacgcaggcctaggtgagttgctgcaacgagcgttgggtgaaaccatccgtctcgatgtgcaattaccccaggactcctggtgcatcaacgtcgaccgcaaccagttggaaaacgcactgctcaacctggcgatcaacgcccgcgatgccatgcagggcgaaggcgtgatccgcattaccggcgataacatcatcctcaaccctgccgactgcgagggtaaaagcatcaagcctggcgagtatgtgcgcctggccgtcacggacatcggcgtgggcatgtcgccggcgatcctggcgcgggtgttcgaaccgttttttaccaccaagcgtgaaggccatggcaccggcctgggcctgagcatggtgtttggtttcgtccgccaaagcggcggccatgtcgaggtgtggagcgaggaaagcaagggcaccgtggtgcagatgtatttcccgcgcagcctgggcgaagagtgcccggacagtaacgtcgaaccggagccgcacctcgttggccaggagacgattctggtggtcgaggacaacgaagatgtgcgcgtgacggtggtggagttgcttgagcagtcgggctacaccgtgctcaccgccgaagacggcgaccgcgccatgcaagcgttgcagggcggtgtgcagccggacctgatctttaccgacgtggtgatgccgggtcgggtcaaaagtactgacctggccaactgggcacgcgcccaggtgccgccggtggcggtgctgtttacctccgggcatacccgcgacattctctccagcaatcacttgctgagccccgacattcatctgctgagcaagccttacagccccgaagccctgacacaacgggtgcgcagcgtgctcactgttcgataaggttttccatgacttcacagcgcaactttccgccgctcaccggccagcactcaggctttgtaagggtgcgcggcgcccgtgaacataacctgcgcaacgtcgacgtggacattccccgcgatgccttggtggtgttcaccggcgtctcgggctccggcaagtcctcattggcgttttccacggtgtatgccgaggcccagcgccgctatttcgaatcggtggcgccctatgcgcggcgcctgattgaccaggtcggcgtaccggatgtggattccatcgaaggcctgccaccggccgtggccctgcaacagcagcgcggtacgcccagcgcgcgttcgtcggtgggcagcgtgaccaccttgtcgagcctgattcgcatgctgtactcgcgcgccggcagttatccgccggggcaggcgatgctgtatgccgaagacttttcgccgaacctgccccaaggcgcgtgcccgcaatgccacggcctgggccgggtctacgaagtgaccgaagcgctgatggtgcccgaccccagcctgaccatccgccagcgtgcggtggcgtcctggccgttggcgtggcaagggcagaacctgcgcgacatcctcgtcacgctcggctatgacgtggatattccctggcgcgacctgccgaaaaaacaacgcgactggatcctcttcaccgaggaaaccccgaccgttccggtgtacgccggtttcactccgcagcaaacccgcgatgcactgaagtgcaagttggagccgagctatcaaggcacgttcagcggcgcgcggcgctatatcctgcacaccttcacccacacccaaagcgcgctgatgaaaaagcgcgtctcacagttcatgcagggcagcgcctgcccgttgtgcgaaggcaagcggctgaccaaggcggcgctgtcggtgaagtttgccggggtggatatcggcgagctgtcacaactgtcgctggcgcaactggccgagctgctgcggccggtcgcggcggggcaggacaagatgaaactgtcggtggaaaaacgtctggccgcccagcgcatcgcccaggatttgcttgagcgggtcagcaccttgaccgaactgggcctgggctatttgtccctggagcgcagcacgccgacgttatcgtccggggagctgcagcgcctgcgcctggccacgcaattgggctcgcagttgttcggcgtcatttatgtgctggatgaaccgtcggccggcttgcacccagcggacggcgaagccttgttcaccgcccttgagcgtctgaaagcggcgggcaattcgctgtttgtggtcgagcatgacctggaaaccatgcgccgcgccgactggctgatcgacgtcgggccggctgccggcgaacatggcgggcaggtgctgtacagcggcccgcctgctggcctggcggaaatcgaagcctcgcagacgcgtgaatatttgttcgccgcgcctcggcccttgagcccgtcgcgccgtgagccttccggctggctgaaacttgaaggcgtaacccgtaacaaccttaacgacctgagcgtggatttccccttgggctgcttcacggcggtgaccggtatttccggctcgggcaaatccagcctggtcagccaggcgttgctggaactggtgggcacgggcctcggccgcgtggttgaaagcgacgaggagcccagcctggaagacgacaccccgcaaagcagcggtgggcgtatcagcgcggggcttgagcatatccgccgcctggtgcaggtggaccagaaacccatcggccgtacgccgcgttccaaccttgcgacttacaccgggctgttcgacaacgtgcgcaaactgttcgccgccacgccggcggcgaagaagcgtcagtatgacgccgggcagttttccttcaacgtcgccaagggccgctgccccaattgcgagggcgaagggtttgtcagcgttgaactgctgtttatgcccagcgtgtacgcgccatgcccgacctgccacggcgcgcgctacaaccctgaaaccctggcggtcaaatggcagggcttgaacatcgcccaggtgctggcgctgacggtggagcaggcagtcgaggtgttcgccgaccagcctggcgtgttgcgctcattgcaggtgctgcgcgatatcggcttggggtatttgcgcctgggccaaccggcgacggaattgtccggcggtgaggcgcagcgcatcaagttggccaccgagctgcaacgcaatgcgcgtggcgccaccttgtatgtgttggatgagccgacaaccgggctgcatccacgggatgtggaccgcttgctcagccagttgaatcatctggtggaggcggggcatacggtggtggttgtggagcacgagatgcgcgttgtcgcgcagagtgactgggtgattgatatcggaccgggcgccggggatttgggcgggaaagtggtagccagtggcacgccgcagaaggtggcgaagagcaagagcagccggactgcgcctttcctgagccgagaactggcctgactaccaatgaggtcaaaatgtgggagctggcttgcctgcgatggctgcctgacagccgaccaggatgctggatcagaccgagtacatatccattcctgcggtaacggccacttagggttccgctcttacagcggctcactttttgaaggaccggaatgccggcccagcaaaaagtaagcaaaaagtcctcgtcccaccactcggcacctcgcttaggctcggtgtgcccgtaatccgacatggatttggggggccgccgccacgcgccatccatggcgcggggcggctaaaccggcatccctgccggtttaccccccaaatccatgtcgaattccggccagcgtggtttaacgggacgcctaagatcaagatcaaaagccagatcaagagcaagagcggctcgctgcgcattgtggatacggttggcagctacaaagctgtgtagatgcctatgctgcgatggcatcaacccggtgtacctgacacaccgaggtgcctgcatcgcaggcaagccagctcccacagttgatcgagtaaagtttcaatgaacaggtcggctgtcaggccgcctcggccttgcttttgatccaaacactcaggtcggctattaggccgccgtgctgtagattttgatcttgatcttaggcgccccgttaaaccacgctggccgaacgcaggcttgaatccgtgggtaacccggcaggacgccgggttagccgcgctgggccaaggatggcccatcgcggcggcccacggattcaagccggagtgagggcacagcgaagcgtgagcgaggtgccgagtggtggggcaagagcccttttggttacttttggctgggccggcattccgggctcttttccaaaagtgacccgccgtaagggcggaaccaatgttagccttgacccaaacaacggatatgtactcagcgcccctcgacaaacacggcacttaacccctgaaagaagatgtatagatacctatgctgcgatgacggtacatcagccaacacagtattggctgacagcccgctatcgcaggcaagccagctcccacaggttttgatcagtgttgggtcagttgaatctgctccttcgccagcttcaccacattctcaagggtaaaaccaaacttctcctgcaacttcggcagtggcgccgacgcgccaaagctgttcatcaccaccttggcgccggtctgcccgacatagcggtcccagcccagcgggccagcctgttccaccaccacacgggctttaaccgacggcggcagcacgctgtcgcggtacgcctggtcctgatcttcaaacagctcccagctcggcatcgacaccacttgtgcggcaatgccttcgcttttcaactgttcataagcggctaccaccaggctgacttcactgccgctcgccaacaatagaacctcgggattctcggcgcccgccaatacgtaagcgcccttggccgcgcccgacgctgcggcatacttcgtacggtccagcgtcggcaacgcctgacgcgacaacaccacgcagctcggccgatgggtttgcgccagcgcaaccttccacagctccagggtttcattggcatcacccggccgcaaagtcagcagccccggtgtcgcgcgcaattgcgtcaggtgctcgacaggctggtgcgtcggcccatcttcacccacgccaatcgagtcatgggtaaacacaaacactactggcaattccatgatcgccgccagccgaatcggcggcttcatatagtcgctgaacaccaggaacgtcgaggtgtagggccgcaggtacgacagcgccatgccgttggcaatcgcacccattgcatgttcgcggataccgaaatgcaggttgcgcccgctgtagtcttcggcactgaaacgcccggcgccgtcgaaggtgaggttggtcttggtcgacggtgacaaatctgccgagccgccgagcagccaggggatttgctgggcaaaggcattcagcacttcaccaccggcggcacgggtggccacgcctttggcgtcggtgtcgaagtggggcaactcatcttgccaatgctcgggcatttcaccggcgcgcatgcggcgcagttcgtctgccagttccggttcgtactgttccagctgcgacaggtggcgcgtccattcttcgtagagtggctggctgcgttcaagcagtgcgtcacgcagtacggtgcgggcctcgtcgggcaccaggaaactggaatcttcaggccagccatacgcggctttggtcaggcggatttcatccgcgcccaacggctcgccatgggcggcggcggtgttgtgtttgtgcggcgagccatagccgatcacgctgtcgaccacaatcagggtcggcgcgccggtattggtcttgaacgtttccagggcggtgctcaaggcctgcaggtcattcgcatcggtgacatgcaaggtgtgccagccgtaggcctggaaacgcttgatcacatcctcactgaacgccagctcggtatggccctcgatgctgatggtgttgttgtcgtagatccagcacaggttatccagcttcaagtgcccggccatcgatgccgcttcgctgctgatgccttccatcatgtcgccgtcgccgcacagggtgtagacgttgtagtcgaacagcaccttgtcgtcgcgattgaaccgctgccccagccaccgctcagccatggccatgcccacactgttggcgcaaccctggcccagcgggccggtggtggtttcaacgccggtggtcatgcggtactcggggtggcccggggtcttggagctgatttgccggaactgcttgatgtcgtccaggctgatcgccggctggccggagcgcttgccgtgggcatcgatctccaccacaccggccaggtgcagcagcgaatagagcagcatcgatgcgtgccctaccgacaatacgaagcggtcacggttgggccagtcgggatgctgcgggtgataacgcaggaaccggctccacagcgtgtaacccaccggcgccaggcccatgggtgtgccggggtggccggagttggccttctgcacggcgtccatggccagggtgcgaatagtgttgatgcattgggtgtcgacagcggtggcggcgcgagtcatgaaaccgttctccctcaggtggcgatctacagtggagggcagggcgcggcaaaggtttgatcccatcgcccgcctggcgacgaacggggatgcagtgatccaggacatgacaacaccccttggaatgggctagcttcaaagtgtaggccattgatcaacttgcggaggtactccatgccagtgaaacacgacctgtatcaggatttgggtttaaccagagaagtcgttcacgaacgcaggaagggcgatgaccgtttgaatacgctgctcgaacaatatgatgcagccgacaaggaggtactcgctttcgagtcgtcaggcggtgctgacgaagaactggagaagttgaagaagaagcgcctgaacgtcaaagacaaaattgtgctgcagttggggtaattgaacgtccgcgctcctacagggcgcggacacatttgttcagaattgtctgagggacagggcgcttttcactgtttaagatgcgccccgtccacccggctctggggactgttgcggcgcaaggattgcgctggtgagccgggcgggcactcttatttcacctcagcatttcaccccagcagtgcctgaatgcattcgtcgatagagcgctgttgcgtttcgccatacagcttcaactcatcaatcgtccgacggcccagggccttttcgaattcagcctggtttgaattcgccgcatagtgactctgcgccgcatcgcccaggttcgactgaaatatccccgccgcactcaccggcagaaaatcctcatacaccaacggttccactgccacatggccggccgcaatcagcgcgtccagcgtgcgcggctgattggcttggccgcgcgccgccaggccttgttcggtggcgaagtagcggaagtacgcgagcgcctgttcacgcatctgggtgtggttgtcggggaacgcttcgaagtgctcctccatcaattgcacataacgcgcggcgttggcctcattcggaaaagcgcccaatgcgtcgcgtgcagcgttcagcagttggtcgtaaagggctcggccttttggcgtcagcgcgacaccgcgctgttcgatttcgccgaagcgcgcgctgtggctgcctttggcgtcggtgaaggcgatgggctcgtcgagggccttgaagctggtctggcgcagcagaatcgggcactggcggcgcggcggcccttcgatcacggctttgggggtaatgcctttgccgggcatggcgacttgcacctggtcgatgtccagggtgcgcggggtcaggtggttgatgtgcgggcctttgaacgcgaccacgtcggcgatcaggcggtgctggtcactcagttgctggtattgcgcgcctgtgacggtggcggtgtggtgccagcggaaggtctccagggcctggctgacaaattcgtcggcgtcgcgagcgttgaggccgccgtcgcgctccgcttgttcgatcaacgccaaggcgcctggagtgaaaatgttgcgcttggccagggcgctttcggcgaaggtgcgcagttcgaggttttcgatcaattccaggcgcagcagcgaggtgaacacgcggaaggggctggtttgcagtgagcgctcatgcaccgcgcgaaaggcggtggaatgcaccggcacgccggccggcgtcaggtcgtaatagcccaccggttgcatgcccatcaccgcaaacaaacggctgatcgttgccaactcatgggcggtgcccaggcgaatggcaccgtggcgctccatgtccagtcgatcaatttcaccggtgcgttgcaactgctgggccaggcccgattcactcgccagcgtgtgcgcattggtctcggccaccagcgccatcagcgcgccgtagagtggaacttcatctcggtacatgtcggacatggccttggaaaagtctctgcgaatctcgtcggggctgacatgtgcggcgcttggcatagaaaaattcctgaacacagtgaaaagggatcggcctttctctggattttgttgggcttgagccggtctggcaaacgaagaatcctcaggacttcattctgcaaatgaatgaaatgacgcaaatatgacaaaaaaccgcgacggaaaaatttcattttcgagccgagttttctaacaaattcttcacgaggtgcgccccggtcctcatgaaacaatcgtcacgtttgtagggatgaaaacgccgtttcacacacaacgcacataaaaatatgtttaggggctgttacacatgaaaatttctacactggcgttatccatcaccgccgcattgctcgcgcaacaagcgagcgctgacgattttgggctcggctctctgggcacgggcactggtcacagtggctttcttgaagacagccatgctgcgatcagttcgcggaccatgtactacagtgcggacaaccgctcggggaccaacaacgatctgcgcgaagccgcgaccctgctgcgcttcgactacaaatccggcttcacccaaggtacccttggcgtcggtttcgacgtgatggcgttcggcgccttgcgcctggacggtggcgatggtcacgcagcaggcccgggcctggcgggtaacggcaacagcttcttcccgaccaagaacaacggcactgaacctgccgacagctttggtcgcgccgccggcaacgtgaagttccgtatttcccagactgagttgcacgtcggcggtggtttggccccggtgttgcctatcctggtttccaacgacagccgtgtggcgccgcagacttttgacggcggcatcctcacctccagcgacattccaaacgtaacgttcaccggcggtgagctgaacaaggccgaaggccgtgcgtccagcaactccacaggcctgagcgtcgccggcggtacgcgcgacagcgacagcttcaagtttggcggtgtggactacaaaccgtttggctcgtctgacaacgccatcgctaaaaacctgacgttgcagtactactacgccaacctgcaggacttctacaaacagaactacttcggcttggtccatgtactgccgctgggcaatgaccagtcgttcaagactgacctgcgctacttcgacagcaccagcgacggcaaaaacggtgaagccggctaccagttcaacaacaacggtggctatgccaaacacgctggcgaagtggataacaaaacctacagcgccgcgttcacctaccagttgggcggcagcagcctgatgctcggccatatcggcgtaagcgacgatggcggcttcgtctgggtcaaccagggcagcctcgccgacccgcaacaacaaggcgcgggcggcagcgacttctacctgttcaccgacgccgtggtcggccagttctcccgcgcgggtgagcaggtcaatttcggtcagtacacgtatgacttcaaggcctacgtgcctggcctgaaagcctccattgcttacctggacggtacggacatcaagtccaaagtggccggcggttccgatcagaaagaaaacgaaaccgacttccgcctggattacgtcgtgcagcaaggcccgctcaaaggcttcggcactacgttccgtaccggtacttacaaaggccacaacaccggcaccgcagaccaggatcaaactcgcctgatcttcaactacacctacgcgatcttctaagaaaacccgcaggtttttaccgccgaaaaaatcgaggccgcctaatcagcggcctctttttttgcgcgagtggatcagacttcatgtgcatccgcgcgtagatgggttctacactgcgcctcactgtgtcagtgatggaggaaccaatgacggccacgcccgagaccaacatccttgcaacaactgaaggccagcgcctggccgcccaagacgccgagcgctggcgcgagtggggcccatacctgagtgaacgccaatggggcacggtgcgcgaagactacagcgccgacggcgatgcctggacgtatttcccgcatgaacacgcgcgcagtcgcgcctaccgttggggcgaagacggcctggccgggttcagcgacaaggcgcaacgctggtgcctggggctggcgctgtggaacgagcgcgacacgatcatcaaggagcgcctgtttggcctgaacaacgccgagggcaaccacggcgaagacgtcaaggagctgtactttttcgtcgatggcgtgccgagccatgcctacatgcgcatgctctacaaatacccgcatgcggcctttccctacgccgacctgaccaccgaaaacgcgcggcgtgggctcgaggatgccgagtacgagatcctcgacgccggcgtgtttgaagataaccgctactgcgatgtcagcgtcgaatacgccaagcaccagcccgacgatattttcatgcgcgtgaccgtgcataaccgctcggaccagccgacccgcctgcaggtactgccccaggtgtgggcgcgcaatgactggagctggaccgctgatgcccccaagccgcagttgcggctcgacggcgcacacgtgctggctcgtcatcatgaaatttctgatcgccacctcagcgcttggggccaggacggcgtggagtggttgttctgcgaaaacgaaagcaattttccccggctggacgggcaaccggctccggggccgttcaaggatggcatcaacgattacgtggtgggcggtgtgcaatcggcgattcgccgcgatgcgggcaccaaagtcgccgcgcgcttcgtcctcgaactggcaggccaggaaagcaaaaccctgtacctgcgatttgcgccgacggatgcgcccgaggtgaatgcgcgcaagctgtttgaacagcgccgcgaagaagccgatgacttctatgcggccctgcaacacggtattaccgacgcagacgcacgcaatgtgcagcgtcaggccctggccgggttgttgtggtccaagcagctctactactttgacgtaaaccagtggctcgacggcgacccggcccagcccgcgccaccgtctgagcgcctgcatatccgcaatacccattggcggcacctgtccaacttcgacatcctttccatgcccgacacctgggaatacccgtggtacgcctcctgggaccagggcttccaggcggtggcgattgcgctgattgatccgggctatgccaagcagcagctgttgctgctggtgaaagaccgtttcatgcaccccaacggccagttgcctgcgtatgaatggcgtttcgatgacgccaacccgcccgtgcatgcctgggccagttggcgggtgtatcagcaggacaaggcgttgaccggtgtcggcgacatggattttctcgagcggatcttccacaagctgctgttgaatttttcctggtgggtcaaccgcaaggacgccgaaggccgcaacctgttccagggtggctttctcgggctggacaacatcgcgctgttcgaccgctcggccaccttgccgccgggttatcagctggaccaggccgacggcacggcctgggtggccgcctatgcactggacttgatgcgaatcggcttggagctggccaagcgcaatgtcgtctacgtcgatattgcggtgaagtttttcgagcatttcctctacatcgccggcgccatcaaccgcgtcgatgacagcgccgagggcttatgggatgagcaagacctgttcttctacgacgtgctgcaccgccccgacggccaaaatgagccggtgcgcctgcgctctatcgtcggcctgatgccgttgtttgccgtgctggtgctggagcagcgcgagcatgaaggcctggagggcttgcgtgagcggctgttgggtttcatgcaccaccggccggatttggccaagttggtgtcacgctggaacgaaccggggcagggcaatcgcctgctgctggcgctgttgcgtggcgagcggaccaaggacctgctgcggcgcatgctcgatgacaccgagttcctgtcggcttttggcgtgcgctccttgtccaaggcgtttgccgaacagccgctggggttgaagatgaatggcgacacactgtgcgcgcgttatcagccaggcgagtccgactcgcgcttgtacggcggcaactccaattggcgcgggccgttgtggatgccggtgaactacatgctgattgaatcactgcgcgaatttcatcggtactacgcggataacttctcggtggagtacccgacggggagtggttatctggcgtcgctggaggaagtggccgacagcctgagccaacgtctcacgcgattgtttttgcgcgatgaagatggccagcgcccgtcgatggcgggttatgcgcaattggaagcagacccggccagtcgcgatctggtgttgttccatgagtatttccatggcgaaaccgggcgtgggttgggggcgtcgcatcagaccgggtggagcgcgttggtggcgttgttgctgcaaccaaaaacctaagcaacaccactgatctgcttttctgtgggagctggcttgcctgcgatggcggtctgtcagttgatacagatgcagctgacccgccgccatcgcaggcaagccagctcccacattggatttgcgttgatctctaggttgcaggcaaaaaaatcccgccggtgaaggcgggattggtattcaaggttgcccttgaatcaagccgggaacagttcgctcagcttcatggccagcatcatgtcgccttcggtgcgcagcttgccgctcatgaaggcctgcatgccgtcggtgtcgccgctgacgatgccttccatagtttcgccgtcggtcaccagtgtcacttgggcgtccgggttttcgccttccagcagttcgcaggtgttgttcttcaccaccagcgagaagttttgggtgtcgtcgatacggaaaccgaacaccaggtccaggccgtcggcagcggctgggttgaatttggctttcattgcttctacagctttggctacgtcagtcatggtttcgatcctttaaggtagagtccagtgaccttggggtcacggttggccgcaattcatcggaaggtgatgagctgcggcgccttcaacagttgcaagtgggtatgactgttgaaggaagccagtgccacctcgcgaccgcggaatttcagctggttgagcgaggtgttaacaatttgccagttcagttcgaaggcctgcgccgcaggcatccgggtaatcaggtggagcagggcggtgatggtgccgccggaggtaaacacggcgattttgtgtgagttttcagccgcttcaagcacgcgctgcaaaccaccctggacacgctcgacgaaccccagccagctttccaggccgggcgggtcgtaggtgccggccagccagcgctcgacgatcagggcaaaaatgcgctggaattcgccgcggttctgcgcggcattgcgcaggatctccagcgcgtcgggctcggtgctcaacaggtcggggagcagggcgcggatgattgcgtcggcgtcgaactcgttgaaggcgctgtcgacttcaagtgtcggcaccggcaggccaagggcacggtattgatcgaaggcggcggtggcggtgtgctgctggcgacgcaggtcgccggcgatgcagcggtcgaacgtcaggcccaggtcggccagatggcggccgagcacttgcgcctgctccacgccgacgggcgacaggacgtcgtagtcgtctgcaccgaaggaggcctggccatgtcgtatcagataaatgctgcccacgtccgttttcccggtacgttgaaagtctggcgaggttatgaggatgcctgcgagctgtcaatgaaaaaacatacgcttgttttaaaagcgcgttagagcgcttggctgctggcggtttgagcactggtcgcccggcgatagcctcggtatgcttgggcaatccgcgcctggcgccgtgcatttttaaggggacacatggattttttggctgaatacgcgagctttctagcgaagaccgtcactctggtggtcgctattctggtggtattgatcagcttcgcggcgctgcgcagcaaaggccgtcgcaagtccgccggccaattgcaggtcagcaaactgaatgatttctacaaaggcctgcgtgagcgcctggagtcgagcctgctcgacaaggaccagctcaaggccctgcgcaagtccgaaagcaaaaccgaaaagaaaaacagcaagaagaagcctgaggccaagccacgggtgttcgtgctggatttcgatggcgacatcaaggcctcggccaccgagagcctgcgccatgaaatcaccgcgctgctgagcctggccacccctaaagatgaagtggtgctgcgcctggaaagcggcggcggcatggtgcacagctatggcttggcgtcctcgcaactggcgcgtatccgccaggccggcgtgccgttgaccgtgtgcatcgacaaggtcgcggccagcggcggctacatgatggcgtgcatcggcgagaaaattatcagcgcaccgttcgccatcctcggctcgattggcgtggtggcgcagttgcctaacgtcaaccgcctgctgaaaaagcacgacatcgacttcgaagtgctgacggccggtgagtacaagcgcaccctcaccgtgtttggcgaaaacaccgagaagggtcgcgagaaattccaggaagacctggacattacccatcaactgttcaagaacttcgtgtcgcgctaccgcccacagctggcaatcgatgatgtggcgaccggggaagtgtggctgggtgttgcagcgctcgacaagcaactggtcgacgaactgcaaaccagcgacgaatacctggccaccaaggccaagaccgccgacgtgttccacctgcactatgccgagcgcaaaagcttgcaggagcgcgtgggcctggcggccagcggctcggtggaccgggtgctgctgacctggtggagccggttgactcagcagcggttctggtaataccagaatgtgctgatcgttcccacgctctgcgtgggaacgcatgctgtgacgctccgcgtcacccttgtgaagggcttgagtctggcgtggttggacgcggagcgtccggggctgcattcccacgcagagcgtgggaacgatcagaatgtaggtaatccccttgtgggagcgggcttgcccgcgatagcggtgtaccagtcgatacgtctaccgactgaaccggcgccatcgcgggcaagcccgcttgtatgctaggacttgaagggaggaggagggacaaagcccgattctgactgttacagc

SEQ ID NO: 74 - DNA, 33628 bp, Pseudomonas poae FL10F
agtattacaatcactcgcgtatcaagctgaagctaaacggcctgagccctgttgcatatagaactcaggccgttcaggcataggcatgtaatcgtccagctttgtggggtcagttcagagcgtgggaacgatcaagcaaaaaccccatgatcactcatggggttttttatttgcggggctggatttacgcgggtgcggaagtgcggatcaggtggtcgaaagcactcagcgaagctttggcgccctcgcctaccgcgatcacgatttgcttgtacggcacagttgtcacgtcaccggcagcgaatacgcctggcagtgaagtctcgccacgcgcatcgacaatgatctcgccacgcggggtcagttccacagtgcctttgagccaatcggtgttgggcagcaagccgatctgcacaaagatgccttccagatcgatggtcttgaactcaccgctgtcgcgatccttatacgccaggccggtgactttctggccatcgcctttgacttcgctggtcagcgcgctggtgatcacgtcaacgttcggcaggctgtagagcttgcgctgcaacacagcgtcggcgcgcagtttgctgtcgaactccagcaaggtcacgtgactgacgatacccgccaggtcgatggccgcttcaacgccggagttgccgccgccgatcaccgccacgcgcttgcctttgaacagcgggccatcgcagtgcgggcagaagcacacgcctttggctttgtattcctgctcgcccggcacacccatttcgcgccagcgggcgccggtggccaaaatcacggtcttggacttgagcgtcgcaccgctttcgaagcgaatttcgtgcaggtcgccggcgtttttcgccgggatcaagctgctggcgcgctgcaggttcatgatgtccacgtcgtactgacgcacgtgggcttcaagagcactggcgagtttcgggccttcggtttcttgcaccgagataaagttctcgatggacatggtgtccagcacttgcccgccgaagcgttcagccgccacaccggtgcgaatgcctttacgtgcggcgtagatggcggctgccgaaccggctggaccaccgccgacgaccagaacatcaaaggcatctttggcgctgattttctcggcggctttttcaatgccgctggtgtcgagcttggcgaggatttcttccaggcccatgcggccctggccgaagttcacgccgttgaggtagacgctgggcaccgccatgatctgacgctcatcgacttcagcctggaacaatgcgccgtcgatggcgacgtggcggatgttcgggttgagcacggccatcaggttcaacgcctggaccacgtccgggcagttctggcaggacagcgagaagtacgtctcgaagctgaactcgcctttgagggcgcggatctgttcaatcacttcgacactggccttcgaggggtggccgccgacttgcaacaatgccaacaccagggaggtgaattcatggcccatggggatgccggcgaaacgcaggctgatatcggcacccgggcggttgatggagaacgatggcttgcgcgcatcatcgccatcggttttcagggtgatcagcgtggtgaggctgacaacatcctgcaaaagggcaagcatttcctgggatttcgcaccgtcgtcgagggaggcgacgatctcgatcggctgggtgacccgttccaggtatgacttcaactgagctttaagattggcgtccaacatacgggcgatttcctattaattcggtttattgcagacaaaaaaacgcccgagcgaaactcgcccgggcgttttgggggcggatgcagcttacttaagtgcggagtcccgcccttgatatttcacagacttagatcttgccgaccaggtccagggacggagccagagtggcctcgccttctttccacttggctgggcacacttcgcctgggtgggcagcaacgtactgagcagccttgattttgcgcagcagctcggaagcgtcacggccaacaccgccgtcgttcagttcaacgatcttgatcttgccttctgggtcgatcacgaaggtgccacggtctgccaggccagcttcttcgatcagtacgtcgaagttgcgcgagatggtcagggttgggtcgccgatcatggtgtactggattttgccgatggctggcgaagtgttgtgccaggcagcgtgagcaaagtgggtgtcagtggaaacgctgtagatttcgacgcccagtttctggaattcggcgtagttgtcagccaggtcttccagttcggttgggcaaacgaaggtgaagtcggccgggtagaagaacacgacggaccatttgcctttcaggtcagcgtccgacacgtctacgaagttgccgtttttgtacgcagtagctttgaacggttttacttggctgttgatgataggcatcgttgactctccgtcagggttaagaagttgatgagatgaatcctaccgactctttccggcgatggctcattggcaaacctgatgctgacgattggttttccctatcaggtaactgtattaatagaagaaatctcaaatcagcggctgggtcgccaaggtcatcccgagaaagggcgtcgcttcaacatagcgcatagccgatttcatgtcgttccagccgacgtaactcatcaacgacttaaggtcccagccgctgcgatgagcccaggtggcaaagccccggcgcaatgagtgactggtgtacaggtcggctgggatgcctgcgcgctccagggcttggcgcaacaacgggatcacactgttagggtgcaagccctcctcgcccaggttgccccagcgatcaatcccacggaacaccgggccccgcaccagccccgagacgctcagccagtcgctgtacgcctgcaccgggcacaggcgcagcaaggctggcgtctggtaggtcttgccaaggttgtcgcggtcacttttgctgcgcggcaggtacaggctgatgccggcgccgggcaccgcctgcacgtgctcgatgttcaggcggcacaactcatcgctgcgaaaaccgcgccagaaccccagcaggatcaatgcggtgtcgcgcttggcacgcagcaagcgtggcatgtcctggtcgttgctcgcctgctgggcctcggcggccagtgaagccaccacttgctccaggtgcttgagctgcagcggttcggcctgcttctcctgcgccgggtgcacagcgcgaatgcccttgagcaccttgcgcaccaccggtgccttcgtcgggtcggggaaaccctggctggtgtgccattgcgccagcgccgagagccgcagcttcagcgtattgactgccaataccccggcgtgcgccaccaagtaacgcgccacgctgtcgctggtggcaggcaggaagccgccccaactcacttcgaagtgctcgatggccgcccggtaactgcggcgggtgttatcgcgggtggcggcgttgagataccgatccagatcgctcatgaagggcctattcgtactgctacagggtgaatccgcgcttaaaacggctatgacacgggataatacgccaatatcccatctgttaaatcatcaatttaaacgtctttttatccgtgttacagtatgtatctacataccacgtaccacagtactaaatcgacggagaccccatggctcgtggcggcataaacaaagcagtagttcaaacggcacgcttggcgatcctggcccgcggcgaaaacccgagcatcgatgcagtgcgcatcgagatgggcaataccggctcgaaaaccacgattcatcgctatttgaaggagctggacgacagcgaaagccgggcgaccatcaccgaagcgccaatcgacgacgaactgggcgagctggttgcgcgcctggctcaacgcctgaaagacaaagcccaggagcccatcgacctagcgctggcacacttcgaacaacagaaagccgccctgctcgcccagatagaaacgctggaggccgctcacgccgaccttaagcagcaatttgaaatccagtcttcagcactcgcagaagaaagcgccgccctgcaaaccgccagcaccagcctgcaaaccgagcagacccgcaacgccgggctcagccaggcgtgcagcgattacgagctgaggattacggataaggacgaacagattcgttcgctggaagaaaagcacctgcacgcccgggatgccctggagcattaccgcaatgcgatcaaggagcagcgtgagcaggaacagcgacgccacgaaggccagttgcagcaggtgcaggcggaactgcgccaggcccagcaaagtgccatggtgcgtcaggacgagatcacgcaattgcatcgcgacaacgagcggttgctgatcgagcaccgcgtgaccgcgaaggaattggccgccctgcaggagcagaaccgcaaagatcaggccgcgcaacaaaaactcagcgagcaggtaaacctgatagaaagcgaacgcaccttgcttcaggagcgcctgcgggttgccgtgctggaaagccagtcacgccaggaggcactgaccgaacagcagcagagcaacaagagcctggagctggaccttgtcaaggcccaggccagtatcgaggcgttgcgcctggcggctgccgttgcagcagcgccagaggcaaccccgcaaggctgatcagttcgccacaggcgtgcgcatggtgacgaactcttccgccgccgtaggatgcacgccgatggtttcgtcgaaatgctgcttggtcgcgcccgccttgagcgcgatcgccaggccttgcacgatttcaccggcgtccggcccgaccatgtggcaacccagcaccttgtcggtgtcggcgtcgaccaccagcttcatcaaggttttttcctggcagtcggtcaacgtcagcttcattggccggaagcggctttcgaaaatctgcaccttgtggccgttcttcttcgcctcttcttcggtgaggccgacggtgccgatattcggcaggctgaataccgccgtcgggatcatcgcgtaatccaccgggcggtattgctcaggcttgaacaggcgacgcgctaccgccatgccttcggccagggccaccggcgtcaattgcacgcgaccaatcacgtcaccgattgccaggatcgacgactcggcggtctggtacagctcgtccaccgcgacgaaaccgcgctcatccagtttgacgccggtattttccaggcccaggttgtccagcatcgggcggcggccggtggcgtagaacacacagtccgcttcgagtacgcgaccgtctttcaaagtagccttgaggctgccatcggcttgcttgtcgatgcgctcgatatcggcattgaattgcaggtccaggccgcgcttggtcagctcttccttcaggtgcgtacgcaccgaaccatcaaagccgcgcaggaacaggtcgccgcgatacagcagcgaggtctgtgcgcccaagccatggaaaatgcccgcaaactcaacggcgatgtaaccgccgccgactacaagcacacgcttgggcaactccttaaggaagaacgcctcattggaaccgatcgcgtgttcgcgtcctggaatctctggaatctgcggccagccgcccgtcgcgatcaggatgtgcttggcggtaaagcgctcaccgttgatctctacctggtgcggatccaccaggcgcgcatggccttcatgcaaggtcacgccgctgttgaccagcaagttgcggtagatgccattgaggcggttaatctcgcggtccttgttggcgatcagcgtggcccaatcgaaattcgcctcgcccaacgaccagccaaaaccgctggcctgttcgaagtcctcggcaaaatgcgccccgtacaccaagagttttttcggcacgcagccgacgttaacgcaggtgccgcccaggtagcggctttccgccacggccaccttggcaccaaaaccggcagcaaaccgcgctgcgcgaacaccgccggaaccggcgccaattacatacaggtcaaaatcgtaggccatttcactctcctcggcaggacatcagcataccgatttagatggggctgaaaaacgaaaaagccaccctaaggtggctttctcttaaaacactgagcaagcgtgaatcagtaagccttgccagttttgtagaagtgctcgtagcagaagttggtcgcctcgatgtagccttcggcgccaccgcagtcgaaacgctgacctttgaacttgtaggcaatcacgcagccgtctttagcctgcttcaacagggcgtcggtgatctggatctcgccacccttgcccggctcggtttcttcgatcagcttgaagatgtccggcgtcaggatgtaacggccgatgatcgccaggttcgacggtgcatcttccggtgccggcttctcgaccatgtcacgcacgcggatcaggccatcaccaatgtcgtcaccggcgatcacgccgtacttgttggtttcagtcgggttcacttccatgaccgcaacgatggtgcagcggtatttctggtacagcttgaccatctgggtcagtacgccgtcgccttccaggttgacgcacaggtcgtccgccagtaccacagcgaacggttcgtcaccgatcagcgggcggccggtcaggatcgcgtggccaaggcctttcatctgggtttgacgggtgtaggagaacgagcactcgtcgagcagtttacggatgccgaccaggtatttttccttgtcggtgcccttgatctggttttccagctcgtagctgatatcgaaatggtcttccagcgcgcgcttaccacggccggtgacgatggaaatttcgttcaggccggcatccagcgcctcttcgacgccgtactgaatcagtggcttgttcaccaccggcagcatctctttgggcatggctttggtcgctggcaagaagcgagtgccgtaaccggctgctgggaacaagcatttcttgatcatatgagtccttacaaagggctgtgcgtacggaattcggcgcagtctaatcaggccgcagtcaccttacaatgggtcctgctggcgttgcgatgtcaacatagagaaaaaatgtcggcgtaagttccacttatcttccgacaagtaccttcaccctcgaccggcaaacaacctacaagccagtgtttccgagggctacatcctttttagcatgctttcaggccgagggcactgatgtggaataacttcggcgggcgcaggctatttggcgctatcattacgcccttgaaccagaccacgagattcttaatagatgtcagaaccaaaaggtgtaaacggctacttgatcacgaagcgcgcagacggctggcacttgatcaacttccacggtgacagcgttgccggggtattcgagaccgaagccatggcgattgccgtcgccgaagtgtttgtggatgaagccggtcacgcatcgaccaagcgaccgacgaagggcaagtaagcacattcgccccgcgtacaaagccccgttaagcggggcttttttgtgtttgtctgtaccttgatggccgttcgctataatctgctgccaacgccccacgacagtgtcagcgccccttcaacaccctcgacgacgaccccacacatgaacaagattctggcactgaccgcggccctcgcgctgacgaccggctgcaccaccacctccgacacttacctcaaaaacggcgagcaaggcctgaccattgactgttcaggcgaggccaactcgtgggccagttgctacgaaaaagccgacgcctcctgcgcgggcaccggctatcgcattgtcggcactgacggcacgccctcgctgaaagaaagcgacaaaaccctgggcaaagacgttggcaactacaagagccgcagcgtggttgtggtctgcaagtaagccgccgggctacaggtgaatttcagcgaacttgatccccagttcgcgcaacagcgctatcaagtcatccagccgcgggaacgactcgacctcatcctgttcatccaccaggaagtaactgcgcccgccgcttttcttgaaaaacacgatccactcacccaggtcggcagggttctgaatgacatgggtagccgatatctggccctcggcatagcgggctttgacgtgttcacgtttcatggcggttttccgaaaaagacacatgccgcgcaacctcaaggcttgcgcggcatggttggcattgaatagccgacagtttaacggatgccctggccaatcaacacgccgtcaacggtttgcccatacagattgacgccgtcgttggcgtgaaacttcacgcgggttttctccaccgagccctccaccaggcgcgggtcctgcggccgctcatggctgttgacgtatgcggcgacgtcccaggcctgctgatcgctcaagctgccgcccttgcccaatggcatgttgtgcttgataaaagaggccgccgtgttgattcggtgcatgccggcgccccagttgtaagagtctttaccccaaagtggcggcatgacatagctgtcgccgaccttctgcccctgcccttcgccgccgtggcacaccgcacattgacccttgtagacctcggcgccctgagccaggttgtagccattggccggttgcgcaacatcggggtaaccgcgcccaggcagctccacacccaaaggcgccttgctggccagccagtaggcatacaccgacagcgcggtaatctccgggctgtccgccgccgggggtgtgccgccgttcatgctgaactggaagcaaccctgcaatcgctcggcgaaggtgttgaccttgtcatttttcttccgataggccgggtacatcgggtacgcggcccacagcggtgccgagttggcgaggcggccctggtccaggtggcagttgctgcagttgaggccgttgccgacaaattgcggcgccaggcgctgggtgtcgacgaataacgcgtaaccctgccggaccaatttgccgtaggcgttgtcaggcaattcgctttcttgaggcggctggaattgattggccgccgggtgcgcagcagcgggcggcaattgcgactggtcttccatggcgatcgtggcggcatgggccggcagtgccagcagcaggctcagcgcgggggcaaacaggcacggcttcatggcttggcctccacgggcagcgacgcgaagtagtgggcgacgccctgcacttcctcgggagtcagggatttggcgatgtggcccatcaagtcattcggatcattgcgtcgagtgccgttctgccaggctgtcaattgcgcggccaggtaggcggcaggctggccggccaacgctgggaacgcatcgccaacccctactccggcaggcccatggcagctgacgcaggcgggaatctgccgctcccaggcgccttgcaaggcgagcttctgcgccgcgttgccgggcatttcgctgcgcgccgccgtggcaggcgccggaaatggcatcgccgcgacggcctggctgactgcagcaatttcggcttcagtcaacgccttggccagcggctgcatcaccgggttgctgcgtgcgccgctgctgaagtcggtcagttgtttacgcacatacgctgccggcaaacccgccaagcgcgggaagcccgctgcggcaagtcccaacccatcggcgccgtgacaggccacgcagggcatggcacccggctgtgaaccgccttcggtgaatatcttttttccatccagcgcgttggcattgcctagcaacagcaacaacgcgccacccattaacactcgttccaaagacatcatcacggctccatttttatagttatatgcttagctcactttcgcataagcctacaaatggtagggtaatgacctgctccccacaacacccaaaatcagcacaaaaaaaagcccggcgctgcagctgcagcgccaggctttttatcggattcagtgcgcgggatgcaccggcaaggctcagccggagatacattcctctgcggctttcttcacgtcgccggggcggatgggtacattggacatgctttcatacagcttgatgctgctgccgctggagcgctcctcgatttcgaagattgccgaagggtcagccgagaatttctgcggcacaatcacctgcacaccgtccttatgcggttcgatctgcggcggacgacgggtttccgccaatttgtgtacaacgcacgcggcatattcctgcggcttcttccctgaaatgaccaccatcgttggcggggtctgcttgatatctgcaaccgaagcacatccacctaacgccaaggccagaaccaacacactccacttcatactaaaacctccgataaagaccctacgacagcgcagagaggtattttctcccgccaatgtaggatttatctctgaaaacacggtgaataactgttttaaattgtcgaagtcgtcgacgacgacccgataataaactcgctggggctgataaactccatcttaacctacgtatcattctgatttttcagaaaaagcccttctggagacacccgcatgaaattcatccaccagcgcgagcacctcaacgagggcgacatcgttgtcatcgaatgctcgcagacctgcaacattcgcctgatgagcgatgccaactttcgcagcttcaagaacggtggccgccacacctaccatggcggcgcattcgataaattcccggcgaagatcaccgcacccagcaccggtttctggaacatcaccttggatgtagtaacgcgccgcgccatcagcgttacgcgcaaaccggcgttgtcacataaaattcgcatcgttcggcgcaccagcaccaagctgagctgacccgcacactcgacaggaaaaccgctgtgactaccaccaccaaatacgtcatcaagtacaagctcaacggcgagcgtcgcttcgaattcgcgcagttgcacagcaacgacgtcgaagaagccaaacaagccctggcgaaaattcacgacgccgaagacgaaatcaccgacatcaacgtgagcaaggcgctgtaagccatgccaggccctactggcgatctgttcggcgacgaagccctgcaacaacccgcagggcgcgaacagatcggcgaagagtcctacgtattacggggctatgccctgccctggatcgagcgcctcttacctgagttgcggcggatactggcccagtcaccgtttcggcagatggtcacacccggtggctttaccatgtcggcggcgctgagcagctgcggcgagctgggctggaccaccgacagcagcggctaccgttacagcccgctggacccgcgcagccagcaaccctggccggcgatgcccgacaccttgcgccaactggctacgcaggccgcacaggaggccggcttcagcgacttcgacccggacgcctgcctgatcaaccgctacgtgcccggtgccaaaatgtccctgcaccaggacaagaatgaacgccgctacagcgccccggtggtctcggtgtccctgggtctaccggcgattttcctgttcggcggccatgaacgcggcgaccgcacgcaaaagatctcgctgtttcacggcgatgtggtggtctggggcggcgttgatcgcttgcgttttcatggggtgatgccaatcaaggacggcgtgcacccgatcatgggcccgcaacgcatcaacctgacctttcgcaccgccggttaatttgaccgcaagcttcagagtgtcgagagctacccgcgcggttaatctgcccgtgacccgtcaagagtgcaggccatgaacaaccaacaagatccccgctgggccgccatcgtcgcccgcgacgccaaggcagacacgttgttcgtctacggcgttaaaaccaccggcgtgtattgccgccccagcagcgcctcgcgtttgccgaggccggaaaacatcgaattcttcgacacgccgcagcaagccgaagccgcgggatatcgtcccagcaagcgcgcctccggtgaccagacgcaattggctgcgcaccacgcgcaactggtggccgaagcctgccggcaaatcgaacaggcagaaaccccgcccagcctggacgcactcgcgcgccgcgccgggttgagcgcgtttcacttccatcgcgtgttcaaagccatcactggcctgaccccaaaggcttacgccagcgccctgcgttcgcgcaaagtacgcgatggcctgaagggccagcattcagtgaccgatgcgctgtatgacgcgggcttcaattccaacagccgcttttatgaatccgccgaccagctactcggcatgaagcccagcgattacaaggctggcggcaccaacagtgaaattcgttttgccgtgggccagtgctcactgggagcaattctggtggcccagagccaacgcggtgtgtgtgcgattttgctgggggatgacccggacaagctggtgcgtgacctgcaagaccaattccccaaggccgaactggtcggcgcggaccgcgacttcgaacagttgatcgcccaggtcgtgggctttatcgaggcgcccgcactgggcctggatttgcccctggacttacgcggcaccgcatttcaggagcgggtgtggcaggcactgcgcgaaattccggtgggcagcaccgccagctacgcgcagattgcccagcgcatcggcgcaccaaagtcctttcgcgccgtggctcaggcctgtggcgctaaccacttggccgtggcgatcccctgccatcgcgtagtgcgcagcaatggcgagctgtcgggctaccgctggggcgttgagcgcaagcggcagttgctggagcgcgaaacccgctaaaccgctggcggatgccgatctagatcagcgccacgtcatccgcctggtacacctcgaagtcgttgacccaggcccgcgactcaacaccaagcctcacgtggcttttctcttgcgaaactccgccaccttatgccggttgccacacaacgccatgctgcaccagcggcgcttgtgagccttggtccgatcataaaaccacaggatgcattccgggtgttcgcagcggcgaatcaaattgaaatcgcctgccaccaataaatcagcggctgcttcggcaatcggcgacaaaaattgctcagcggtctgctgcttgcgttggcgctgcagttgcggcgcgccggacgcaggccagaccaactgcgggtggctgaccgctttgcgtaaaaagcggttgagggccgccgggtcacccgcctcgccgttcttgcgcgcggccaccagctcacgaatcacctcgcgcagttcgcgtgcggcactgagcaaggcgccctcttcaaatgtgggaacactgccttcctcggcccactccaggcgcaccagccagcgcgccacgtcggcgtcggctttccagaaatcccacggcgcagcgtcgatattcgccaaggtattgagcatatccagcaccgggtcgtcggccagtacgtagggttctgaaggcgttgctgcgggtgtaggggcggccatgattcgtcctcttgagtacgccgcaatcgtaaccgctattttgacgtctggatagttacagccgacaaaatactaacctgaataattgcgttgacaggttacatatttgagcgcagtttttaaaaacggtaacccgtattccaatattaaccagttacaaaggtgtgttcatcatgtctatcgcagccccagtcgttcgctaccaccacgttgatgtcgatggcgtgcgcatgttctaccgcgaagctggcgaccccgccgcgccggtgatgttgctgctgcacggtttccccagttcgtcgcacatgtaccgcgacctgatcccgctgctggccacgcgctttcgggttatcgcgcccgatttgcctggctttggtttcaccgaagtacccgccgagcgcaactaccactacagcttcgataacctggcaatcaccgtcgggcatttcgtcgatgcgctgaagctgagccgctatgccctgtacgtgttcgattacggcgcaccggtgggcctgcggctggcggtggcgcacccggagcgggtcagcgcgctcgtctcgcaaaacggcaacgcctacctggagggtttgggcgatgcctgggcgccgattcgtgcctactgggccgaaccgagcgcagccaaccgcgaagtgatccgcaacgcggtgatcagcctggaaggcacgcgctatcaatacctgcatggcgtgagtcagccggagttggtcgcgccggagtcctacatgctcgatgtgctgttgatgcaacgccccggtaacgacgagatccagttggacctgtttctcgactaccgcaacaacctcacgctgtacccggcgttccaggcattcttcaaagctacccaggtgccgaccctggtgatttggggccagaacgacccattctttattccgcctggcgcccacgcctacaagggcgacaacgccaacgccgtggttgagctgctggacactggccacttcgccctggaaacccatgcggcccttatcgccgagcgtattcacgccgtgttggggcatgccatcgactaacgatggcgcacgaaactgcgccatcgtccagtgaataaaacagactggccgggtgccaatggccctgctaaaacagcgaaaagccctactaacgctggagacgcatcccatgagcacttggccagacacgcgaattctcgacctgctcggcattgaagtgccgatcatccaggcccccatggccgtggcaaccacaacgaccatggtgattgccgccaatgaagccggcgggctgggctcgatgcccgccgcggcgctcagcatcgagcaactgcgcgaagccttgactacgattcgccaggccagctcgcgccctatcaacgtgaattacttctgccatcaaccgcccgcggccgatgcagcacgcgaccgccgctggaaggacttgctggagccctactaccgcgaactcggtgccgattttgatgcgccaacgcccgtgtccaaccgtgccccctttaacgaagccgcctgccaagtggtcgaggaatttcgccccgaagtggtgagctttcactttggcctgccggaaaaagccttgctcgaccgcgtaaaagccaccggcgccaaggtgctgtcatcggccaccaccgtggaagaagcaatctggctggaacagcatggctgcgacgccatcattgcgatggggattgaggccggtgggcatcggggtttgtttctcagtgatgacctgaatacccagatcggcctgatggcgctgctgccgcagattgtcgatgcggtcagcgtgccggtgattgccgctggcggcattgcggatgcgcgcggcattgtcgcggcattcgccctgggcgccagcgcggtgcaaatcggcacggcttacctgtttacccccgaagccaacgtcagcgcgtcccaccactatgcgttgcgtcacgcccaggccagcgaaaccgcgctgaccaacctgttcaccggccgcccggcgcgtggcatcgtcaatcgtgtgatgcgtgaactcggtgcgatccacccggccgctcccgcgtttcccacgtccggtggtgcgttgatgccacttaaagccaaggatgaagccggtttcagcaacctgtggtccggccaggcgttgcgcctgggcaaagacatttccacctatgcgctgacccgcgaattggccgcgcaggcgctggccaggttcaaatagaactgacgcctgaggcaactttgcgctgtaccggcaatggccaaccgctatatattcccatacatagcggttacgccttctacctataacgcgccgtacaccttcaaaggagctgcttcatgatgatccgcgcctcacgcctcgcccctgccctgattgccgcctttgcgctgggctcggcccacgccgatgaagtgcaagtcgccgttgccgccaacttcaccgcgccaatccaggcgattgccgccgacttcgaaaaagacaccggccacaagctcgtcgcggcctacggcgccaccggccagttctacacgcagatcaagaacggcgcgccgttcgaagtgttcctcagcgcggatgacaccacgccaaaaaaactcgatgacgaaggcgccaccgtcaaaggttcgcgctttacctacgcggtcggcaccctggcgctgtggtcggccaaggaaggttacgtcgatgccaaaggcgatgttctgaagaaaaatgaataccagcacctgtccatcgccgatccaaaaaccgcaccttacggcctcgccgccacccaagtgctggccaaggaagggctgaccgaaaaggtcgcgcctaagctggtcaccgggcagaacatcacccaagccttccagttcgtctccaccggtaacgccgagttgggcttcgtcgctctgtcgcagatttataaagacggcaaagtcaccagcggttcggcttggatcgtgccggccgccctgcatgacccgatcaagcaggacgcggtgatcctcaccaagggtaaagacagcgccgccgccaaagccctggtcgagtacctcaaaggcccgaaagccgctgcggtgatcaagtcctacggttacgagctggcccagtaaatgccgctgtcgagtgccgatttttccgcgatttggctgaccattaaactggcgtcactgaccactgtgatcctgctggtcatcggcactccgattgccctgtggctgtcgcgcacccgttcctggtggcgcggccccatcggagcggttgtcgcgctgccgttggtgctgccccccacggtgatcggtttctacctgctgctgaccatgggccccaacggctatttcggccagttcacgcaatggctgggcctgggcactctgacgttcagcttcgccgggctggtgattggctcggtgatctattccctgccgtttgtggtgcagccgttgcaaaacgccttctccgccatcggtacacgcccgctggaagtggccgccacgctgcgcgccaatccttgggacacgtttttcacggtgatcctgcccctggctcgcccaggctttatcaccgcgtcgattctaggtttcgcccacaccgtcggcgagtttggcgtggtgctgatgatcggcggcaatatccccaacaagacccgcgtggtctcggtgcagatctacgaccacgtcgaagccatggaatatgctcaggcccattggctggccggctccatggtggtgttcgccttcctcgtattgctggcgctctactccagccgtaaaaccaagatgggctggagctgatcgccatgattgatgtacgcctgcaaatgcactactcgggctttgctttggatgtggacttgaagttgcccggccgtggcgtaaccgcgttgtacgggcattccggctcgggcaaaaccacctgcttgcgctgcatcgccgggctggagcgggccgaggacggctttgtgcagatcaacgatgacgtttggcaagacagccgcaacggcgtgttcgtgccgccgcacaagcgtgcgttgggttatgtgttccaggaagcgagcctgtttccccatctgtcagtgcgggccaacctggagttcggcctcaagcgtattccacgcacgcttcgccgcgtggacatggcccacgccaccgaattgctgggcatcggccacttgcttgagcgccatccgcagcacttgtccggcggcgagcgccagcgcatcggcatcgcccgcgcgttgctcaccagcccgcaattattgctgatggatgaaccgctggcggccctcgacagtaaacgcaaaggcgagatcctgccgtacctcgaacgtctgcacgatgagctggatattccgctgctgtacgtcagccatgcccaggacgaagtggcgcggctggccgatcacatcgttttgctcagcgacggcaaggccctggccagcggcccgattggcgaaaccctggcgcggctggatttgcccctggccttgggcgacgacgccggcgtggtgatcgatggcagcgtcagcgcctacgacgaccactaccaattgctcacgttgcagttgcccgacagcgctttatcgatacgcgtcgcccatgcgccgctggcgttgggcaaacagctgcgcatcaaggtgcaggcacgcgatgtgagcctgagcttgcaggcgcaggaagccagcagcatcctcaaccgtttgccggtgacggtggccgaggagatttcggcggacaacaacgcccatgtgctggtgcgcctggacgccggcggcacgccgttgctggcgcggattacacgcttctcccgcgaccagttgcagctgcatcccggccaggcgttgtgggcgcaaatcaaggcggtggccgtgctcgcgtaagtatttggcacccgcgcaaaaccctgcggtcaatcagacataccggcctgattaccgataaggaatttgcaccatgcccgatgccgcgctgcctgccgacctgccccgcgacctgcattacgttgacgacacccaacccgggatccgccgcaagaaggtgcgcggcaagttccagtatgtcgacgccaaaggccaggccatcaccgatgccgatgaaatcaaacgcctgaatgccctggccgtgccgccggcctataccgatgtatggatctgcgccgacccgcgtggccatctgcaagccaccggccgcgatgcgcgcgggcgcaagcagtaccgctaccacgcgcgctggcgtgaagtgcgcgacaccgacaagtattcgcgcctgcaagagttcggcaacgccttgcccaaattgcgcaaacagctggaagcgcaaatcgccgagcccggtttcacccgggaaaaagtcctggccacggtagtgatgctgttggacgcgacgctgatccgcgtcggcaatacgcaatatgcccgcgataacaaatcctacgggctgaccaccttgcgcacccgtcatgtggacatcaagggcagcgagatcaagttccagtttcgcggcaagagcggcgttgagcatcagatcagcgtcaaggaccggcgcctggcctcggtggtcaagcgttgccttgaattgccggggcaaaacctgtttcagtacctggatgaggacggcgaacgccataccgtcagctcccacgacgttaacgcttacctgcacagcctcaccggcgcagatttcaccgccaaggactatcgcacctgggccggcaccgccatggcgctggcggtgttgcgcgaattgcagtggcagcccgagtcggatgccaagcgccatgtggtggcgatggtcaaggacgtcgccaagcagctgggcaacaccccggcggtgtgtcgcaagtgctatatacacccggccgtgctggagcatttcagcctcggcgagctgtccaaactgcccaagccgcgggtgcgcaagggcttgaaagccgaagaagtcgcactggcgatgttccttgagcaactggcggcggacttgccgaagaaagccaaggtgggttagcctctgagccccttctgattcccgggatgaccgccgacgtgaacaactaagccttccaaaatgtatctgcaacgagccgcctggcgcgcttgttggcctgttcgacatttttttggaggtgctgatgactgacgtcaaccggctgcccgtactcgtttccctgcaacacctgacattccagttcgccgatggcgagaccttgctggaagacctcaccctgtcgatcgatcacacgcccaccgggattgtcggccgtaatggccgtggcaaaagcatcctcgcaaaattgcttgccgggctgctggcgccctcttccggcacgctgaaaggctcggccagcgtggcttacgtcgcgcaaacactcgccgttcaacccggcgcaactctcgccgatgtcacgggcactgccgaggtattggccgcccttgaacgcatggcccggggcgaaccccaggcgcacgacctggcgctgatcgacgaccgctgggacctcgcccagcagctgcgcacggcgctagacgccgcaggcttgctccacctcgatgcgcacacgccagccgggcaactcagcggcggccaactggccagaatcgcggtgatcggtgcgctgttggcaacgccgcaactgctgattctcgatgagcccaccaaccacctcgacagcgtcggccgtgactggctgctgagcgtgctcggcgcgtggcgcggcggcctggtggtggtcagtcatgatcgacagttgctcaacgccatgggccgcatcattgaactgtcgccactgggcgtgcaggtgtacggcggcaactacgatgcctaccgcttgcagcgcgacgcgcagcaacacgccgccctcgccgccctggaacacgcacgcctggcgcgcagccgcgagcggcgtcgcctgcaaaaagatcatgacagcctgcaacgcaatgccgcccgcgcgcgtaaacacgcagaaaccgccaacgtcaccggttttaccaaggcacgctggaaaggcgctgcgaaggaaattgtcagcactgtgcgcagtgagcatcgcgcgtataaaactgaactggatgggcaggtgcgccaggcgtacgaacgcgtcgtcgatgaaccgccgacgctgttggccctgcccggctcggcagtgcccaacggccgtcacgtactgacgctgcataacgcccaactgccgtggctggccccgcaggcaccttcaacttacctcacgctcaacctcatgggcccgctgcgcattgccgtgcgcgggccgaatggttgcggtaaatccacgctgctcaagctgctggcggggcactggcaggcggtcagcggcgaatgcagggtgcacgtgcccagcgcgtatatcgatcagcacctggcagtgctggacgaccatcgctccatcgtcgaacagctcaacctgctcgatacgcctttggccgaagccgaactgcgcacgcgcctggcgttgctgcatctggacgcactgcaggtgacgcaaccggcacgccgtttgagtggcggtgagcgcctgaaagccgccatggcgattgcgttgtggcgcgaggtgccggcgcagttgctgctgctggatgagccgaccaaccacttggacctggagtcggtactcgcctttgagcaggcgttgcagggttttaccggggcgatgatggtggtgtcccatgacgaggcgtttgtgcaggccatccggccgacgcatcatttgacctggcaagctgaaggctggcgactgcaaggtgcttgaggtcattgcacgcgcgctcaaagcgtcctacggtagtggccgaataatctcacccgggagtccagcaccatgctgcctgcagcgcgtacaccctacgccaatgccgccctcgcccatcgccagcgttggcgagggcgggtcggtttaatgttggtggcgagtctttccgtgctggccggcatgaccgatgccatcggctttatggccagcggcgattttgtctcgttcatgagcggcaataccacgcgcctggcggtggcgattggcgcgggtgatgtgggcctgtcggggcgtttgctgttgctggtcgcgatgttcgtggtcggcaacgccttgggcgtggtggtcagccgcctggccaaacgacatgcgctgcctttgctgttgtgcattgcggcgttgttgtgcggcgcggccttgtggccttttgtcgataccttgccggcgttgctcgcagcgattatcgccatgggcatgctcaatgcggccgtggaagaggtcaacgggttgccggtgggcctgacgtatgtgacgggcgcgctgtcacgctttggtcgcgggctggggcgctggatgctgggggagcggcgcaatgggtggcgggtgcagttgatcccgtgggccgggatgtttgtcggcgcggtgatcggcgcactgctggagcagcaactgggcctcaaggcgctgctggtcagtggcgcattggcggcggtgttgggggtggtgtcgctgaagattccccggcgctggcacttgggttacatgccgcgataaggataaaaagaggcccgcccgacgtttcggcctcgacgtccgtgtactggtaaagagccatcacgtcgagcgagcgggtggaatgataagcgaatgtccggcggctgtcccgccgggcatttccgaaaaccactaaggcaaaggattacaggcaagtcgcgagtgcggcgaggcggcgtttagccggcatcgtgtcgtcgcccgcgaagtagttcacgctggaaccggcgcctgcgctgcgcacgtcgacaaaatagtcgccgccggtggtgtacaccgtgaagccgccggtttcgagcggttccttgaagccaccggcgtcaacgccgaataccgcttcgtcctgccagccgaactggatgcattgggcaaccaccagtggggccttttccgacgccagggtcttgtaaggcgtaccggtgcgcgcctccttcatcttcgagcccgcgcaaccggacagtgctgccactatcagtgcgccaattaccaccttccgcatgccatcgcctccttggaaaaaccgcgactctatcatttgcaggcggcattcaaggattattacgtcaaggctgaagccaggaagaaggcgtcaccggccgccgaatgaattttgtttcactgtgaagggaggcggcgctgcctatagttgccaggctcatttttaagaagtctcccttctgcccgccctcccgcgggcttttttttgcctgcgcggtgcgcaatgtgggagctggcttgcctgcgatgcgggcgccgcggtgtaccagtggccacccgtagatgccatcgcaggcaagccagctcccacagaagaacagatctgctgtgttcgcgactcagagccaccagcgaaacagatagaacaaccccatgctcagcagcaccgtgatcaacacactgcgcgtccagaacatcaacgccaccgcgcagatacccgccagcaaatatggattggccgggctcaggttgagcctgtggtcggcgagaaagataatcggcccacaaatcgccgtcagcatccccggcaccgcaaacccgaggaactcccgcgcgccgcgattgagccgcaccggcaaccgcggctcaatgaacacgtaacggttgaaaaacaccaccaggcccatggccacaatcatcaggtaaatcatcgctgcccgactcccagccgcttgcaggcaaaccccgcgctcatccccaacacacccgacaccaccaccgccgactcccagtgcaagtaactcaaccacaccgagcacaacagcgacaccgccacacacaccaccgtgggcacgtcgcgcaccaccggggtgatcaaggcgataaaggtcgcggcaatcgaaaactccagccccaactggtccaggccgggaatgcttttgcccagcacgatgccggccagggtaaacaggttccagatgatatagaacgtcaggccgacgcccagggcgtaccagcggttgaaggtctctcggtcatagtgattgaccagcgcaaagaattcgtcggtcagcagaaaccccaggctcatgcgccagcgtgcgttgagtgaggacaatgttgggcgcatgtgcatgccataaagcagatgctgggaagtcagcagcaaggtggtcagcacgattgaaatcaggctggcgccacttttgaccatgccgattgcgactaactgcgcggcacccgcaaacacgatggcggacaaaccttgggcctgcagcggggtaaattgcgcatcgatggccatggaaccggccagcagcccccaaggcgcacaagcgagcgataacggaatgacggcaatcgcgccgcgcccgaaggcgtaatgaggtaaggctgtaggcatggagacggctcatcgacagacagtcgacaagcatgccagcgcaataagggtgttgtcttgaacgatcgtgctcaggcgagcttgaccgagacctgctccaccgagtcacgcgcttcgcgcagctcgtaggcatcctggttgagccggtgaatggtattgagcaagcgttggcgcagcacttcgtcgccgagtttttccacggcgcgcatcaggtcaaacgccgcagtttcgttattgtccgcgacggaatcgagggtcttgcgcaggttgcgagtggcacgggtcacgcgggttcttccttcatcagcaatgggcaggcactttaggacattcgtgtttcattttaatttcagtcacttgtggctgatttggtggcatttgatccacgtcaatcgaattcaggatttgacctacatatatggctatacgtatattcggacagccatatatacgaaggcctcgacatgccggacctcatctccccgcccaccctgttcaaatgcctggccgatgccacccgcgcgcgattgacgttattgatcctgcgtgaaggcgaactttgcgtgtgcgaactgatccatgctctggacgacagccagccaaaaatctcccgtcacctggcgcaactgcgcagttgcgggcttttgctggaccgtcgtcagggccaatgggtctattaccgcatcaacccggcactgcccacttgggtgacacacgtgctggaaactaccttgcaagccaaccagccatggttgcacaacgacgcgcagcgtcttgatgcaatgggcgacagaccacaacgggccagcacctgctgctgagccatcggagcgtttattcatgcttgtcgcaattgcgatttttatcttcaccatcgtcctggtcatctggcagcccaaaggcttgggcgttggctggagtgcaaccatgggcgcgatcctggccctggcgtgcggggtgatcagcctggcggatatcccggtggtgtggcacatcatctggaacgccaccggcacctttgttgcgctgatcatcatcagcctgttgctcgatgaggccgggttcttcgcctggaccgcgttgcatgtggcgcgttggggccgagggcgtggccggcgcctgttcgcctatatggtgctgctcggggcgctggtgtcggcactgtttgccaacgacggcgcggcgttgatcctcacgcccatcgtgatgtcgatgctgctggcgctgcgtttttccccggcggcgaccctggccttcgtgatgggcgcggggtttatcgccgacacggcgagcttgccgctggtggtgtcgaacctggtgaacatcgtctcggcggattatttcaagatcggcttcaacgagtacgcggcggtgatggtgccggtgaacgtcgtcagcgttgcagcaaccctggcagtgctgctgtggttctttcgccgcgacattccacaggcctatgacccggccgacctggatgacccgaccagcgccatccatgaccgtgcgacctttcgcgccggctggtgggtgctcggtattttgttggtcggctgtttcgcactggaaccgctgggcattcccatcagtgcgatttccgccgtgtgcgccgtgctcctgttggtgattgccgccaagggccacaaaatctccacgcgcaaagtgctgaaagacgccccgtggcaaatcgtgatcttttccctgggcatgtacctggtggtctacggcctgcgtaacgccggcttgaccacctacctggcgacctggctcgacaccttcgccacctacggcgtgtggggcgcagccatgggcaccggcgtgctgactgcgctgctgtcgtcggcgatgaacaacttgccgacggtgctgatcggcgcgctgtccatcgaatccagccatgccgtgggcgtggtcaaggacgcgatgatctacgccaacgtcatcggcagcgacctgggcccgaaaatcaccccgatcggcagcctggccaccttgttgtggctgcatatcctcgcgcgcaaaggcatcaccatcacctggggttactacttcaaggtcgggattgtgctgaccttgcccgtgctgttgatcaccctggccgcactcgcattgcgcctgagcatttgaaggaaatagccatgaaagtcctgtttatgtgtaccgccaatagctgccgcagcatcttgtccgaggcggtgttcaaccatttggcgccgcagggcttcgaagcgatcagctccggcagcttccccaagggccaggtgctgccgcgcagcctgagcacgctgcaggcggcgggcatcagcaccgaagggctgtacagcaagggcaatgatgccttcgaaggcagcccgccggacgtggtcatcaccgtgtgcgacaaggcggccggggaagcctgcccggtgtatttcgggccggcggttaaagcgcactgggggttggaagacccgtcggaactgcatgctgacaacgcccgcgtcgacgccgcgtttaaggccacactcgacatcatcgccacccgttgccaggcgtttttcgccctgccctttgctcacctcagcccgcctgaattgaaagctgaactcgaccgcatcgcgcagttgtagccggagacgctcatgagcaccctgcccaatctcgacacaacgctcgtcaacccgatgcctgccgaaccgccgcacccgccgcgcattctgttgctttacggctccacgcgcgcgcgctcattcagccgcttgctggtagaggaagccgcgcgcctgttgcgtcacttcggtgccgatacgcgagtgttcaacccgtccggcctgccgctgccggacgatgcgcccaacgatcaccccaaggttcaggagctgctggacctgatgcaatggtctgaaggccaggtgtggtgttcgccggaacgtcatggctcgatgtcggcggtattcaaggcacaactcgactgggtaccgctggccctcggcgccgtgcggcccacgcagggcaaaaccttggcggtaatgcaagtgtccggcggttcgcaatcgttcaacacggttaaccaactgcgcgtactggggcgttggatgcgcatgttcaccatccccaatcaatcctcggtgcccaaggcgttcatggagttcgatgaccaggaccgcatgaagccttccgcgctctatgatcgtgtcgtcgatgtgatggaggaattggtgaagttcaccctgttgctgcgcgatcgcccggacctggtcgaccgctactcggaacgcaaggaaagcgccgctgaactgtcacagcgcgtcaatcagcggtcgatctgagccacactggcggcgtatgctcatgcccaccctctaaccgagttatagcgatgagcgccgtgcaacacgcctggctgggcaattacgaagtcagcagcaccacctgcaccggcctgacctttgcccgccacagccatgatgaatgcgtgatcggcataaacctcgtgggcgaggaaaaagtctggctcgaccgccgcgaattcgacgccggccccggcagcattaccttgtacaacccagggcagattcagggtggcggcgcggcggatggcgcgccttggcagttcgtcagcctgtacatcacggccgctcagttagcggcggatctaggcctggcgcatgtggaatttgaacgctcgctgtgctttcaaccggtcttggcgcagcgcctggcggcggcggtaaaaggcgccttgagcggcgatgcgttggtgcgcgaactgaatgaagacgctttggttttgctgctcggtgaagtggtcggcgtgagcggtgtgcgcctgcccggcgcggcgaaaaccggcaccaacctgatcagccgcgcgcaggaattgctcgccgcgcagttgcaccagtcgacgcctctggagcaattgggcgacgaactgggcctgtccaaattccacctgttgcgaacctttcagaaagaaaccgggctaagccccaggcaatgggccatgcaactgcgcacctgccgtgccaaaggcctgttgcgcaacggcgcctcggccagcgcggtcgcccatgacctgggctttgccgaccagagccatctcaatcgacatttccgtgccgcgtatggcatcacgccaggccgctatcaaagcgtgttgaagcgctaagagcgcaatctggttcaagacgcccgcacgccgcaccgacacactgcccgcccgagttgaaggaaagcgcgcatgttgacgatcttcgtttacgcattggtattcggttttgtgttttgcctctccccgggcgcggtgctggccgagacgttacgccgaggcctgctccacggctttaccccggccttgctggtacaggtcggctcgctggtgggcgacgccgtgtgggcagtcattggcctcaccggtatcgccctgttgatccagcatgatgccgtgcgtgtgccgctgacggtggtgtgcgcgctgtacctggcctggctgggcgtgcgcagtttgctcgacgcctggcacttgcccgcaacggacaccgcaccggccagctccgggcagaacgcgctggcagtgggtgcggcgatttccctggccaacccgaagaacattgtctactggggcgcgctgggcagcgccttgtccggcatcgtcggcgccacgccgagccatgggcaaaccctgatgttttttgccgggttcatgttggcgtcggtgctctcgtgttttctgattgcagcgttggtcaatctgttacgcaagaacgcatcgccgctgtggcagcgcatcagttacggtgcatgtggcgtagtgttgatctatctggctgctctggcggcacagggtatatgaagttatatacctcgcaagttgctgcgcgcttatctgaatgaactctgaacacgggagaatttaattaatcatgcgttgacattttgtaaccgtctgagtagattgcccgtgcccgcaactggggccttttttaaacctcacaaaagaagccaatggacacagtatctagtcgctgtccgagcaccgccttagcgggcatcgggcgccaaacccagaatatgacaggactcgccttccaggtccggtaagctgcgctagagcttgatgctccaccgtaactgcctcaccggtcgcccgtccggtcccgaggtgtgttatgaccttccaactccttgttttgcccgatgtacgtacgctagccgcagccctgcgtgccaagctgtgccgcgagcctgtgggcttttcgcctactcgcaccgcctttgctgcaccctcttcccaactgcgtccggcgcccccgctggcgcactggcgtgtctgccctgacagcggtcaactgctgcagcactgggaccacgccgaccctcaagacccgcagagacctcaggtttccaccctggctcaagccagcgtgctgctcggtgtttacctgagcctgcgcgccgcttaaaccggctggaaacagcaactttctgattaacagtctggagttctttatgaacacgtccagtagtagcccgctgcgcgttagttaactaacgcgcgtctggcgggcgctgtagaagttatatgaacaccttatttaaaccgatcgcgaagtccgcggctcggcatgctttcgctcgcctgtattcaggtaagtaccgggtatgttttgtcgagaattggcgacaggagtacagacaatgagcgccgtaaaaaacacgcctctgcacaagaaaaatggcaccaccaccgacaccaaactgtcgatgcgtgccgcccgtgaagcccagaacggcctgcaagccacccttgccaatgtgcgagcgacccaggacggcctgaccgaactggacgcctcggcgcgcctgcaacgtgaaggctacaacgaagtggctcatgacaagccgcctcacgccatcattcagttcctgcaggcgctgaacaaccccttcatctatgtgctgctgaccctgggcggcatcagctttgtcaccgactactggctgccgttgcaggccggtgaagaagttgacctgaccaaagtcatcatcatcatgaccatggttctgctcagcagcttgctgcgcttctggcaggaacaccgttcggccaaatccgccgaagccctcaaggccatggtgcgcaccaccgccaccgtattgcgccgcgagcaagtcggtgcacagccgacgctgcgcgaagtgccgatgcgcgacctggtggctggcgatattgtgcagttgtcggccggcgatatgatcccggccgatatccgcctgatcgaatcccgcgacctgtttatcagccaggccgtgctgaccggcgaagccttgccggtggaaaagtacgacacgctgggtgacgtcacgcagaaatccgcgtcctcgctggccgccgaccaaggcaacctgctggacctgccaaacatctgcttcatgggcaccaacgtggtcagcggccgcgccaaagcggtggtggtcgccaccgggccacgcacctactttggctcgctggccaaggcgattgtcggttcgcgggtgcagaccgcgttcgaccgtggggtgaacagcgtcagctggctgctgattcgcttcatgctggtgatggtgcccatcgtgttcctgctcaatggcttctccaaaggcgattggggcgatgcgttcctgtttgccctggcggtggccgtgggcctgaccccggaaatgctgccgatgatcgtcagcgccaacctggccaagggcgcgactgccatggccaagcgcaaagtggtggtcaagcgcctgaacgcgatccagaacttcggttcgatggacgtgctgtgcaccgacaagaccggcaccctgacccaggacaagatcatcctcgaacaccacgtcaacgccttcggccaacgtgatgacgcggtgctgtccctggcctggctcaacagctaccaccagagcggcatgaaaaacctgatggaccaggccgtggtgcagttctcggaacacaaccccaagttccagctgccatttgcctacagcaaggtcgatgagttgcccttcgacttcgtgcgccgtcgcctgtcgatcgtggtcaaggacgccgccggcgatcaattgctggtgtgcaaaggtgccgtggaagagatgctgagcatttccacccatgtgatggaagatggcgcagcggtgccgctggacgatcgtcgccgtgatgagttgctggcgctggccaacgactacaacgaggacggtttccgtgtgctggtagttgccacccgcaacattcctaaagcgctggcacgccagcaatacaccaccgccgatgagcgcaacctggtgatccagggcttcctgacgttcctggatccaccgaaggaaaccgcaggcccggcgattgcggcactgcaacaaatcggcgtggccgtgaaagtgttgaccggcgacaacgccgtggtcaccagcaaaatctgccgtcaggttggcctcgaacccggccagccgctgctcggcgtagaaatcgaagccatggacgacgcgaccctgctgcgccgcgtggaagagcgcacagtgtttgccaagctgacgccgctgcagaaatcccgcgtgctcaaggcgctgcaagccaatggtcacacggtcggcttcctcggcgacggcatcaacgatgcaccggcgctacgcgatgccgacgtgggtatctcggtggacagcggcacggatatcgccaaggagtcggccgacatcatcctgctggaaaagagcctgatggtgctggaagaaggcgtgctcaagggccgcgaaaccttcggcaatatcatgaagtacctgaacatgactgccagctccaacttcggcaacgtgttctcggtgctggtggccagtgcgttcatcccgttcatgccgatgctggcgatccacctgctgctgcaaaacctgatgtacgacatctcccagctggccttgccgtgggacaagatggacaaggaatacctggccaagccgcgtaagtgggatgcgaaaaacatcggccgcttcatgatctggatcgggccgacctcgtcgatcttcgacatcaccacctttgcgctgatgtggtacgtgttcagcgccaacagtgtggaaatgcagaccctgttccagtccggctggtttatcgaagggctgctctcgcaaaccctggtggtgcacatgttgcgcacccgcaagatcccgttcttccagagcacggccgcctggccggtgttgatgatgaccgccatcgtcatctgcctggggatctacgtgccgttctcaccgctgggtaccctggtcggtctggagccgttgccactggcgtacttcccttggctggtcggcaccctgctcgcctactgctgcgtggcccaactgatgaaaacgatctacatccgccgcttcaagcagtggtactgatcacccgcctctgaaaacggtggtcgtcgcccggcggccaccgtgcaacacaaggactctgactatgcgcgtgttgatctgtgcaggtcgtcattacgccgacaccaaaaagtcccgccaagtgctggacgcttaccaccgcctgcgcccgatgcaggtattgattcacggcggcaaccagttcctcggcagtgacatcgaggaatgggcgcgggaaatcggcatcgacgtggtgcgctacccgcccaattggcaacgccacggcaagcaggcggaacgccagcgcaaccatttcatgctggccgacagccgccccgacgtcgtcatcgccctgccgggcggtgacgacacctcggagttggtctgccaggccaaagccagcggcatttcggtgctgaccgtagaaagctgaattcaagcgaggtgcatcatgcacaaaaaacacactcctctgcgtcaggacgggtttgccaagtaccgtgcccgtcactatcgcggcgctcgccataccctgttgctgctgccaccggccaagcgccgcgcactgcaacgtaacctgacgtttatcggcgtgaccctgggccttattttcttcatcgcgctgttatccaaagcccacgcggccggtggcgcttatgtagtcgacgacggcgccgtcaacgcccccggcgaatgcaatgtggacgcctggtacacggccgatcggcatcaaggcaacgtccataacgagacattgaacccggcctgcaccttcagcgcattgccgtcggtgcagtggagcgccgcgctgtcgcgtgccagtcatgcaggcgacgctgaaacccaggtcagcccacaggtaaaggcccaggtatggtcgcgggatgacctggggctgcaaatggcggtgtcggccacatcgcattttgcgctggaccgccaacatgcgttcgacggcgcagatctgaatgtgccgttgacctggcaacccgtcgaagcgttgcgcctgaacgtcaatggtggctggacacatgcctacaacggcggtgagcagaatcatcggctgacgtgggggaccgggttcgagtatcaactggcggacgccttgacgctgatcggtgagcgctacggccaggaaggcggcgaccaggcctggcaggccgggccgcgctttcatgttggcaaactggtcgatgtggatgtggtggttgggcaaagcctgagcggcgaccggaaccagtggttgaccaccggtgctacggtgcgtttctagtttgagtggtgtggatcaaaagaacgcctcggacaacctgtgggagattctatggttgaggggcaaccctcaaccaatcttcggttggtattcggtttgtcctttcatcaaggca

SEQ ID NO: 75 - DNA, 32041 bp, Pseudomonas poae FL10F
ggttaatggtcgggtccccatccgctccttggctaaggtctacttttatctgatgtaaggagataaataggtgggagcgggattgccggggaatggggtgattgagccagctcatttgttcctgtcccacccaattcgggagaaagcccgctcccacatttgattgagtacagcctcaatggatatgtacccgcgatcacaacccctgactcccgcgaatcaaatcataagccttgcgcgcaatcgggttcgccgtattcggccgaatccacaagtagtaagtgacctcaggcatgcgcggcaacccatccgtctcacccagcacgcgcatatccggcccgagcatttccatgctccgcggtgtcacccccaaccccgcgcgagtcgcggccttgatgccgatcaggttcgacgccaggtacgcctgccgccaaggaatattcgcccgctccaacgcctccagcgcataccgccgataaatgctcggctcatccaccagaatcaacggtagcggctcacccggctggtgaatgtactgcgccgaacaaatccaccacaccggcgaagtacgcaaggcaaacccctccaggttcgggtcggaccgcgtggatatcaccatgtccaccttgccccggtgcaagtcatccatcaaaaacgggctgcgccccacatcgatttccaaacgcaaacgcggtgccgagcgggcgatgtggctgaggatcggcggcagaatcgtgtcggcaatgtcatgcggcgaaccaatgcgcaacacaccgctcaagctgctttcacgcagcgaattcaacgcgtcgtcattcagcgacagcatctgccgcgcatgccgcagcagctgcaagcccggctcggtcaattgcttctgccgcccgcgcttttcaaacaggctcacgcccacttgctgttccaggcgctgcatatgctgggtcacggacgactgcgtacgcgccaggtgcatgccggcgccggcgaagctgtggtggtcgaccacggcaataaaggtgcgcagcagttcaaggtcgagggtcgacataggccatttccaaaggcggttttatatcaagggcatgaagttaaacattacagattttaatgtgttgttgaagcggatttttatcaaggcccgtaaataaaaggttatgcctgaatcaaaggtcgcccttatacggcaagttataacgatatgagatatttgcatttccgttgctaccgcactctccctagcatgcccctccatcaggtcggggtacgccgatcattcgccagggggaagtccaatgatgttcaagaaatggttgccggtggccctgggatcgatgatcgccctgggtggcagcgtggcggcccaggccgatgcgacgctggacaaaatcgaacaacgccatgtgctggtggttggtgtgctgctgtctggcgggccgttcggcagcattgatccggccacgcagaagcccaagggcttgaacgtcgacctggccaacgaattggggcgccagctgcacgccgaagtgcaactggtgccggtactgcccgccaaccgcgtgcagttcctgcagcaaggcaaggttgacctgctgatcgccaacatggaatggaccgccgagcgcggtgacatcctcggctttgtgcccaccccgttctaccgcatcggcggcaccgcagcggtactcaaggacagcaagatcacccgctgggaagacctcaagggccaacccgtgtgcacctcccaaggcagcagctacgtcaagccgctgaccgagttcggcgcgcagatcaaagctttcaagagctcgtccgaatcgctgctggccctgcgcggcaacaactgcgtggcggcggtgcatgactccacgctgatcaacccgctgatcaacgacagcaccgaatggaaggactaccgcgccatcagcccggaactcaacccggcgccgtcggtgatctggacccgtcgcggcgaaggcgacacccaggccaaactcgacccgatcgtcaaggaactgcaccgcagcggctggctgatcgacgcccagacccgcaaccgcatcagcccggcctcgccggcgctggtggaattgcaacaacagttcaagggtgcctgagcatgccgtttaaaaccctcaccgtacttggcctggccctatgcgccggtttcgcccacgccgatgccaccctcgacaagatccagcaacgccatgccatcagtgtcggcgtgatcctcagcggcccgccgttcggcaccctcgacccgaacaccggcgagcacctgggctacaacgtcgaactggccaaaggcatcggccaggcgctgggcgtcgagaccaagacggtttcggtgctggcgcccaaccgcgtgcagttcctgcagcagggcaaggtcgacattctgatcgccaatatgcaattcaccgaagagcgcgccgagatcctcgattacgtgcccacgccctatgaagaagtcggcggcgcggcattgattcgcaaaggtgcggggatcaagcaatgggccgacctcaaggacaagccggtgtgcgtgtcccagggcagcaacttcatcaagccgctgcaggaaacctacggcgcgcagatcaaggcgttccgcagccagtccgaatcgttgctgtcgttgcgcggtaacggttgcgtggcggcggtgcacgtcagcccgaccatgcatgcgctgctcagcgatgccgagtgggacggctatgaaattccactgccgggcgacctgattccgtccaaatcggtgatctggattcgcaagggcgaacacgacacccaggcccggctcgatgccatcgtgcgcgactggcataaaagcggtttcctgatcgccctcggcaaacgcacaggcatggcgccgtcccaggccctgcgtgatctgcacgagcagtacagccatgagtgaaacgctgttcgccaccctgcaacaactgctcggcgccgcccatgtgcaaaccagtgctgaagcggccaagtacctgactgacaagcagggccgctacaccggccaggtgatcgcggcggtgcacccggccaccaccgacgaagtcgccgccgtggtgcgcgcctgcgtggccttgcgcacgcccatcgtggtgcagggcggcaacaccgggctgatggccggcgccacgccggatgccagcgggcgttcggtgttgctgttgcttgatcgcatgaaccgcgtgcgccaggtcgacaccgacaacgacacactcacggtggaggccggctgcatcctgcagaacatccaggacgtggcccgtgaggccgaccgcttgttccccctgagcctgggcgccgagggcagttgcaccatcggcggtaacctgggcaccaacgctggcggcactgcggtattgcgttacggcaacacccgcgagctgaccctgggccttgaagttgtcaccgccgaaggcgagatctggcatggcttgcgcggtttgcgcaaggacaacaccggctacgacctgcgcgatttgtacatcggcagcgaaggcacgctggggattatcaccgccgccaccttgaagctgttcccgctgcccaaggcccaggctaccgcgctattagcctttgatgagctggcccaggcggtggcgttcctgtcccatgcccgtgccggttttggggccggcctgacggccttcgaactgctcaccgccgattgcctggcgctgttgcgcgagcagttcccggacggcccgcagcctttcaaaaccgcgcgccagccttggtttgccttgattgaactctccgataatcacggcgaagcgcatgcccgcgaagccttcgaacaggtgctgggcgatgctttcgaacagcaactcatcagtgatgccttgatcgccgaaagcctggcacaaagcgaggccctgtggctgctgcgcgagaacatgagcgaggctcagaagcgcgccgggcgcaatatgaagcacgatatctcagtgccgatttctcaggttgtggccttcgtcgcacataccgacgcgctgctgcaaaaacacttccccggcgtgcgcaacttcaccttcgggcacctgggcgacggcaacctgcattacaacgtggcgcacccgctgggttcgacagtggacgcgcacatggcccattacgccgagttgagcgcgttggtacatgacagcgcccatgcccacggcggctcgatcagtgccgaacacggcatcggccaacgcaaagtcggcatgctggggcgctacaaaagcccggtggaattggacctgatgcgccgcatcaagcaggcgctcgacccgcacaacctgctcaaccccggcaaagtccttgaggtgcagccatgaccgtacgcttgtccaaacgcgtgcagcgcgtgtcgctgtcggccaacgccgcggccaaatcccgcgccaacgaactgcgtgacgccgggcgcgatatcctcgacctgaccaccggcgagccggatttcgacaccccggaacacatcaagcaagccgcctacaccgccatcgcggcgggtgccaccaagtacacgccgacgccgggtgtaaaagccttgcgcgtggcggtgcagcgtaaactggccggggaaaatcacttggactacccgctggcctccatcgtgattgccaacggcgccaagcagatcatcttcaatgctttcgctgccaccctcgacgaaggcgatcaagtgctggtgccgacgccttactggccgtcgtttccggacagcgtgcgctttaacggcggcgaaccggtcttcatcgaatgtgggctggagcagggctgcaagttgctgccggcgcagttggcgcaacacatcactgagcgcacgcgctggttgatcctcaatggcccgggcaaccccagcggcgcggtgtacagcgaaaccgaactgcaggcattggccgaggtgttgcggcgccatccccaggtgctgatcctgctggatgagctgtacgaacacatccgcttcgatgggcgcccggcccagagtttgttgaacgtcgcacccgacttgcagggccgctgcctgctggtgggcggcgtgtccaagacctacgccatgactggctggcgcatcggctttggcgccgggccgaaaagtctcaccgacgcgatggcggtggtgcaatcgcagtccacctccggcgcgtcatcggtagggcaggcggcggcattggcggcctataacggcgggctggacttcctcggcgagcaggtcgcggcctatcaattgcgtcgggatattctggttgcagcgttgaacaacgtggaaggcctggaagtgctcgaaccccagggcggttttttcgtgttcgtgcgctgcgcagggctgttgggccgttctcgcccggacggccagcgcatcgacagcgatgaagacctggtcgcctggctgctggaggagggcgtcgccggtgtggcgggcagcgcctatggcctgtcgccgtggtttcgcttgtccatcgccaccgcgaccgacagcgtggctgaggccgggcggcgtatcgcagccgcctgcggacagttgcaatgatgcaggcgtttgttcattgggccgcaggctttggcctgaactacagcttcctgctcgacgcttaccagcgcggcaccttggtccagggcgcgctgaccaccggtttgctgtgcctgttcaccatcatcggcagcctgttggcgggcatcagcctggcggccatgctgacttcgggcaacccgtggctggccaagccggcgcgggtgtttgtcgaggtcacgcgcaatacgccgacgctggtgcagctgtattgcgcgttcctggtgttgaacatgctgttgacccaagcggtgggcgcggccaacccgctgacgccgtttgcctgggtggtgatcgtgatttccctgcacaagggcgcgttccacgccgaagccttgcgtgcgggcatcgaagcggtgcccgccgtgaccctggaagccgccagctccctggccttcaacaggcgccaattgctatggaacgtgcagttgccgctggcgctgcgctttgccttgccgtcgctgatcaacaacttgatcgacctggtgaagatgactgccgtggcctcggccattgccgtgggcgacatcacctacgccgcgatcatgatctggacccaaagcgacaacgtgctggaactgatgatcctgatcctgagtttcttcggcctgctgagttttatcgtcaattgtgtggggcgctggctggaagcgcgcctgaggatgcccggctatggccattgattcatttccagtgctgtcggcgttgtggcagtggtcgccggcgctggtggcaggctttggccagaacatcctgatcagcctgttggcgattgccatcggctcgctgctcggcctgttgatcggcgcactggcgctgtcgccgctggggtttgtcgcgcggctgtgggtgcaggtatttcgcaatgcgccgtggctggtgctgatctatttcaccacctacgtgttcccgttcgaaatccacatcggcagcagctatgtgtcgttccccgactgggtcaaggtcaccctcggcctggccttgccggcgagtgccaacgtggcggagatcttccgtggcgccatcggttcgatccccagcacccagtgggaagccgcgcggtcgctggcgtttacccgtggccagctgttccgttcgatcattttgccgcagtgcttcaagcgcatgttgccgccgtggatgaacctctacgccgtggtcaccatgggcaccgcgctggcctcactggtgggcgtgcatgacgtgatcgacaccgcgcagatcgccagcaacaccgtcaacctcaccggctttaccgtggtgatctacctcagcctgctggtgctgtttttcgcctactgctacccgatttcccgcctgacccaacacctggagcgccgttatgccttctattgaacccctggtgagcctgcgggatatccacctgtcgttcggcagtaacccggtgctcaagggcattgacctggatgtgcatcgcgggcaggcggtgtcgatcatcggcccgtcgggctcgggcaaatccacgattctgcgttgcatcaccgggttgttgcagccccagcgcggcagcattcgcgtgggtgaaacccgcgtcgacaccctggcccatgaagcccagcgcatcgagttgcgcaagcgcgttggctttgtgttccagcagtacaacctgttcccgcacctgtcggtgctggaaaacctggtgatcgccccgcgcaaggtgctggggcgcaaccgcgccgacgccgagaaagacgcgcaagcgttgctggccaaggtgcgcatggagcacaaggcggatgcttatccaggccagttgtccggcggccagcagcagcgcgtggcgattgcccgcgcgctggcgatgcgtccggagctgatcctgttcgatgaagtgacctcggcactcgacccggaaaccgtcggcgaagtgctgacggtgatccgcgaactcaccgaagagggcatgacctgcgtgctggtcacccacgaaatgcgattcgccgaagagatcagcgacctggtgtatttcaccgaaaacggcgtgattgtcgagcatggcagtgccgcgcagatcttccagaaccccagcagcgaacgcacccagacgttcctgcgccatgccttgggcgattcggggcgccgtggccccatcgcccacgacccgtacctgttgaccaatttgagccgttacagcctgtccgtctgataagaggaaaaccgtcatgagtagcgaaaaccgtgctgctgtcatcgaagcgttcttgcagcaaatccgcgtcatcaatcagcgcggcgtagaccgtgcggccctggtggaaatcgtcggcctgctggaaaacctggccgagcgccgcgacctgttcaacttcgacgcattccccgcgccggtgccggggcagggcagtaccgcattccgctatcgcctgaatgacgacggcgacaccccgacgctgtacctcaactcgctgttgccgggcaaaagcacgatcccccacaaccatgaaacctgggcgatcatcagcgccattgaaggccaggaaatcaactacgtttacgcacgcaatgatcaaggccgcgagccgggtttcaccagcctgaccctggaaaaagaagtgatcgtgcagccgggtacgtcgatctcattcctcggtgaagacctgcatggcatcaaggtcgaaggcgagcaggcgaccttgcacttccacctctacggcttgccgctggaatcgctgaatagccgttacggcgtggaagccgacgggcgcatcctcaactacaacgcctcgcaaatggcgccgtcgattcgcgcgtactgatcgttcccacgctctgcgtgggaatgcttcctgtggcgctccgcgtcacgcctaacaccgggacgcagagcgtcccaagcggcattcccacgcagagcgtgggaatgatcagagggcgaggtttttatgattgacctgtattactggcctaccggcaacggcctgaaagtcggcatcctgctcgaagagctgggccttgaataccgcctgctgccggtgaacatccgcgaaggcgagcagaaggctgccagctttcagcgcatcagcgccaacgggcgaatcccggcgattgtcgaccatcgccgcgagacaccgctgagcctgttcgaatccggcgccatcctcaactacctggccgacagcgccgggcaattcctgccagcggccggcactgccgagcggcaaaacgtgcaggaatggctgttctggcaagtcgggcatatcaccccgtacctgagccaattgcaggtgttcaaggagaaagcgccggagccgatcccgttcgccctcgacctgctgaatgccgaagcgacgcgcctgtaccgcgtgctggagcagcgcctggctgaagtgccatttgtggccgctgaatactcggtggccgacatggcgatattcccgtggattcaaccgctgcgccaaggccaggacctggcggactacccgcacatccaggcctggcgcctgcgcatcaaagcgcggccggcggtgcagcgtgcctatgccaaaggtcgcgaagtcgcagcgggcgagcgttcgttggcgttgcagtaactcttttcttactttgttgggacttccatgagccagaccatcaccccacgtcaactgcagcaatggctgttcgacgggcaggaaatcgccgtattcgacgtgcgcgaacacgggcaatacggcgaagcccacctgttccacggggtgaacctgccctatagccgcctggagctggaactacgccgcctggcgcctaacccgcaggtgcgcctggtgatttacgatcaggacggcggtgaggtggcgacccgcacggccgcgcgcctgcaggcgttgggctacagccaggtgcatgtattggcgggcggcgccgacggttggcaagcagccggtttgcaactgtttgccggtgtgcatgtaccgtccaaggcttttggcgagttggtcgaagaggccagccacacgccccacgtcactgcgcggcaattggccgagtggcaggcgcgtggcgagccgctggtggtactcgacgggcggccgttcgatgaataccgcaagatgaccattcccggttccatctgctgcccgaatggcgagttgggctaccgtgtgcatgacctggtgccggatgaaaccacgccgattgtggtcaattgcgcggggcgcacccgcagcattatcggcgcgcagacgctgataaaccttggcttgaaaaacccgatctatgccttggagaacggcacccaaggctggtacctggaagacttccagctggagcacggcagcacccgacgctaccacgagcaggtcagcacggacctggctcaacagcgccaggccgcgcggcaattggccgagcgcgcaggcgtggtgagtgtctcggcggagcaggttcggcagtgggcgagtgacgcgcagcgcagcctgttcctgtgcgacgtgcgcaccgccgaagagtttgccgtgggtagtttgccgggctcgcaacacacgccgggcgggcagttgatccagtccaccgacctgtacatcggcgtgcgtcaggcgcgggtggtgctggtggacagcgacggcgtgcgtgcgccgattgtggccagttggctgcgccaattggggcatgaggcgtatgtgctggagggcggtatcgccagcggcctggcgttgccggtgttgcagccggtggcatacgagccgctgccgctgatcagtgcccaggcactggcgctggaattgaacgacgtcaacctgatcgatttgcgcccgagtatgctgtttcgcaaagggcatatcgccggttcgcagtggtcgattcgatcactgctgaaaaccgatcatcggccgttggtgctggtggcggatgatccggcgttggccgcctttgctgccgaaggcgtgtcggcaaggttgctggacggcggcttcgcggcctgggctgcagccggtctgccggttaacggaggcgcgcagaccttgcccgacgcgcagtgcatcgacttcctgttctttacccacgaccgccacagcggcaacaaagatgccgcgcgccagtatctggcctgggaaatcggcctgttggcgcaaatgagcgaagccgaaatcgccagcctcaagccactcacgccgccgtcacgcgtgcgcacgcggttgatccacgccgcgcgtactgaaaaaggccacggtggccgcgcagtgaatgtgccgatcacgcgcatgagcacggtgctgttcgataacctcgcacaaatgcgcgacgcccgcgcccgacgcgacagcgagcgcgtgttgacctacggtgcgcgcggcaatcccacctctcatgccttggaagacctggtcaccgagctggaaggcggctatcgcacgcggctttacggcaccggcctggcggcagcggcccaggtgttcctggcttacctgcgccccggcgatcatgtgctgatcaccgacgcggtgtattcgccggtgcgcacgctggcgcgtgaatttctgcagccgttcggcatagacgtcagctacttctcgcccgatgcgacgggtttggaggcgcaactgcaagccaacaccaaactggtctacgccgaagtgcctggctcgctgctgtatgaactgtgcgatctgcctgcgattgcggcgttgtgcaaaccacgcaacatcttgctggccgtcgacaacacctggggctcgggctacctgtaccggccactggcattgggcgcggacatctcgatcatggccctgaccaaatacctcggcggccacagcgacgtgatgatgggcagcgtgtgcaccaccgcagcggcctggccggcgttgggcaaaatgagcgacaccttcggcaactcggtcagcgccgacgatgcctacctgattctgcgtggcgcacgcaccttggcgtcacgcctggatgtgcacgagcgccaggcgctcgagatcgcgttgtggctacaggcgcaaccgcaggtgaagcgcgtgttccacccggcgttgcctgggcatccggggcatgcgctgtggcgtcgggatttcaccggcagcaatggcttgttgtcgtttgaactggcgaatgccaatgcggcttaccttgggcgctttatcgatgctttgcagctgtttggcttgggcgcgtcgtggggcggctatgaaagcctggtcaccgtcgccgacacccaggaccgcgagcgcgcggcggatcgggcgttgaattcggtggtgcgcttgcatatcggcttggaagatgtggcggcgctgatcgaggatctgcagcgcgggtttgccctggcgggctgagtgaagatcgctcccacgcaaagtgggagcgatccaccggtcagtgtttgaccggcgtcggcagggtcacgaggttgacgtagccgtcccagaatttcttctgatccacgccaaacaccactttggctttctgtgtgccaaccggtgcgcctttcttgtagcccagtgcgcggccatagtcggcgccgaaggtggcgtccacgtccacccacaaatcgcgcgattcggtgacgatctccgggctgaccaggaacagcgccggcaggctgtcccaggtgaagctgtggtagctcgggtctttgtcgaacagcggcccgaactcatgcttgtacaagtcggcaatcgcgcctttctgtgcaatcacgcgctggtataccgacttgtcgaaggtgactttctcgcacacatcgttcgggaaaatcacgtgctcgatgggtgagcgcaacacgatcttcgccgcctccgggtcgaaccaccagttgaattccgccgccggcgtggtgttgcccggaatctccagggcaccgcccatgtacacgatgcgcttgatcagcggcacgatgtccggcgccgagcgaatcgccagggcgatgttggtcagcgggccgaccgccagaatcgtcacttggtgcgggttggcgcgtacgctttgcacgatgaactgcgcggcggtctcactgcgcagttgggtgtgggtggccaggccgtccggtggcgcgaccaattgcgcgggcgaagtaggccgcgggtttttgaacgcgcccggccagcccgagccgaacagggctttttccgcctcataggtggcgtagtcatgcagcagcgggtaggcggcgcctgagtaaacgccgacctctttttccacgcccatgcgttccacggccttgagggcgtcgacctgttcctggtcgacccaggcgttgccactgaccagggtcatgccgagcaagtcgatgcgtttttgcgcatgcaactgggcgagcatgataaaggcctggccgtcatcgttgagcacattgaagtcggtgtcgaagatgactttttccgcagcgttcgcggtgccggcacacaggccgacggcgacaagcagcgcacaacttttaaagaagccttgcatggtggttcatccgaaaaaattgttgttgttaacggttcaccagtttcgccggcaaggcgatgaccaggaagctgctgaggatcaggcagccggcgaaaaaccacaaggcgcccgcgctgctgccggtgacgtcaatcgccacgcccatcaacgagttgctgaccaggccggcgatattcgccactgagcatgccagggcaaagccggtggcggctgcggtgcctttgagaaaggtcgccggcaggctgaaaaacaccggaacggcgccgatgatcgcggccgaggcgatggcgaacagggccacggtggccgccacgttatgggtgaagaaggtgctggtggccatcgccgccgcgccgatgaaaaacggcacgatgatgtgccagcggcgttcacggtgtttgtccgaactggcgccgatcagcagcatgcccagcagggcggcgacgctgggcaatgccgtcagcacgccgatatggaaggtgtcggtcaccccggcgttgcggatgaacgtcggcatccagaaccccatggcgtaggcgctgagcaggatcgagaagtcgataccgccgagcatccacactttgaggttgaagaagccgtcacggaagctgtgcttgctgccggtggcgtcggcttcatccttgcgcagctcactttcgagcagggcttttccgtcctgcgacagccatttggcttgctggaaggtgttgggcagtgcccagaacgtcagcacgccgagcaacacgctgggcaccgcttcgatcaggaacagccactgccagccgcgcaggccgcccacggtgtcgaaatggcccatgatccagccggacaacgggccgccgatcacgctggacagcggcaggccgatcatgaacagcgcgatgatgcgcccgcgtcggtgggtggggaaccaggtggtcaggtaatacaacacacccggcaaaaaaccggcttcggcggcgccgagcagaaagcgcaggatgtagaactgcgtggttgaggtgacgagcatggtgcaggccgagagcaggccccaggtgatcatgatgcgcgcgatccagatttttgcgccgacccgctccagtaccaggttgctcggcacttcaaagaggatgtagccgacgaagaacaaaccggcgccgaggccgaacgcggtttcgctgaagtgcagctggtcgagcatctgcagtttggcgaagccgatgttgatgcggtccaggtaagcggccaggtagcagaaacacaggaacggaatcagcttccaggtgaccttgtggtagagcgtggtgacggggtcggcgacgctggtcgcgggtgctgcattcgcaatgggcattgggtgtctcctggcggtgacttatggtttttatacagccgctttgttccagcacttcggagtgctgtagaagcgacgtccaaaggcagtgtcagaagactgagatttcccctgctggatgagatcaagtgtgggagccgggcttatgtgggagctggcttgcctgcgatagcatcgacgcggtgtaacggttacaccgcagcgtctgcatcgcgggcaagcccggctcccacagggatcggcttctacagatgatcgcattccaaggctttacctcagttttttcaagaccgcgctctatggcgcagttcttaataacgtcttattgctccctgaacttgctcatcgcctcctgcttggtcaccacgtcgccatacttgctgtcgatatcgaacaagttggcttcatggggcgccgagtgtcgatcgccgacgcattcgcgcacgacgatggtgcgaaacccgtgttgcacagcatccaccgccgtcgcgcggatgcagccactggtggaacagccggccagcaccacggtgtcgatgccctgcgcgtgcagcatcggggccaggctgctgccgaaaaacgcactggcgtactgcttggtgatcaccacttcatcggcctggggcaacacctcggtgcagaacgccgcgagggggttgccttcgaccatgtccttcatcaccggggccttcttgacccagatgccgccgtcggcgaaatggccgggatggtagcggatattggtgtgcaccaccgcaatcccgtgttcacgcgcagtggccagcagctcgacgctttccgccacggccgtgaccacgcccggcgcaaacagtggcgcgccttcggtggtgtagccctgcatgaagtcgatcatcagcagcgcggcttttttgccaaagccgatgcggttgccccagacgccttggtagttggcgtcggcggattgttcgctcattcttcaattcctcattctctgtggcgagcgggttgttgtggcgagcgggcttgccccgcgttggggcgcgaagcggcccctcgtccagacattgggtttcgtcaggcaaaccgcatggcaggttttggggccgcttcgcagcccaacgcgggcaagcccgctcgccacagcaagcccgctcgccacgagtcaataagcgccggaaagcaaggcgccggcgccgggtacgatgggctccaggtccagggccttgagcatggcgtaagtggtggcgatggcggcggtgagcaccggtttgccggtttgcgcttctaccttggccaccaccggcagcgactgcatctgcacgcaggccgagagcacgatcacgtcgacaccttccaggttcatgccggcgacgatggccggcagcttggccgggtcgtggcgcgccacttcgaggttgtcggggatctccagggcgcgccagtccaccacctcaaagccttcttcacggatgtagttcaccaccagctcggtcagcggtttcatgtacggcgcgacgatggcgatgcgtttggcgcccatcactttcaagccttcgatgagtgcgccggcgctggtgatcaccggtgcgttcgcgtcgttatcggcggtggccttgcgcaggcgttgttcggaattgcggtgataacccagccccatggccatgatcgccaccaggcaggcgtaacccaacacatcgaccttggcgtcggacagctcgatggcgcaacggtcggactcgccgtccatggccgccagttcctctttgcgcacttgcttcatgcgcatgcggctggagtgaaaggtgaagcgctcggggcggattgcctggcgcgcggtgagcatcgccgggatctcggtttccatggtggtgttggagctcggcacgatctggccgatgcggtaaggcttgtgcatggtggtctccgttcttattgggtgaggaagtcgccgagggcgtggaagaagccgtcgaagtcgtcccacggaatcatgtggccggcattcggcacgcgggcgacctggatgcccggttgcaggtcatggatttcggccacgtcttcatcgaggatcacgccgccacgcccggccaccatcaacagggcaggggccttgaggtgcggcaggtcctggtggaaatccaccgtgtgaaagtcattgaaggcgcgcacgatggcgggctcataacaggtgtgcagccattcggcgcgcagttgcagttgctctggcgtccaggtggcgcagaaggcgcgcatcgcctccgcgtccatgccgatcagggattggcggatcgagttgacataccacggcagtttgctcgggtactcacggcggccggggccggacaccggcggatcgatcagcaccacgcggttgacgccctgcgggtgtttcaccgcactgcgcacggcaaaacgcgcgcccatggaatggccgaccaggtggtagctgtccaggttgagggcatcggcgaacgcgccaatatcatcgctgcaggtgtccgcgctgtagtccagctcggggccggtggacgacaagccgcgcccgcgcacatccagcacgtacgtgtcgaactgcgcgcccaggcgttccgccacaaagccccaggtgatcgccgggctggtgatgcccgggatcaaaatcagcgccgggcctttaccgccgtagcgcaagtaatgttggcgaatgccgttggcctgcacattgccgccgtagagaaaggtgctcacgcggcaacccccgatttcagctgttgggcatacaggtcgtagccatacacccagtccgggtcttcctgggtgcgcagccaggtattggcgttggacactgcctgcacgcgcgaggcgcgctccttgcggttggcttcgtagagttggaacgcggtgcggtagtcgctgatgccggtttcctgcaggcagcgggtcagcatcgcggcgtcttcgatggccatgccggcgccctgggccatgtgcggcttcatcgggtggcaggcgtcgcccagcagcaccaggcggccacggctccacagcggcaacgggttgcggttgcgcagcggccatttggtcacgctttcggtggactcgatcagcgcctgcacggtggggtgatagcccttgaaggcgtcaaacatctcttcgcggctgctgtcgacgaacgcgccctggaagtcccattcggcatggggcacgccggtcacgtagtagtactcgtcgcgcttgccggtggtgtaatacaccatcatgtggcggtcttcggtccaccatttgatgcagtcttcgaacttgaggtcgtacttggccaactggtcgccacggatcagcgcacggtgtgcgacccaaccgctatacagcggtttttccacgccgagcagttcttcgcgaatcttcgaattgatgccgtcggcgccgatcacgatatcggcgtaggtcacttcgccgtcggcaaaggtcatgcgcacttgggtgtcggtctcttctagggtttccaggcgcttgttgaagtgcagggtgccgggcttgagggtcgacatctgcaaggcgtgcaggtcgccgcggtgcacggtgatgtaggacgcgccgtagccggtaagcgggatgcgcgagaggtagtcgccggtttcgccgcaacggctgaaccagtgctcggggtgcgagcccatcaggtccagctgcttttcgatgcccatgcggcggaagattttcatgatgttggggcccatgtggatccccgcacccagccgggagaactccggtgcctgttcgtagatgtctacgtcaaaaccggcttgctgcaacagggtggccgcagcggcgccgcccaggccggcaccgacaatggcgattttttgcgtgcttcccatggggcgtgatcctctctctttttgatttcaggcggcgtctgtccgcaaggtttttaaagtgtatacgctcattttttgaaatgggaagcctgctttggaaaatttattttttggccgtatttatcctgtgtaacgctgagtagccaataaaagcggggattgtttcgataggtaacgaattggcgcgccgcttgcagtccgcctgcaattcaggtcttatcgttattaattggcgtatacgctataaaaatgcactagagtgaagcgcgatgcatgaacttggtgcagccccacaggagacaggaaaatgccggtaagcgattgcgaactgacccagatgtttgaacacgtgctgaagctgtcgaaggtcgacccgacccagagcgtcgccgtgctcaagagccattattccgacccgcgcaccgtgcgcgcggcgatggatgcggcgcagcgcctgggggccaaggtgtatgcggtggaattgccgtcgttcaaccatccgcgggcgatgggcaatgacatgaccgcctactgcggcgacaccgcgctgaccggcaatatcgccgcgcaacgtgcgctggaagcggccgacttgatcgtcgacacgatgatgctgctgcattcgccggaacaggagcagatcctcaagaccggcacgcgcatcctgctggccgtggagccgccggaagtgctggcgcgcatgctgcccactgaagaagacaaggtgcgcgtgctggccgccgaacagttactgaaaaaggcccgctcgatccacgtcaaatcccgcgccggcagtgattttcgcgcggcgttggggcagtacccgtcggtgaccgaatacggttttgccgatgagcctgggcgctgggaccactggcccagcggcttcctgttctcctggcccaatgaggaaaccgccgagggcgtgctggtgctggacattggcgacatcctgctgccgttcaagacctacacccgcgagaagatcaccctggagatcgagaagggctttatcaccaggatccacgggggctttgaagcggaatacctgcgcgactacatgaagtatttcaacgaccccgaggtgtatggcatctcccacatcggctggggcctgcagccccgtgcgcaatggacggccatgggcttgcatgacaagaacgacggcatgtgcatggacgcgcgtgcgttttatggcaacttcctgttctccaccggcccgaataccgaagtgggcgggacgcgcaagacgccgtgccatatggatattccgctgcgcaattgtgatgtgtatctggatgatgaagcggtggttatcgccggtgacgtagtcgccccggcagcctccctggcccgctgaaaatcccaatgtgggagctggcttgcctgcgatagcggtctatcagtcacatcccggctgcctgatccgccgctatcgcaggcaagccagctcccacattttgcttgtgttccggcagtgagaggcttgagtcgattcaccatccccgccatcatgccttcccaatctccacacccaccgagcccgccgtgcctgattcctacgttttctctgaacaagttggccacctgctgcgcaaggcctaccagcgccacttggcgatctttcagcaaaatgtcggcgactcccagctcaccgccgtgcagttcgtcaccctgtgtgcactgcgcgatcacggtgcaagttccctcaccgaactggtcaaggccaccgccgtcgatcaggcaactattcggggcatcgtcgagcggctcaaggccaaggaactgattaccctggagccggacccgcaagacaaacgcaaggtggtggtcgacctgtctgccacaggcgccgaactggtcgcgcaaaccgcaccgcgtgccgcgcagatcagcgaactgaccatgagcaacctcaacccggccgagcgcgtggcggtgttgtttctgctgcgcaagatgattgacgatccgcaggaatagctggttgccaaggcgtcttgttgtggcgagcgggcttgccccgcgttggggtgcgcagcgcccccaataaggccaccgcgttttttcaataagaacacagttgctggttttggggctgctgcgcaccccaacgcggggcaagcccgctcgccacgacaagctcgcaaccttctggcatcgtttttgctctgtgttgatgtagtagccacttcaccattcaagtgtgtcgcgaggccccaggtccgcgatgcttttttttgactgtttcgtgtagtagctgcttcaccaactgacacaggcgaagcgaatgatcagcccctccatcacggtagcccttgaggtcaacggccacacccgcgaagtcagcgccatggcggatacaccgctgttactggtgctgcgcaatgatttggcgctcaacggccccaagtacggctgcggcctgggcgagtgcggtgcgtgcaccgtgatcatcgatggcgtggccgcgcggtcctgtgtgttcccgctggcgggggcagttggccgtgagatcgtcacccttgaaggcctaggcacccgccaggcaccgcatccggtgcagcaggcgtttatcgatgagcaggcggcgcaatgcggttactgcctcaacggcatgatcatgaccgccaaggccttgctcgaccgcaaccccaaccccagcgaagccgagatccgcaatgagctctcgggcaacctttgccgctgcggcacccatatcgaaatcctgcgcgccgtgctgcgtgccgctcacctcctgaccgtggatggccaaccatgaccgacaccgcactttcccgcgaacaatggctggccaaggccggcgtcttgttgattgtcgatgacgtactgccgccgtccggtccggtggccaagggcggcacgccgaccgtgaagcccaaggagttggggctgtttatcgcggtcaacgatgacggcttggtctacgcgttcaacggccatgtggatttgggcaccggcattcgcaccgcgctggcgcagatcgttgccgaggaactggacctgagcatggatcaggtcaagatggtcctgggcgacaccgagcgcgcgccgaaccagggcgcgaccattgccagcgcgaccttgcagatttccgcgatcccgctgcgtaacgcggccgccgaggcgcggcgctttttgctcgcgcgggcggcagggcgctggggcgtaagcaccggcagcctcaaggtcgaggccggcattatccaggcggcagacggacgcaccaccacctacggcgagctggtcagcggccaacatgatcagctgcgcatcagcggcgacgcaccgttaaaagccatcgaggattaccgcctggtcggcaagggcgccgcgcgcgttgacatccccggcaaagccaccggtgagctgacctacgtgcacgacatgcgtgtgccgggcatgctccacggccgtgtggtgcgcccgccgtatgccggtttggactgcggggattttgtcggcaatagcctgttgaatgtggacgaggcttccatcgcgcatatcccggggattgtcgcggtggtggtgatccgcgattttgtcggcgtagtcgcgctgcgcgaagagcaggcgatcaaggccgcgcacgaactgcaggtgcagtggaaaccctggaacaacgccttgccggacatgagtgacgtcgagcaggcgatccgcgacaaccctcgcgtgcgccgcacggtgctggaccagggcgatgtcgacggcgcactggcggctgccgcccagcgcatgccgcgcagttacctgtggccgtatcaaatgcatggttcgattggcccgtcctgcggcgtggcggattactcgccagccggcagtcgtgtgtggtccggcagccagaacccgcacctgctgcgtgctgatcttgcatggctgctggagtgcgatgaaaccctgatcgacgtgatccgcatggaagccgccggctgttacgggcgcaattgcgccgatgacgtctgcgcggatgccttgctgttatcccgcgccgtgggcaagccggtgcgggtgcaactgacccgcgaacaggaacacctgtgggagcccaagggcaccgcgcagttgatggaggtggacggcggcctcaccgccgacggcagcatcgccgcctacgattttgaaaccagctacccgtccaacggcgcgccgaccctggcactgttgctcaccggtcgcgtcgagccggtggcggcgatgttcgagatgggcgaccgcacctcgatcccgccctacgatatcgacaacatgcgcgtgaccatcaacgacatggcgcccatcgtgcgcgcctcgtggatgcgcggcgtgtcggcgttgcccaacacctttgcacatgaatcctatatcgacgaattggccttcgcggcgggtgtcgacccggtggaataccgcctgcgctacctcaaggacgagcgcgccatcgacctggtgaaatccaccgccgaacgggcgaaatggtcaccgcgcacggcgccgatgcaaaccgctaacgaagatcatttgctgcgtgggcgcggctttgcctacgcgcgctacatccacagcaagttccctggcttcggcgcggcgtgggcggcctgggtggcggatgtggccatcgacaaacacaccggcgacgtgtcggtgacgcgggtggtgatcggccacgattcagggatgatgattaacccggccggcgtgcagcatcagattcacggcaatgtgatccagtccaccagccgcgtgctgaaggagcgtgtgacctttgaagagtccacggtggcgagcaaggagtggggcggttatccgatcctgacgttccccgaagtgccgcagatcgacgtgctgatgatgccgcgccaggaccagccgccgatgggcgccggtgagtcggcctcggtgccgagcgcggcggcgattgccaatgcgatctacgacgccaccggcattcgctttcgcgagttgccgatcaccccggagcgggtgttggcggcgctgaatgccggcacgctgggcgagccggccaagtcgccgcagaaacgcagaaagtggtggttcggcgcgctgttcgcaacgttgggcgccgtactggccacggcctggccgttccacaatgaaatcgcgccgattgcgccacccagcgccggcacctggtccaaggccaccctggaacgcgggcgtttgctggcggcggtgggcgactgcgcggtgtgccatacggcgccgggcggtgctgtgaatgccggtggattggccatggagacgccgttcggcacgctgtacagcagcaatatcaccccggatgtgcagaccggcatcggcgcctggtcgtacccggcgttcgagcgggcgatgcgcgacggtattggccgtgacgggcgcaatttgtacccggcgtttccctatacggcgtttcgcaatatcaacgaggcggacatgcaggcgctgtatgcctacctgatgtcgcaggcgccggtgagccaggcgccgacgccgaatgccatgcgcttcccgtttaatatccggccgttgatggcggggtggaatgcgctgaatttaaggcgcggtgaaatcacgccgcagcctgagcgcagtgagcagtggaatcgcggtaattatctggtcaatggcctggggcactgcgcggcctgccattcgccacgcaacctgatgggcgcggagaagggcggtaaagccttcctggccggcggcacggttgatggctgggaagcaccggcattgacgggtttgtccaaggcgccaacgccctggactgaagaccagttgttcacttatttgagcaccggctattccgacgcccatggcgtggcggcaggcccgatggggccggtggtgagtgaactggcgaagttgcccaaggcagatatccgtgcgatggcggtgtacctggcgtcgctcaccggcgaggcgacggctgaggcgcaaaccgtggcggcagcagcggtgcccaatccgaatggccgacgtgtgttcgaaggttcgtgcaaggcctgccacgccgatggcctggggccaaaactgtttggggtgagcccgtcattggcgaccaataccaatgtgcacagcgatcagccggataatttgatcaaggtgattttgcaaggcatcagcaacccggcgactcaggatctggggtatatgccggggttcaaggacagtttgtcgaatatgcaggtggcggatttggtcgcgtatttgcgcgggcaatttgcgccgaatgcgccgcagtggaaaggcttggagcagaaggtggcgcacttgcgggccaaccccggcactcattgatattccagaaccggtgaagatcaaatgtgggagctggcttgcctgcgatagcggtttgtcggtgtacatatccatttctgcggcaacggcttctattggttccgctcttacagcgggtcacttttgcaaggacgcaaaagtaaccaaaaggtcctcgccccaccactcggcacctcgcctaggctcggtgtgcccgaacgcaggcttgaatccgtgggccgccgcaatgggccatccttggcccagtgcggctaacccggcgtcctgccgggttacccacggattcaagcctgcgttcggccagcgtggttgacggggcgcctcagatcaaaagcaaaatcaaaagcagagcacggcggcctgaaagccgacctgagtggttgaatcaaaggcgaaaagcgagaagtggatttgcatacactgaaaaattgcttttctgtgggagctggcttgcctgcgatggcggtgtgtctgcaccgaaaatactacctgacacatcgccatcgcaggcaagccagctcccacagggatcagagccgttttctataatgagttaggggagacacccctcagcaccaaatcagtgataaaccccagccaatcctgctgctgccccttatccgccaggtcttcacccaaaaacgaactgagcgtatgccggttggagttatagaagtagcacagcgaagcgatcatcaagtacacgtgcttgaggtcgatgtcctggcgaaacacaccctgggcctggccggcttcaatgatcggcttcaacacacccaccgcttcgccagataaccggcgcatctcgccggactgttgcgcatgtttgccttggtgcaggttctcgatgctcaggatcgccacaaattccggatgcttgacgtagtaattccagataaacgcgaccaaatcctgcaacgcctgcacgggcgcctccaggttcagcttgagtttgctttcggctttgttgaactgctcgtagatgtgttccagcacgcagatgaacaggtgttccttgctgccgaaatagtaataaagcatgcggtcgttggagtcggcttccttggagatgctgtcgacgcgcccaccggaatagccgtcgcgggtgaacaccttgaccgccgcctgcaagatgcgcgcacgcgtctggtcggcctgttgagcccgaatgccggtcttcttgatcaccatttccacgcgccttgcagccagtctgggcgcgaaatatagcatgggcaatttctcggccgttctgtgaccgacaagttctgtaacaaaaacgccattgcgctgggggttggatccaagtcgggctattttggtgcgtcttaataactagagtagccatggatgaaataccaacctttcagccgtaccttaatcgcgaccgccttggtgttgacggtcagcggtgtacacgccgcgtcccaggccccggtggccggtgaaaacggcatggtagtcaccgcccagcatttggccactcatgtgggtgtggacgtgctcaaggccggtggtaacgcggtggatgcggccgtggccgtgggctacgcgctggccgtggtctacccggcagccggcaacctcggtggcggcggtttcatgaccgtgcagttggcggacgggcgcaagaccttcctcgatttccgcgaaaaagccccactggcggcgaccgccgacatgtacctggacaaagacggcaaggtcatcgacggcctcagcgccaagggccacctggcggtcggcgtgcccggtacggtgtccggcatggaaaccgcgctgagcaaatacggcaccctcaaacgtgcccaagtgattgccccggcgatcaagctggcggaaaacggcttcgaactggagcagggcgatatcgacctgctgcacaccgccaccggcgaattcgaaaaagacaaagacctgcgcgggatcttcctgcacaacggccaaccgctgcaggtcggccagaaactggtgcagaaagacctggccaagaccctcaaggaaatctccgccaagggcaccgacggcttctataaaggttgggtcgccaaggcactggtggattccagccaggccggcaagggcatcatcacccaggctgacctcgacaagtacaagacccgtgaactggcgcccatcgagtgcgactaccgtggctaccatgtggtctcggcaccaccgccaagctcgggcggcgtggtgatctgccagatcatgaacatccttgaaggctacccgatggccgacctcggctatcactcggcccaaggcctgcactaccagatcgaagcgatgcgccacgcctacgtggaccgtaacagctacctcggcgacccggacttcgtgaagaacccgattgcccacctgctggacaaggactacgccgccaagctgcgcgccgccatcgagccgcaaaaggccggtgattcccaggcgatcaaaccgggtgtgtcgccccatgaaggcaacaacaccacgcattactccatcgtcgacaagtggggcaacgcggtatcggtcacctacaccctcaacgactggttcggtgccggcgtgatggcgagcaagaccggggtgatcctcaacgatgaaatggacgacttcaccgtcaaggtcggcgtgccgaacatgtacggcctggtccagggcgaagccaacgccatcgcaccgggcaaggcgccgctgtcgtcgatgagcccgaccatcgtgaccaaggacggcaaggccgtaatggtcgtcggcacgccaggtggcagccggattatcaccgcgaccttgctgaccatcctgaatgtcatcgactacaagatgaacatccaggaagccgtcgacgcgccgcgtttccaccagcagtggatgccggaaaccaccaaccttgagaccttcgcggtcagccccgacacccagaaaatcctggaaagctggggccacaagtttgccggtccgcaggacgccaaccacctggccgcaatcctggtgggcgcaccgtctttgggcggcaagccggtgggcaacaaccgtttctacggggctaacgacccgcgtcgcaataccgggttgtcgctcggttactgaggcatgaggtggtgatgcaggtgcgccagggacagcgccaggctgtcatgggataactgggtggcggcgccttcggcgctgtccctggctgccggcatcacacgttcgaacatgtggttttcataggcctgcactgccgctgagcagccaggtgtctcaagcaggtgctgcgccagttcggcggcatcgagcatcgcagcattcaccccttcgccgccaaacggcgacatcaggtgcgcggcatccccaatcaacgtcaacccttggcggtggtgccagcgatggcccaccggcagggcgtggatgtgcctggccttgacggtggtgttggccgcgtcaaataacgcgaggatgtccgcgtgccagccttcgaattgagctttgagcgccgccaaactgaggtggtcgacggcccaatcggtcggcacgcggaagatcgcatacccacgcaggtgcgcattggcattgcgctgcacggtgatcgccttcgcgccgccttctacgtccagcttgccgcgcccgaccaatttggcgatgtgcgggtgctgacggtcgacatcatcaataccgaattcgataaacgtcagcccgctgtactgcggcaggtagggcgacagcagcgggcggactttggaccaggcgccatcggcaccgacgacaaggtcgaacgggccgtgagtgatgtcgccttgatgcagcgtccagcgggcattcccggcggggcgaatggcgtcgatgcccacgccccagtgcacgcagccttcgggcagcgcatcgagcagaatctggcgcagggcggttcggtcgacttccggccgatcaccggtttcggggttgggggcttcgaacagcaggcgcccgtgttgatccatcagccgagaaccttggtcttcatagcgggcgatttgctggaaggcctctttcaggccagcgtgctgcagcgccagcaggccggactcgacatgcaggtccagcgtgccgccctggggccgttccagtggcccgcgttcgcgttcgaacacgctgacggccagcccgtgacgctggaggattcgcgccaaggtcaagccgccggggccggcgccgacaatggcgatacgcaaagaggtgttcatcgaggttgtccttggcgatatgtataggagcctatatagttagtgcataggctcctatggaaagtcaacgacagcatgaatgaacacgtcatcgcacccaacccgatgcaacagatcggtcttgccaaccgcgggtttatccgactctacgagggccagctgcgcgcgctcggctttgctgtggcacaaataccggtcctggtcgcgctcaagcacagcgacggcttgccccaggccgagctggtgcgcatcgcccgcgtggagcaatcgagcatggcgcaactgctcgcgcgcatggagcgtgacgggatgatccagcgcacggtcgacccggcggataagcgcagccgcttgatcaccctcaccgacgccgtgcgcgaacgcatgcctgcggcttatgccgtgatggtgcagggcacggcgcaggcgttggaggggttcagcgccgaggaagaggcgacgttgctggcgttgctgctgcgggtgaatgccaatctggagcgcgccagcgaaacggcgttggcttgatcgtcagcacaggcgaatgatcgccaaggcttcggccttgcccagcggttgctgcatgcgctgcgacaggcgcgctatggcctgctgatgctcgcaggcaaccacggcttcgacctgctcgtcatggcagagcagcgcaatgaaagcgtggcgttgaaggtcgccttccacgtgcaggcgattccactgttgcgcacgcccgagcacttcaaaggttttgtcgaagtggtaggtccagaagaacggcacgtcggcgtatacctgggtatcgccgagcatattgcgcgcggccagcacggccagttgctgggccacgcgccagtgttcgatacgcgtgggctgctgttgccaggcaaacgtcacgttgtcgccggccgcccataggccaggcgccacgtgcagttggctgtccgcgttcagcgactggtcctcggccttgtcgacgccgtggacaaagccggtggcaggcttgacgccaacgcccatgatcaccagatccgccgccaggcgcttgccgtttttcagcagcacggtgctcacggcgccgtggccgtcgaggcgcacgggttcggtattgctgtggaagatcacaccgttgtcttcgtgcagttggcggatcgcggcaccgatgcgcttgcccaactgcgccgcgaggggcacctgatgacggctgaccacttgcaccaccaagccgcgctggcgcagggcggatgcggcttccaggccgataaaactgtcgccgatgatgaccgcgcacgcggctgatttggctgcttcgtcgatgcgcgcggcatcttcgcggctgcgcagcacaaacacgttactgaggacggcgccggggatgtccagcggctgcgcttcgccaccggtggcaatcagcgccgcgtcgtagtcgaagtggcggccgtcggcgagttcgatgcgtttggcgtgtgcgtccaggcgctgcacttcgccatggatgcgggtcggcatagcgtccagcaatggcggtgtatcggcgggcgccatttcaccggcgatcacgaatttgctcagggcggtgcggtcgtaggcgggcgcctgttccctgtcgatccacagcaagcgtccactgaagccgtgccgacgtaacgtggccacggcagcagtgcctgccgcgccggcgccgatcacagcaaaacagcgatcttcagcctgcgctgtcggggtcgacgtttgcatgggctcgtcgccgacactgaccacgccatcgtgaacctgcaccgggtactgcttgagcccgagcagtgccggcggctccaccaccgcgccgctgtccacggcaaacgccgctttgtgccacgggcaaataatccggccgttgcagatcacgcctttctccagcggcgcaccggcatgtgggcattgcgcctgaaaggcacgaacctggttgccgacacgcaccagcaagagcgcacgttctgccgtggtgacgcgaacacctcggttttccggcaagttgatcaggcgggcaacgatgcgcatgttcataggccaatctcctttagaagattgactggcgccgagggaaaggaactgcgttgacccgatggtcggtattactcgcccagcaattgggtgaccgctgcaaaggctttggcgcggcgctcctgccaattaccgcgaatcaccacggcgggctgttggtgctgttcgatccagtccaggctgccctggaaaaacgcccggcgatccgccagctcgggttggcaacgctggccgtcggcggtccactccacatcttccggcgacaacagcaggtgcaggtcgtaatgccgggccagcagttcgtcgtccagccacgccgggtagtcgccgaacagggtctggctccatagcttgttggtcagcaggtgagtgtcgaggacgagcaagtcgggctgctcggcgcgggcggcgtcttcccaggccaattggccacgggcgatcgccgggatatccgccaaggtggtgtcgcgctggtgatggtcgatgaaataccgcacgtattcgccgaccatcagcccgccgaagtgcgcgtgcagttcggccgccagccagcttttgccgctggactcggggccggccagtaccacgactttcatgcgtgcaacgccgggtcggcgcgccattcacgccagccttgcacggcgatcacggtgaacagggcgtagagcgcggcggtgaggtagaggcctttgtagaggaacagcccgacgaagatcacatccacggcgatccacagcggccagcactgcacgcgtttttgcgccatccacatttgcgccaccaggctgaagccggtgagggcggcgtcgagccacggttgggcggcgtcggtccagtgggccatggcggcgccgagcagcaggctgaacacggcgccgacgaacaggctggtcatgattgcaggccagccgaggctggtgacctgacggccttgcttgacggcaccggcgcgggtccattgccaccagccgtagagttgcagcgcggcgtagaccacttgcaggagcatgtcggagtagagttttacgtcgaagaatacccaggtgtagagcagcaccatgaccaggccgatgggccagcaccaggggttttgtttgaccgtcagccagacagcgatcacccccagggcggcggcgaacaattcaagcccggacatggcggttccttgggagagtgggagagggcggtgattgtaaccaaaggtcgggaatgttcaatcggtgatggggtgggttgttaggtggattgggtacatatccgttgctgcggtaacggcggcttggggttccgctcttacagcgggtcactttttgagggaccaaaaagtaaccaaaaagtcctcgccccaccactcggcacc

SEQ ID NO: 76 - DNA, 31969 bp, Pseudomonas poae FL10F
ttatggcaccttgggacgggggccgggtggggggtcgacggatcttgggagtgcaggcgcccgcacagggaatttggggcgggggagcttgcccccgctggacggggtagcagcccctttttggggcccgctccgccccccaacgggagcaagctccctcgccacacggacagggttcggccttaactgagcagtatcagggctcgccgcaaagggcagcgttggccctatagccaatgccagaacctgctccagaacccacgccccaaatcatccttgcaccccgcatattgcgccgcgtacatctgcgaacgtgcctgtaccttgctcgccaccggcggcagccaggctttggcggcgtaggtgcgctggcggtagccgccccagccttcgtggtagttcaggtactggccataggcgtcgtacttgtacacgccgttgatggtgtaggtcttgtccatgtaccagccgacgaagtcgatggcatcgtcaaaatccttacggttggcgccgctgcggccggtgcttttgcggtagtcgttccacacttcatccttggcctgggcgtagccggcagccgtggagacgcggccccaggggatgatccacaacaggtatttgcgcggggccagggcgtcctgatggaaaccggattcctgatacatgatggcgaatggcacttggatcggcacgccccagcgcttttgcgtgactttggcggcatcgtaccaatcatctttttcgcgaaaaatgccgcacaggtcgttgggcgtgcgtggcggtgaggtgccgcacgctgccagcagtgaagtgagtaataacagtccgacggctttgcctgcgctcaaagggcacctgtgcgtgatatgcgtaaaaggcgggtattttacgcattcattcaggcggatgggttattgggttcaccagataaccctgtgggagcgggcttgcccgcgaaggcggtctgtcagagacacagatgctgactggtccaccgtattcgcgggcaagcccgctcccacattggatcgagggtgttggttaaatcgcattcggcgtgatgactgctgttacttccagctccagcatcccgccgccgggcaacccggccacgcccacggccgagcgtgcatggcggccgtgttcgccgaacaggtggtgagtgacgaggaggaatggctgcattgcggcggcaccagcacgaactggcggtcgaccaccgaggtgctgcgcccgctgtcttcatccttgaaccgcaacaagccgtgctcgggcaccatcaacatgaactcgtcatgggcgtgtgccccggtctcgtaggcaccgttggaattgaagacgctgtagatatcacgcatcgccaaacacaacaggggaatggaatgctgacactagcctgttgggtgccagtgaaaagcggcgtccttgccgcacaaacggttaagccaaaggcacgcggcgcgtggtcagcgcagtgcgaccgacgaagaagctcaaggcggcgcccaacaacagcatggccaaggtgctccacgccgcgcgggagagctgtttggccgcgacttcaccggcttcacgggctttctgctcggcctgttgcttcagctcatcgaccttttgcatggcttgctgataagcctgggcatagttgtcgacgatttgcgtggcttcggccttgctcttgccggtacgggccgcaacgatattgaccagtgcgtctttatccgccgcattcaaagcaggctcacccgaggcttttacgcgctcgaaccactgcttgagttggtcgcccgcctgggctgggttggtggcggcatccgtcgccgtttgcttgccatcggcagcggcctggtcggttttctgctcaacgttggccgggtccagctcaggcttgccgctttgcttgagcaaggtgtcgagctggccttgcaggctgttccaatccaggtgaatgccctgctcgtccaactgctgtttgacgctgtcgctgatgcccggtgctgcggcggcgatgccgctaccggcagcagacaggcccttgccgacgacattgcccgccgtgcccacgacgctcgatgccagcgccgccagcagccaggtggtgaacagcgtggtcagcgtccaggtcagcacgccgtgcaggccgccgcgatccggcgcggtacgcccggccacgaaagcaccgacgccaatcgctaccagcgtcgacacaaacagccagatgccggcgcccgtgccgaagccgcgcaacgggttaccggcttccatcgggttgacggcactcgcgccgatggccgtgcccaacacactcagcaccaggtaggtcaccagggcaattgcactacccgccagcacagagctccaagacacgcgaaacggtgaacggttggtttcatagacagtggtcatgattaatcctttgagtgatttgaccgtctcagtctggcgagcatcgtggcggtcgtcctcattcaaatgcaccagtccatctggtgcattcgcaccccgcaccgggcaacttctctgcactatcctgaagcccgagtgtcgtacttcccatgcgcccatcccccggagaaaccatgacccaggacgttcttgccaaagaaaccaaccgccgccaattgcagcagatcatctccggattgtctgacggtgtgatcctggccgaggtcgaccagaccattctctgggccaacgaagccgcgctgaccatgcacggggtcagcgaggtcgaggaactcggcgccaataccgaggaatacgcccagcgcttcgccctgcgctaccgcaataaccaccctttagtgctcgacaactacccgctcagccgggtggcggccggtgaagagttcagcgacgtgatagtggaagtcacccccgccgccgacgagcagcgcagctgggttcaccgcttgcgcagcctggtgttgaccgacgcgcacggtgagccggagctgctggtgctgatcctcagcgatgccaccgagtgggccagcgccgagcagcgcttcgaaaaaaccttcaacgccaacccggcaccggcggtgatttgccgcctgagcgacctgcgctacatcaaggtcaatcagggcttcctggaaatgaccggctacaaccgcgaccaggttatcggccgctcggtgtatgagttggatgtgctggaacaggccgagcgcaaagacctggccatccagcgcctgggcgaaggcgcgaccatcccgcagatgcaggccgagctgcgcctgcccgaaggcggcagcaaactggtgatcgtcgccggccagccgttggacatgaacgaagaagactgcatgctgttttccttcaccgacctggagccacgccgcaaggcggaaactgccttgcgccagagtgaggagcgctttgccaagtccttccgcctcacaccggtgccgaccttgatgtgcagcgccgccaaccgccaggtggtggatgtcaatgaagcgttcatgaacattaccggctataccagcgaagagctgatcggcaaggccatcgaagacattcattttatcgacagcccccaggccggtgcgcagttgttcgccaccctggaaaaaatcggcaacctcgacggccaggacctcaagctgcgcaaaaaaggcaacgaggtgatcgactgcgtggtgtctgccgacaccgtgatcatcgaggacgtgccctgctacctgctggtgatgatgaacatcaccgagcgcaaacgctcggaactggaactggtggcagccattgaggaagtcatgcaggacgcctcctggttcagccagaccctgattgaaaaactcgccaacgccaagagcgtcaacagccccaacctgcccaacgtggcctttaccgacctcacggcccgtgagcgcgatgtgctgggcttgatctgcgaaggcctggccgacaaagaaatcgcctcgcgcctgaaactcgcgcccaacaccgtgcgtaaccatgtggctacggtgtactccaagctgggggtgcacagccgcagtgcagccatcgtttgggcgcgggagcgcgggttgttcgccggtgaactgcgcgtcaaaagcaagaaatagagtgcaaatgcactagtgcgaccagtgcaaattcgccttattcccggggggcgcggtgcttaaccttgaagagtgggcaaagggcctttggccccttgccgtaacgagttgatctcttgaaggaatgcacgatgaaaagcgaacaagtcaaaggcgccgtcgagaaggttgctggcaaggctcagggttttctcggcgacttgaccggtgatgagcaaatgcaagccgaaggcgttgcccgccaggccgccggccaactgcagcaaacctatggcgacgcgctggataccgtcagtgatttagctcgcaacaagccgctggcgaccgtggctgtcgtcgccggcgtcggcctgttggtgggcctgttgctgcgccgtcgttgagggggctaagtcgcatgtttaccctctcccaactgcgtaattgcatcgaagaaggcctgtcgccgctgacctgcgagttcaccctgtgccgggatgcgtccttgaccctcaaggtcttcgacgccgaaaccggccgggtcgacctggtggtcaccgggatcagcaccaatcggctgcagaccccgcaggaagtggaaaaaatggtcgaagaattgcgctacgaactgcaaagcaacactgttggcaaaaatgtcggcaagctcacgctggatgatttgcctttaacgacgaaccaatgaaatagaacaccccgcctccgacgataaacgccccaagcatgtaaaacatgaagggggccggcaggctggccaacaccagcccacacaacaccggccccagcgcagcccccaggttggacaggttctgcgccccgtaatacatgccgcgcaggtggtccggggcgatccggtcgataaacatgtactcggccggaaacacaataatctcccccacggtaaacaccgccatcgccagcacccaccacagcacgctggtggccagtgcaaagccgatcaccccgagcatgaacatgccaaggccagcgatcagccactggctcagatagcggtgcgagatacgccggccaatcacgtactgcaaggcaatcaccagcaccgcattggtggtgagcacggcgctgattaccgtgtaggtatattccgcggtggtggtcgtcaccaggtactgcgacaggtaggccgtgaactgcccgaacaccacggcactgagcaggccgccaaaggtgaagcacaccaggcgccggtcccgcagcagtacacggccgacggcgaaaaacgacaccggtttctgcgtggcatcagcggtggccagcgtgcggtcgccccagcgccaatacagcaggaaaaaccccacgcccagcagcgccgaaaggatgaacggcaggctgatgtcgagcttggccaccatcgcaccaaaaaacgggccgacggcataaccgatattggtcagggtgtacttgatggaaaacacttcgctgcgcgcgtcttccggcagcaagctggcgaaaccggctttgacggcaatgtcgatcacggcgtacgccaggttgatcaggatcaggcagccatagaacagccagataccgtgagccaccaccgtgccgataaaccccagtacaaacagcgcactcaagccgagcagcagccgataactgttgacgcgatcgaccagaaaaccgccgtacacactcagcagtgagccgacaatcaacgaactgccgatcaccaggcccacctgggtaatgtcgaggccgaagtgatgggtgaggtaaatgaccaggtacggaaaggtgatcgccttggccagcgtcaacagcaatgtggccaacagcaacaggttaacgctgcgcgggtagtgtcttattgtggcaagcatcctgctctcattcttggaaggtaacgcgacctgtgtggccggttaccttaccgcaagagccaggaaaaaagaccggtcatttcttgacgggggtgatctcgaggatggtgccgttggtggttttgagcagcacaaacttgtcccccacacgggcccactggctgtcttcttcgggctgcttcaaaccgcgctttttccagtcgctcacggcggattccttgcgcatcagcatgtccggggcgcggtcgccttctttcaaatcgcgtgcgttgatgctcgaaggcttcacggtttcttgcggggtatcaccggcctgcacgacaaagctggcggtggacaagccggcggtgagcagcaggcaggcggcgagggttttagacttcatgggtgctccttcaatgattggcgcgtacccaggttccgaccgcaggcgtgtgggatcattcagattcgataagggatataccgcgtgttggttattggatttatttcgaagcgttttaaaaaactgtcagatctgacagttgagcaggaaagacgcgtaatcgaccatggagattcactgttcttcaaagagagcaagatcatgaaaatgccgattcacacagtcaccgcgtgtgccgctacctgcctgatgctgtttgtgttcggagcacatgcggcggatgctcaatacacctgctaccccactgcgagcaaagggcctaaaatcaccgtgacggcgagctctttagctgatgccgaaaaacaagctagccctaaattgcaggggcgtaatatcacctgtataaaaaaataacgagatacgctgttaggttcagctaaatcgcccccttgctgcaacaaggcgaaagctggcgccgcttggcgccagctcagaaaacaacgaactgcaaaactcctctcatttcccgctgcaccgtagccccaaaagcctcaccgcacactccccgaaagaatgcgatgaccggattagggcagcttcgctgcccagcgggagcaagctccctcgccacaacgtgtcttgcctctacagccaggcagcatcccaaagtgggtagttaccgatgtgctctaccaagcccgctcgcagtggattggcaatgatatagcgcgcaatttttataaggtcttcttcagcgcgcgccgcacggtcatggtagccgctctgccaaaaagcaccttgcgtcccacaggctcgattgatggccagcgtgctgcgcgacttcacgcgcttcattacttcgggcagcgtggcgtctctgagttcgaaaagccaatggaaatggtccggcatgatgacccaagccagagagttgatcagatttaggtcatgagcttgtttcaattcatccaccagtaaccgccccacgcggaaattggtaaataccgaacggcgctcataaaccacagcggttaccagataagcacgccctgactccgaataacgaccgcgcctaagcaaatgagaattgggcttttgaagcaatcctttgcgtccttgaatgaatcaatgatccattcaacctagcaggcaaccacgataaccctgcccgatacagtttccccatgtgtcccccaatcccctgtggcgagggagcttgctcccgctgggctgcgcagcggccccaaaagcctcaccgcacactccctgaatgaatgcggtgaatgaattggggcagtttcgctgcccagcgggagcaagctccctcgccacaagggctctgcagcgcctgctctaacgaaaacagatgcgtttcaagttccatcagccttgccccatgatattaatcctttaattgctcatgaaatttctcgacataaatctcatgaaccaacaacaagaactcgacgccctcgccgtccttatccacgacctgcgtaaacacaagaagctgtgctggagggcaagttgacgccgtgggtagaaggtgtggccgacgcggtcaccctcggccttggcgacagcttccacctggccagctttgcccattgccgctacgccaacctgactgatctgcctgcacgcttaccgtgggtttacaaccaacagccccactcgtaaaaatcagtcttccacgttgctggccgaagtacgaaccttccatcagaaccaccccgaccgtgcgtaacgtcgacctgatcgacctggacaatctggggcacttctacggtggtgcttacccaggtcccgaatcattgagcgtgataccgagcactgtgcttgtgccattccagattaccggcaatccacgcggtcaggcctgtgaggtagcgattgagcaagggcggtgcatccgcccgcaatgcgcgctcggcaacctcatagtcgagcatgacagcgtcatgtatatcggcgatccgatcgattgcctcctggagcgaacattggtgttgatccgccagtaagtagggcaacttgaacctgccaatctcgtccatatgctctttgtaggcggagtacaagtcattgaccagcgtcgtcgccagtgaagccagcacagtcacgcggtggacctcaggctgggaatacatatttgccggaacctcgtaccctccaatcggatcgaccagcaccatgcaaggccagaaactattcacttgccgacttgccaggtactcggcaacagtcggcccggtgccatacacccgccaagccccttcagccgccatggtcacgaacatcgcaatactgacctggcgaacacgggcaacctgcgaagccgtgcaaaattgggtaactcgctgcatgtacgcctgcaagccaagcaacaccggatcgctgttcaattggtgcttcaattcggtatcaaatggcgtgggcagatagcacgggtccatggccgcaatcgcaaacgacaggcgaggagctacgtgtttgggatctgagcccaaagtgcggtcatcacaataatggtcatccactgcgaacaatgccgccaggcattgcgcctgcagcaataaacgatcgggatcatcggtatcggggtggcacaacatggcgtaacgcccgaaatcagaagcgcggatcttgtctgttttgccggggaagatgccaatgtggctgatccattccatcagccgatcattaacctctcgcccgagcggttcatccatgcgcaccggtgccgggcaacgtagcccgcgaaccacaaaaggcgcgatctccaggcccggtgtatcaaccggcaagtgggtcggtaactcgttcatagcaagacacctcggttcttactactgggcgttactgcgacccaactgcgtgaattgtgcgtttttttcaagcgtagtgactgatttccgcgcctgccatcggcgtttaatcacttattaacataaattaggtaccgcttagaaacaggccactattcactggggttgcgcaggcgagcattgctcaaatgaaattaatcctgtaatttttcatgaaatttatcgacataaatttcatgaaccagcaacaagaactcgacgccctcgccgtcctgatccacgacctgcgcaagcacaagaagctcaccctcgcccaactcgcgcaaaaaatcgagcgttcggtgggtttcctgtcacaggtcgagcgcggcctgtcgcgccccaccgtggccgacttgaccgccatcagccacgcccttgatgtgcccaccacctacttctacagcctgcccaaacccaaagcggtaagttgggtcacccgccccaacgagcggcgcacggtgtattacgccaatggcatcaccgacattctggtctcaccgagcatgaacggcgccttttcgatgctcgacagcctgctcgcgcccggcgccaacagcggcgagcaaaccatgagcgaccgcgccgaacaggccggttttgtgctggagggcgagttgacgctgtgggttgaaggtgaggccgacgcggtcaccctcggccctggcgacagcttccacctggccagttttgcccattgccgctacgccaacctgactgatctgcccgcccgcgtgctgtgggtttacaactaggagcaacacccgtgaaaaaccagtcttccacgttgctggccgaagtacggacctttcgccagaaccaccccgaggtgcgttacgtcgacctgatcgccctggacattccggggcatttctacggcaagcgctacccggtggacatgctggaaaaggtcgccgccggcagcccgttgaaactgccgcagaacgccgtattgctgggcgcacagggcgggctgttcaagattggcgattattgcttccacgacggcgacccggacgccaaccgccgcctggtgccgggcacgctaaagccggtgagctgggagtcgcagccgctggggcagatgctgatcacctcggacggcaccgaagcccccatcgagttcgaaccccgcgaagtgctggccaaggtgctggagcgcctgcacagcaagggcattcacccggtggtggcgttcgaattggagttctacctgttcgacaagaagctcgacaacggcttgccgcaattcgcccgcgacccgctcagcgacgacaccgatgaccagcccaacctgcatatcgaacggctgtcgcgcttcagcgaggtgctcgacgacatggcgcaaaccgccaaggaccagggcatcgacatcacggtgatcaccgccgagctcggccctggccagttcgaaatcaatttcggccatctggaagacggcctgcgcgccgccgactgggccgcgttgttctgccgcagcacgcgtggtgtggcgctcaagcacggttaccgcgccagcttcatggccaagccgtacctgcaattccccggcagcggcatgcacgtgcatgttagcctctacgacgcagcgggtaataatttgctggcggcgcaccaacagcaacccctgcgtcatgccgtggccggttgcctggagctgctgccgcattgcatgccaatcttctcgcccaaccacaacgccttccgccgcctgggtggcacggtcaacgcggcaacccgcgccagctggggttttgaggaccgcgacgcgtgcgtgcgcatccccgagtccgacccgcgcaacctgcgcatcgaacaccgcctggccagcgctgacgccaacccgtatctggtgctggcggcgatcctggctggacttgaacatggccttgaagccaggcaagaacccatcgcgcccttgaacgaagaccgcctcagcggcactgacttccccgtggaaatgctcgatgcggtacgcgccatgcaacatcaagcggtggtgcgcgataagctcggcgcagaatttgtcgacgtgtattgcgagaacaaacgccaggaccacctggcctttcaacaagagatcaacgcgcgggaataccgctggtttctctaaccccctggaaccaccgatgaccgagcaaagcgcgccagcgctcaaggaaattttcaacgctgaacgcctgcagcacatcgcctgcgagatgtcggcggtgtatccggcgttcgacgccaagggttttctcaagcacgccagtgccgggcttgcagagttgtcggtgatgcagcgcatggcgcgggtcagcgaaagcctgcacgcggtgatcgggctggattacgcgcaaaccctcaagctgctctacgccctggcaccgcgcctgaacagcgcgtttgtcagcctgttcctgccgcactacgtggcgagttacggccagggtgatttcaagcgttccatggccgcgctcaaatacttcaccacctttggatcggccgagttcgccatccgccactttctgttgcacgacttccaacgcaccttggccgtgatgcaggaatggtcactggatgccaacgaacacgtgcgccgcttggccagtgaatgctcgcgccctcgcctgccgtggtcgtttcgcctggccgaggtgcaggccaaccccgagttgtgcgcctcgatcctcgacaacctcaaggctgacagcagcctgtacgtgcgaaaatcggtggccaaccacctcaacgacatcaccaaggacgacccggactgggtgctcagcctgatcgaaggctggaacctggaaaacccgcacaccgcgtggatcgcccgccacgcgctgcgcagcctgatcaaacaaggcaatacccgcgcgttgacgctcatgggcgccggggccaaggccgaggtgatgattggtgagttgaacgttacacccgcggcgatcaacctcggtgagcgcatcaccctgtcgtttacgctgcaatccaccgccgccaccacgcaaaagctggtggtggactacgccatcgactacgtaaaaagcgccggccacagtgcgtccaaggtgttcaaactcaagacattcacgttgggcgcaggcgagcaccacagcattcgccgcgagcaacatatccgtgaactgactacccgcaagcactaccccggcaggcattcggtgcacgtgctggtcaacggcgagcggctcgccagcgcagagttcgacctgctaaaaccctgacatgaatcaaagaaaaggctctagcacgggcctttcagcccgataaattgtcgaacaatcctggattttgttgttgcgatccattatcatccggcgccttctcactgcccgttgggcagttgtttcaatgtgtcacccgaggcgccaatgtactgtttgcaccgcttttcgtttcaccgctctttgattgtcatcagcctggggctggttacccattctgttaacgccgccctgcaacccatggccgaagccccgctggccagcgacaccgagctgcattgccacttcaaccgcgacgccagcaccgactgcaccaccacccagcactacacgatcctcaaacccaacggccgcgaaatgctctcgcgcatcgacttcgactattccgaaggcgatatctttgaagtgatcagcgcgcaatccacccagcctggcgccaagccgatcgcactggacgcggcgcaaatcgacacgcgcaccgcacccaacccggaccaggggttcagccgcgacaagcagacttccctggcgtttccaaacctgcgcgtgggcacacaaattcgtttcaccgtgcgcgaacatcgcgcggccaaaccgctggtgacgcagtttcactacgccctgatgttcggccccagcgcgttccgtcgcgaccacgtcaaggcgcgctttaccgccgagcggccgatccagtggcgcagcgagctgttcgacgggttcacggtgacaccatcggccaatggcaagaccttggacgtggtgcaaaagaaaccgacttacctcaactacatcaatgaatcttccagtgccacgctgctgcgcgtcccgcgtctggaagtcggcagcgccgtggatcgccaggcgtatttcggcgatttcgcccagcgttacaaccagattctcggcgccaaactgcctgcgcaagccgccgccgctgtagtcgccgcgcgcagcttggcgccggccgaacaggtcgccgcgctgatgcagcacatcaacgaccactaccgctacctcggcgactggcgcgctacggagcgcggctatgtgccgttcaacctggaggaaatcgagcagcatggttatggcgactgcaaagacctggcgatcctgctgaccgccatgctcaaggccagcggcatcaaggctgaaaccgcctgggtcagccgtggcgatgtggcgtatgcgttgctgatccccggcaccaacgcgccgaaccatgcgattgtgcgcgccgaagtcgacggccaggtctggtggctcgacccgaccaacccggtcttcgcccccggccaaaccctgcccgacatccaggaccgctgggtgctggtcaacgatgcccagggccaagtgcgcgaagaacagatcccgctggaacgccccgaaaccaccctgcgcctcgacaaacaggtgcatttcgacaagcagggcaatggcgccacccaggccaccatcaccttcagccgcctgccgctgatgcaaatgagcgtggccgaccgccaacaaggctccactgccaccgaccagaacatctgcgccaacttcggcaacgaaatcagcgactgccagatcacccgccaacccacggcctttgtggtacacgacggctacaccgtcagcgcgagcatgaacgaccaacgtgcgctggaaaaactggcgagtgagtatgtctacaccgatgaatcgctcaaagggcgttgggacggcttcatcaactaccgtcgccaccaccaacaggccgatctttacctgggtaaccctgagacccacgattacagcttcacgctgacgggtgggcaaatggaaaaagccatccccggctgccaggtgcgctcgccgtggtatgacctggatctggaagggaaacgcaccgatgacgggctgcgctatcactatcgcctgagccagaagacacgcttgctgacccatgctgaagtcgccagtgacgcgtttggcaagatgattgacgaggcgcgggcgtgtgcggagcaggtgcatcaggtggtgaagctgtaaccgcactgtaaacgcaaatccaatgtgggagctggctcgtgtaggagctggcttctgtgggagctggcttgcctgcgatggcatcaactggttctgcctgattcaccgaggtgtctgcatcgcaggcaagccagctcccacatttttatccgattacttcagtgggattcgccgagcagcaaacgttgctcccttgcacacaactccaccacataatcccacaacacccgcagccgcaccgacttgtgcagctcccgccgcgagctgatccagtagctgcgttgaatcccctccgccggcagcagcgccaccaagtccgggtcacccgccgccataaagcacggcaacaccgcaatccccaaccccgagcgcgccgcctggtgctgggcgatcacgctggtgctgtggaacaccaccttggggttgcggcagaagctgctgaggaacttcagttcctggctgaacagcaggtcatcgacataatcgatccaggcatgcacggcgaggtcttcgcgtttttcgatcggtgggttgcggtccagataggcacggctggcgtagagcgccaggcggtagtcggtgagtttgcgcgtgacgagttggtcgacgctggggcgttcgaggtggatgctgatttccgcttcgcggttgagaatgctgacgaaacgcggcacggccaccagctccacttccagcccagggtaacggtcgaacaacccgcccatgcggctggcgaggaacatcacgcccaacccttcggccacaccgaggcgaatcttgcccaggggcgcggcgcaatgggtgagttcgtcctcggccagcagcgcgacgttttccatggcttcggcatgtttgagcagggcttcgccggagggcgtcagttcgtaaccctgggcgtgctgcacaaacagcgcggtgccgaggcttttctcaatggcctcgatgtgccgggccacggtggcgtgcgtggttttcaggcgctgcgcggcggtcagcaggcggccgctgcgttgcaactcgagaaaaaaccgcaggtcattccagtcgaacatgtcgcctccctcccttggatataagtattttctaatgcctgaccctgtccctgtggcaagcgagcctgttggggctagcgcgctttttgtggcgagcgagcttgctcgcgctggggtgcgtagcagccctaatagctacaccgcgttttatctggcccaacgcgtttacgttgatggggccgcttcgcgccccagcgcgagcaagctcgctcgccacagaggacggtactcacttcatgtttagagggtgctgtttaaaaacgcacagcagctgggtaaaaactaacatttttaagacgaaaactaacaactaggatggagccaataagaaaaacaagcgagacctcagatgcccattgcagctgctgaatacgattacgtggtagtaggcgccggccccgcaggctgcctgctggccaatcgactgtccgccaaccccgcccaccgcgtactgctgctcgaagccggtagtcgcgacaactatccctggatccacatccccgtcggctacctgttctgcatcggtaacccacgcaccgactggtgcttcaagaccgaagcccaggaaggcctgcaaggccgtgcgctgagttacccgcgtggcaaagtgctgggcggctgctcgtcgatcaacggcatgatctacatgcgcggccaggcccaggattacgacggctgggccgccgaaggcaacccgggctgggcctggaaagacgtgctgccactgttcaagcagagcgaaaaccacttcgccggcggctcggaatttcacagcgacggcggcgagtggcgcgtggaacaacagcgcctgcactggccgatcctggatgccttccgtgatgcggcggcgcaaagtggtatcgcgccgatcagcgacttcaacaccggcgacaacgaaggctgcggctacttccaggtcaaccagaaggccggggtgcgctggaacgcggccaaggcgtttctaaagccgattcgccagcgacccaatctgaccgtgctgaccgaagtcgaagtcgaccgcgtggtgctggaaaacggccgcgcctcggcagtggtcgggcgccagcatggccaacaggtgagctggaaggcacgcaaggagatcgtcctgtgcgccggctccgtgggctcgccgggcatcctgcaacgctcagggataggccctgccaacgtgctcaaaccgttgggaatcgatgtgctgcatgagctgcccggcgtgggcggcaacctgcaggatcacctgcaactgcgactgatctacaaactggaaaacgcacgcaccctgaaccagatcgccggcaccctgtggggcaaaatgggcatgggcctgcgctacctgtatgaccgcagcggcccgctgtcgatggcgcccagccagctcggcgcgtttgcccgctccggcccggaacagacctcggccaaccttgaataccatgtgcagccgctgtcactggagcgttttggcgagccgttgcacgcgttcccggcgtttactgcgtcggtgtgcgacctgcgtccgcaaagccgtggccgtatcgatattcgctcggccaacccggccgatgcaccgttgattcggcccaactacctcagccatccagaagacctgcgcgtggcggccaacgccatccgcctgacacgccgcatcgttgcggcgcccgccttgagccaattcaaaccggtggaatacctgccgggcgattcactgcaaaccgaagaacagctgcatgaagccgctgcacgtattggcacaaccatcttccatccggtgggcacttgccgcatgggtgatgaccagcatgccgtggttgacacccaactgcgtgtgcatggcgtgcccggcctgcgcatcgccgatgcttcggtgatgccacgcatcacatccggcaacacatgctcgcctacactgatgattgcggagaaagctgcgcagttgatcctttcgccgaacacaaggagcctcgccccgcagagagaaacggttcatgcaatctgaatagcggcgccgcacccggcgccgacagtggaacaacaataaataatcactgtgagggttacccgatgtcagaacatgctcaacccctgggctcggccgtcagcgcgagcaccggcagcgaatcaagaaaggtcatcttcgcctcgtcactggggacggtgttcgagtggtatgactttttcctctacggcgccctggcggcggtgatcagcaaacaattctttgccggggtcaacgacaccacggcgttcatctttgccttgatggcctttgcggccggctttgtcgtacgcccattcggcgcgctggtatttggccgcctgggcgacatgatcgggcgcaaatacacctttctcgtcaccatcatcctgatgggcgtggcaaccttctgtgtcgggctgttgccgacctacgcgagcatcggcattgctgcgccggtgatcctgatcgtgctacgcatgctgcaaggcctggcgttgggcggcgagtacggcggcgcagccacctacgtggccgagcacgcgccggccggcaaacgcggcttgcacaccagctggattcaatccaccgccaccctcggcctgctgttgtcattgctggtggtgctggcctgccgttacttcaccggcgaccagttcgaagtgtggggctggcgtattccgttcctgttttccatcgtgctgctgggtatttccacctggatccgcatgagcctgcatgagtcgcccgcgttcctgaaaatgaaagaggaaggcaaggccagcaagtcgccgatccgtgagtctttcggcaaatgggaaaacctcaaggtggtgctgattgcgctgttcagcattaacggcgggcaagcggtaaccttctacgcggcgcagttttatgtgctgttcttcctcacgcaattcctgaagatggacccggccctggccaacatgctgctgattatcagcgtggtcatcggcgcaccgttcttcattctgtttggctggctgtcggacaaagtcggccgcaaaccggtgctgatgctcggcttgctgctcgccacggcgctgtacttcccgatcttcaagggcctggcgcactacaccaacccggcgatggaccaggccagtcaacaggcgccgatcacggtgttggccgacccgaccacctgcaccttccagttcgacccggtgggcaaggcaaaatttgacagcccgtgcgacaaggtcaagaccttcctggtcaagcaaggcctgccctacagcagcagcgccgcgccagcaggcagcccggtgcaagtgagcgtaggcgatgtgcgtatcgacggtttcgacgaagcggccctgcgcggcgcggtgacattggccggctacccgacttcggcggacgtggcgcaggtcaacaaggtcatggtggtggtgctgattgtggtgctgatcctgatcgccgccatgtgctacggcccgttggcggcgttgatggtggaactgttcccgacgcgaatccgctacacctcaatgtcgctgccctaccacatcggtaacggctggtttggcgggttcctgccgacggtatcgtttgccttggtggtgtacaccggcgatatcttctatggcctgtggtatccggtggtggtgactggggtgagcctgattgtcgggttgttctgcctcaaagaaacgcggaatgtggatatcaataacaactgatctgctgctgggagggggttgcttgcctcctcccacaattggttttgtttcagtcacacaaattgctgtacatccatacagataatggttgctcaaatcctcctgactaagcatcctgcaaggcatcaacccgatctgatgtgatgaccatgcggctgtacctctgtgaaaaaccctcccaggccaaagatatcgcggctgtgctcggcgccagccggcgcggtgacggttgctgggtgggtaatggggtcacagtcacctggtgcatcggccatttgctggaaaccgccccgcccgatgcctacgacgccaagtacaagcgctgggtgctggccgacctgccgatcgttccggaaaaatggaagatgctggtcaagcccaagaccgccagccagtacaaagccgtaaagcgtttgctgggagaagcccaggatctggtgatcgccaccgacgccgaccgtgaaggcgagatgattgcccgtgaactggtggagcattgccgctatcgcgggccgatccaacgcttgtggctgtcggcgctggatgacgcctcgattcgcaaggcactggcggcgctcaaaccgggcgccgaaaccttcagcctgtatcactcggccctgggtcgctcgcgcgccgactggctgatcggcatgaacatgagccgtttgtttaccttgctcgggcgccaatccggctatcaaggcgtgttgccggtgggccgggtgcaaacacccaccctgcgcctggtagtggaccgcgaccgcagcatcgccgattttgtgccggtggcttactgggccattgacgtggacctgcgccacgaacacatgaccttcaccgctcaatggcgcgccatggacgatgcgtgtgacgaccaggggcgctgccttaacccgcagctggctcgcgacgctgccgatgcgatgcgcaatgccgccagcgctaggctggtgaagctgcgcaccgaacgcatgcgcgaggtggcgcccctgcccttcgacctcggcaccctgcaggaaatctgctccaagaagctcggcctcggcgcccaggaaactctggatatcgcccaatctctctacgaaactcacaaagtcatcacctacccgcgcagcgattgcggctacttgcccttaagccagcacggtgacgcgccgaaaatcctcgccgcgctgggccgcgcggatgcggcagtcaatgagttgatggcgcatatcgacccccaacgacgctcgcgggcgtggaacgacgccaaggtcagcgcgcaccacggcatcatccccactggcgcgggcaaggatgtggggcaactcagcggcaaacatcgcgcggtctacacactgattcgcgcgcgttacctggcgcagttcctgcccaaccatgaatacgatcgcacccaggcggatttcgactgtgccggccaagccttgcgcgccgtagggaaggttgtgattgagcccggctggaaacgcgccttgcccgaagcgctggcccctgccaaaggccgggaggcccctgcgccgcaagccttgccgacgctggtgcagggccaggattacgcggtggccaaggtcaacctcaaggacctgtggacccaaccgcccaagccgttcaccgaaggcgacctgatcaaggcgatgaaaaacgtcgccaaactggtggaagacccgctgctcaagcaaaagctcaaggacaccaccggcatcggcaccgaagccacccgcgccgggattatccaggggctgctggaccgtggttacctggtcaagaatggcaaggccctctcggccactcccgccgcgttcagcctgatcgacgcagtgccgcgagcgattgccgacccgggcaccacggcgatctgggagcaggcgctcgacatggtgcaaagcggtgaaatgagccttgaggaattcgtcgccaagcaggcggcgtggatgagcaagcaagtggcacgctgcaatggcatgcgcatgaccatcactggtccggccagcccggcgggccgaggtgccactccgtggaaaaagaagcgcaagacggcgccacgcaagacaaccgccagcaccaagcgggtaaaaaagccgacaaacgctgggtaaacgtcgaaaaaatccggcaaatgacgtttttcgacgggtttaacgccgctttggaccttgctccggcgtaggccgtctaggattctgtagggacccgctgacttcctaacaacaacaccggagtggccgccatgaaaaccgtcgcacaagtgctcaaagccaaggaccagaaaaaccaggacgtccacaccatcaagtcgcaccagaccgtgatggaggcactgattcagatggcagccaaaaacgtcggggccttgccggtcgtggacgaaggcaaagtggtgggcgtgatcagcgaacgggactacgcacgcaagctgatcctcaagggccgctcttccgcgaccaccgccgtcagtgaaatcatgagttcgccggtcatcactgtcgacaagcaccagagtgtcgaaaaatgcatgaacatcatgacggacggtcacctgcgccacctgcccgtggttgaagatggccaattgattggcctgctgtccatcggtgacttggtgaaagaagccattgccgagcaagctgacctgatcaaacaactggagcagtacatccgcggcgaataggggaacccatgcagggcacgctggaacatcaagaggaccacctcgacaccctgtaccgggcgatggctgaaaggcgcttcgtggtgctgaccggtgcgggcatcagtacgtcgtcgggcatcccggattatcgcgacagcgaaggcgtgcgccggggcaaggcgccgatgatgtaccaggaattcctggccaccccacaagcacggcgccgttactgggcacgggcgatgctgggttggccacgggtgcgcattgctcagccgaacaaggcccacctggcgctggcgacgctgcaacaacgcgaacgcatcagcgggctgatcacgcaaaacgtcgacacgctgcatgaccaggccggcagccaggatgtgatcgaactgcatggcagcctgcaccgcgtgctgtgcctcgattgcctgcagcgcagcgagcgcgatgtgatccagcgggtgatgcaagatcagaacccttacctggccggcgtcgatgccgtgcaagcgcccgatggcgatacgctgctcgatccagcttttgaagaacgcttccaagtcccccactgcccgcactgcaacggccagcgactgaaacccgacgtggtgttttttggtgaaaacgtcgccccgcaaaccgctgccagggcaatggctgcggtgcagcaggctgagggtttgctggtagtgggctcatcgctgatggcttattcggcgtttcgcctgtgcaaggcgatggtggagcaaggcaagccggtgattgccattaacctgggcaagacacgcggggatgaactgttgcaggtgaagatcgaggcgtcttgcgagcggttgttgcccttgctggtcgagcgactgggatagcgacacacctccaatcaacctgtaggaactggcttgtgtgggagcgggcttgctcgcgaaagcggtgtgtcagccaaacatattccagctgacataccgtattcgcaggcaagccagctcccacaggtttcccgtctgaattgaagatcgtgccccttcgaccaaccgcacaaaaaatgacgcccaagtcacgtttttccgcattcccccgtccccgcaacgatttatgtagtgatcaaaaaaaatcactacataaccgttgacgtaacctttttacccttgcattatcgagacgtctcccggatcgggagtgttggtaacacgtgttttgaacaagctcgtctgaccgccgagctgttttttccggatgtgcactgcccacaaggcagattgatgaagctgaccggcccgcaaggatcggtacaaggagctcaatcgctgcttgtcttcgttatgaaaccattgcgtagcagttcatcagcaagactacatgcatcaggttcaagaccctgcccgtattcggcagacagtcactgacgcccggttttccaagccggagacaactaagcagttttaacggaatcaactgatagatcgccaactggtcaaggggcttacattatgaatctgaacaaccaacccactatcgatgaattggctgagatgtttgcagcgcagaaagacacactcgacgaccatatcctgtgggtcgaaaaatcgggccaagttcatatcgactgcgtggcgccccacacccttgaagaagagttcgataaaaacaaccgccaactggcagcgcgcctgaaaatgtaccgccgcggccagggttatgtcggcaagaaggccgccgctgacgagaactttatcgagcaagttttcgacacacttaacaatgcctgggcgtctttcaaagacagctcgcaagttaaagtagtcgatcgctactactaagtaaaacttgccctctgtgggagttggcttgcctgcgataacggtttaactgccaacacttttgttgaatgttaactggctatcgccggcaagccggctcccacatttatttggggcacgctcagaaagctggaaagcggcctttcgcggcctcatcgcgaaaaatatcaaacaacacctgcgctgccgccgacagttcgtgcccaggcttagtcagcacgccaatcggccgctcgatcaccggattgctcaaggtgatgcaatgggcgcccgcctcttccatctgctgcgcgcacaacgcgggcacagcgctgacacccaggccattggcaaccatcttgcccaccgtcgccaattgatgactttccagcgccaccggcaacttcatctgcaaggcgcccaagtgttcctccagcatcaccctcactgtggaaggccgctgcagggtaatgaatggctgttccagcaaggtttgccagtcgatttcgctgcactgggctaatggtgaatcaccgggcaccactgcaataaagcggtccaggtacaacggggtgaatgacagcgacgacccatcggacggctcgaaggccacgcccaactccacttggcggtcgcgaaccatctccagcacctgctcgttgatcaggtcgtgcaccgtcacattcacctgcgggtaacgcgcgcggaatatcttcaggatcggcggcagcagattgcctgcaaacgacggcatcgcggccaccgtgacccggccccgctgcaaggtgaagcgctggcgcagctcatcctcggcattgtcccaatcggcaatcagacgacgcgccagcggcaacaacgactcaccctcaggcgtcagcgcgacattgcgcgtgttgcggctgaacaagcggccacccaggccctcctccaggcccttaatggtcaggctcaacgccgactgggaaaggtgcaggcgctcgcaagcagcggcgaagctcaggctttgggccacggcgagaaaggcacgcatctgtttaacggtcatgaggctgctccgggcggcgggtcgactatgctgttttctaaatcaatcaaccttaaaaaacaacttaacaaatcaatccatcggcgcaacactccagtctgctggcccacatacaataaaagaggtgcatatggcaggtttcgataaacgcgtggcgtcctatgaagaagcgctggcaggcctggaagacggcatgaccgtgctctccggtggctttggcttgtgcggcattccggaaaacctcatcgccgagatcaagcgcaaaggcacccgcgacctgaccgtggtttccaacaattgcggcgtcgacggtttcggcctgggcgtgttgctggaagaaaaacagatcagcaaagtcatcgcgtcctacgtgggtgaaaacgctctgttcgagaagcaactgctcagcggcgaaatcgaagtggtgctgactccccaaggcaccctggcagaaaaaatgcgtgcaggcggcgccggcatcccggctttcttcaccgccaccggcgtcggcacgcccgtcgcagaaggcaaggaaacccgtgagttcaacggtcgcccgtacctgatggaagagtccatcaccggcgacttcgccatcgtcaaaggctggaaagccgaccacttcggcaacgtcatctatcgccacaccgcccagaacttcaacccactggccgccaccgccggcaagatcaccgtggtcgaagttgaggaaatcgtcgaaccgggcgagctggacccggcgcagatccacaccccaggcatctacgtcgaccggatcatctgcggcaccttcgagaagcgcatcgaacagcgcactgtccgcaaataatccgccagctcaaataataaggagacaaaacatggctcttactcgcgaacaaatggctcaacgcgtcgcccgcgaaatgcaggacggtttctatgtgaacctcggcatcggcattccaaccctggtggccaactacatccccgaaggcatggaagtgatgctgcaatcggaaaacggcctgctcggcatgggtccgtttcctaccgaagacaccattgatgccgacatgatcaacgctggcaagcaaaccgtgacggctcgcatcggcgcttcgatcttctcctccgccgagtccttcgcgatgatccgcggcggccacgtcgacctcaccgtgctcggcgcgtttgaggtggacgtacacggcaacatcgcgtcgtggatgatccccggcaaattggtcaagggcatgggcggcgccatggacctggtggccggtgcggaaaacatcatcgtgatcatgacccacgcgtccaaggacggtgagtccaagttgctcagccaatgcagcctgccgctgaccggtgccaagtgcatcaagcgcgtattgacggacctggcttaccttgaaatcgaaaatggcgcttttgtcctcaaggaacgcgcacctggcgtcagcgttgaagagattgtgagcaagaccgccggtaaactgatcgtcccggaccacgttccagaaatgcacttccagtgaggacagattccatgcaagacgtcgtgattgttgctgccacccgcaccgccgtgggcagctttcaaggttcgctggccagtatcccggcaccggaactgggcgccgccgtgatccgtcgcctgctggagcagaccggcctggacccggcgcaagtggacgaagtgatcctgggccaggtcctcaccgccggcagtggtcagaaccctgcgcgccaggcgtcgatcctcgccgggctgccccacgcagtaccagcgttgaccctgaacaaggtctgcggctcgggcctcaaggccctgcacctgggcgcccaggcgattcgttgcggcgacgccgaggtcatcattgccggcggcatggagaacatgagcctggcgccgtacgtattgcctgctgcgcgcaccggtttgcgcatgggccacgccaagatgatcgacagcatgatcaccgacggtctgtgggatgcgttcaacgactatcacatgggcatcaccgccgagaacctggtggacaagtacggcatcagccgtgaagcccaggacgcgttcgccgccgcttcccagcagaaagccgctgccgcgattgaagcgggtcggtttgtcgatgaaatcacgccgatcctgatcccccagcgcaaaggcgagccggtggccttcgccgtggacgaacagccgcgcgccggcaccaccgccgagtccctggccaagctcaagcccgcgttcaaaaaagacggcagcgtcaccgccggcaacgcctccagcctcaacgacggcgctgctgcagtgctgctgatgagcgccgacaaggccaaggccctcggcctgccggttctggcgcgtatcgccagctacgcaaatgccggcgtcgatccagccatcatgggcatcggcccggtatcggccacccgccgctgcctggacaaggccggctggagcctgggcgacctggacctgatcgaagccaacgaagccttcgctgcgcaatcgttggcggtaggcaaagaactggaatgggacgccgacaaagtcaacgtcaatggcggcgccatcgccatcggccacccgattggcgcgtcaggctgccgtgtactggtgaccctgctgcatgaaatgatcaaacgcgatgccaagaaaggcctggcgacactgtgcatcggtggcggccagggcgttgccctcgcactcgaacgcagctgattcaaagagcaacatgagaaagggcccgttgtggcgagggagcttgctcccgttgggctgcgctgcggccccatcaataagagcaacatgagaaaaggcccggttccacgaaaaatcgggccttttctttttacgcagtcttcctgaaaaaaacacgacacaactgtgggagctggcttgcctgcgatagcggttcaccccttggcaaatttaccgcctgacacaccgctatcgcaggcaagccagctcccacaatgaccggcactgtcaattcgccagcgccaccaccttctcgcccacctgcaagctcaccgtggcaaccccttcgggcacggcgtgagcgatcatggcgagttcttccttggcgtgaggcttgaggtgtacgccagccctcgggtggcagccatcatcatcagccgcgcaaatcccatgggatgctttgcgtaaatccgccagaaacgcgatgcttacagcagcgaagatcaactgtgggcttgcccgctcgccacaatgatcagcgcttcatgcagcgctgataacgatcatccacgcgcttggcaaaccacgccgtggtcaggttgcgggtgatcttcgggctcttgagtacgatgcccggcaaaatcgcccgtggcatcggcttgcccgccgctttatcagccagggcaaacacgcggttgtagagggtggtttgctcaaaatcgagttgctcacccttctccaactggctgcggatgctggggttgcgcatgtccaacttcgcgcccaaggaacgcaccgccaactcagtggtgcccggcagcaatgaaccatagcggatcaagtccccgtccaacgccagctcagtgccggtgacacggctgacagccgcctgaaacgccgcgttgcggctggcgtaccagcccgcattgaagtcggcaaagcgatacagcggctggtcataactcgccgggtagcccagcaagtgggcaataccgaaatacataccgccgcgccgcgtgaagacttcccggcgaatcgtgccatccaccatgtagggataaccccgcgcctgtttctgcgcaaagtcgatgctcacttgcatggggcctgcggtatgcaccgggttgaagccgccaaacaacgtattgcccaacggcaccacgctgatgaaatcgtcaaagatgccactcaggtccttctccgtgcgcgcagcactcaagcgctcggcataagtcttgccggtcggcgagcgcaattgcagcgcgctgcgcaccacaaaggctggcacatggactttacccgcgcgccgcaggatttcatcctgggcgatcttgcccatgtttggcaccggtgggtcgacttgataggtggactcttgctcggtcaccgcaagaaccgcgcagatattttcggtgctggggtaaatcttctgggtgtcgaaggccgtgtagatgtcctgagcccagcctttacggtccggcaccgtcgccggcagcagccgcacaatctgcgctttcacctccgcctcgctgcgctccggctgttgcgggctgcgtgaggtggaacaaccggccagcaccagcaacgtggtgaggcacaggatcagacggcttgaatacatggggcttccttggataacgacgggccgggcattgcgcatatcgacaggtaagtctaaccggggttcggcgacctgcagcactcaccagccgcatacttacgtgacaggatctgtcatcgaccatttgccgggctgggcttaaaactggcgtttgcgcagcgctgacaaagactgctgaaacatctcacgccacacccggataagctctacagatatcgcctgaaaacctctgcaaagtccttcgcctgatcacacagtgcgagggattgcagatggtttttttcggtaaagctccgctttttggggctgtcttttgatcgccgccaccagccaaaccattggccttctggtgctggccgccatggattccaagacgcgcgacgtcgaatccgttctcagcgacttccggcaatgtctcaacacctacgacgcctgggcggaaagcttcttcagcttttcggcactggatgtcgagcaggtcttcaaggtcggggatgaggtggcgctggtcgcgccgatcgatcgttccctctttcccagctcgaccgtggctgcgtgcaagcaagacggcaccctgaccctcgtgcacatgttccagagtgctcgattcgtgccgattggcaacacgccagtggtgttgcaacgcatcgatccaaacggcggcccgctgggcgaacccatccacaaagtcatcgggcccagcggcattctggaaatcaccgagtgtgatcgcaaccagaagtaccgggtcaatttttaccccaacgtttccagggaacacttcaaggcgctgtatgcctcttatcagtcggtcatcacgccactggaaggctggctgcgcagcgagtggagcggcacatttgcgccgctgtggaaggactactccgaggctaatttcctcaagcgctatctctcgctgcaccaggcttacgccaaaggatttggcgatgcactgagctcactctgggacagcctcaaacagctggttgaatggctggcgcaccccctggcaaatgccgaaaagctgctgcactacctgtcccaggccgagttcgaaaagctactgaaggtcagcactgaaacccttgccaaaggcctgctgatactcagcgatgaaccgctgctgttcgtctacatggcggccatggtcagttggctgcggatgatgccaccgccgtatatgaacgaggtgctgggagagatcggcgtcgaggtgctgatcaacgtattgctgtgtgttgccacggccgggatgggcgttgtgatacgcctgagcagcaaggtgctgggcagcatcaagtcgcgtcgtgtgcgcgagtggctggaacatgtggccagccagttcggcaaatcgcgcctggatacgcacgttgaggcggctaagccgatattgctcgccgggccggcgacttcgatcaacacggtagcgggtgcgccgttgaaggctggggagaacctggttgcgaacgcggtgcctgcggttcgtaagaagacgcagcagacagcgttggtgcgccaggagcatgtcgatgatgtgcctgtcgcggcgaaaaatccccagggagatgcggcggcgcctgcggataaaaccgccaccaatggctgcccggtgtcgatggttaccggcgaggaattgctcaccctcaccgatggcgcgctggacgggattttgccgtttgagtggacgcggctgtatcgcaccagcgcggtggaagtggattgtgggttggggtttggctggagccattcgctggcgcagcggctggtggtggacggtgattcggtggtttggacggatcatgagaatcgcattactgagtttccgttgcctagcgtttcccggcctgcgattaccaacagcttggctgaagccgcgatctacttgggggctttgcccgatgagctggtactggctcaggcatcgcgtttttatcacttttgcgatggtcagctgacagcgatcagcgatgcgtatgacaaccggctgcgggttattcgtgatcgtttggggcggattgagcggctggataacggtgtaggccggtctttgtttttgcgctatgagcttgggcgcattgtggcggtggactatcaggttcatcgcgccaaaggccgtgagccgtatgtgtgggtgacggagcagaacgtcgtttcctacgcctatgacgacgctggacgactggtttcggcgaccaatgctgtaggcgaaagcgaggtttatcggtacgacgatcagcacgtcattcttgagcggcaattggccggtggtgcgagttttttttgggaatgggaacgggcgggtaaggccgcgcggtgtgttcggcactgggccagcttttcgcagatggacacgcggtatgcgtgggaggacggcggtcgggttacggttcataacgcggatggcagtcaggaagtgtatgtccatgaccagcgcgcgcggctggtgcagcgggttgatcccgatggtgctgagcatttcaaatcctacgacgacaagggccggctgacggttgagcaggatccgcttggggcggtgacggcgtatcagtacgacgacgctgggcgtttggtggcgttgtttccgggggaggatgagccgacttcctacgagcatgacaacgggttcgtacgggttgtgcggcgcggtgaagcggtttggaagtatgagcgtaatgaccaaggcgacgttacgcgtcagacagatcctgacggcaatgttacggactacacctacaacaaacatgggcaactggttggggtttggtatccggataacggttgtcatcggctggtctggaatgagcgtgggcagctccttgaagagcaactgccgaatggtggggttaagcggtatcgctatgacgatgttgggcgacaggttgcgcgtgaggatgagcatggggcgctgacccagtatcagtgggatgctgtgggtcggttggttcgtgtcgttcttccaggcggtgccacgcgggaattcagctacaacccgtacggaaaaatca

SEQ ID NO: 77 - DNA, 30682 bp, Pseudomonas poae FL10F
tctgtactgctgtaacagtcagaatcgggctttgtccctcctcctcccttcaagtcctagcatacaagcgggcttgctcgcgaatgcagagtgtcagtcggtacatgtgtaactgacccaccgcattcgcgagcaagcccgctcccacattttgattttcattcggctccgatcctgttgatcgttcccacgctccgcgtggaaatgcatcttgtgacgctccgcgtcaccttcgttcacgactcgagaattgcactgactggcagagcgcggagcgccccaagcggcattcccacgcagagcgtgggaacgatcaattcttcgcaacacctccaatcaaatgtgggagctggcttgcctgcgatagcggtagatcagctgcagatatgtcgactgacagtccgttatcgcaggcaagccaactcccacatttttaatctttgttcggcgtgagtccgcgtttgctgatgctctgttactccaaccgtaacgatccaccttcgggcttgattgataccccccactttcactcctaaggtaagcccacgacagcaaaccccgtggagcgaccatgacaacaaccatcacccccgactcgcgctggacgcggcggcgcgacgagaagcagcggcggctcgggctggtcaagcaatacgcagacggggcggtgttgcccagtgacagaatcgtcgaggcgctggaagcgctgatccttcccggcgaccgcgtggtgctggagggcaacaaccagaagcaggccgatttcctctcgcgctccctggccaaggccgacccggccaagctccacgatttgcacatgatcatgcccagtgtcggccgttccgagcacttggatctgtttgaaaagggtatcgcacgcaagctggatttctccttcgccggcacccaatccctgcgcatcagccagttgctggaagacggcctgttggaaatcggcgcgatccacacctacatcgaactctacgcgcggctggtggtggacctgatccccaacgtcgtgctctcggccggtttcatggccgaccgcgccggtaacatttacaccggcgccagcaccgaagacaccccagcattgatcgagcccgccgcgttcagcgatggcatcgtgatcgtgcaggtcaaccagttggtggatgacgtcaccgatttgccccgcgtcgatattccggcgagttgggtggattttgtggtggtggccgacaagccgttctacatcgagccgctgtttacccgcgacccgcgccatatcaagccggtgcatgtgctgatggcgatgatggcgatccgtggcatctacgaaaaacacaatgtgcagtcgctcaaccatggcatcggcttcaacaccgccgccatcgaattgatcctgccaacctacggcgagtcccttggcctcaagggcaaaatctgccgcaactggaccctcaacccgcacccaaccctgatccccgccatcgaaagcggctgggtcgaaagcgtgcattgcttcggcaccgaactgggcatggaaaactacatcgccgcccgcccggatgtgttcttcaccggccgcgacggctcgatgcgctccaaccggatgttctgccagctcgccggccaatacgcggtggacctgtttatcggcgccacgctgcaggtggatggcgacgggcattccagtaccgtcacccgtgggcgcctcgccggttttggtggcgcgccaaacatgggccacgacccgcgcggccgtcgccatggcaccccggcatggctggatatgcgccacgacgacgcgccgcaagccctgctcgaacgtggcaaaaaactcgtggtgcagatggtcgaaaccttccaggaaggcggcaaaccgaccttcgtcgagacactcgacgcggtggaggtggcgcgcaaaagtggcatgccgctggcgccgatcatgatctacggcgacgacgtcactcacctgcttaccgaagaaggcatcgcctacctgtacaaggcgcgctcgctcgaagagcgccaggcgatgatcgccgccgtcgctggcgtcaccgccatcggcctgcgccacaaccccaaggacaccgcgcgcatgcgccgcgaaggtctgatcgctttgcctgaagacctcggcattcgccgcaccgacgccacccgcgagctgttggccgccaagagcgtggccgacctggtggagtggtccggtggcttgtacaacccgcccgccaagttcaggagctggtaaatgcgcgcccttaaactgcacgaactgagcctggctgaccgcctggcggacatggccgtcgatgcgttgatcgatgaggctgatctgtcgcccaaacccgccttggtggaccgccgcggcaatggcgcccacagcgatttgcacctggggttgatgcacgcttcggcgttgtcgctgtggccgatgttcaaggagatggcggaagccgcgcttgagttcggcgaagtgggtttgcctttgcgcgaagccctcgggcgcattggccgtgaaggcgagcaggcgatgctcaccaccaccaagggtgtgaacacccatcgcggcgcgatctgggccctcggtttgctcaccgctgcggcggcgctggagcctcgggccgtcacgctgacggcggcaaaattagccctgctcaacgaccgctacgcaccgcagccgatgagccacggcgcccaagtcgcccaacgctacggcgcacgcggtgcccgtgaagaagcacaactgggcttcccgtccgtgacgcaacgcggcctgccgcagctgcacaaaagccgcctgcaaaacgccggcgaacagaacgcgcgcctggacgccttactcgcgatcatgactgacctggccgacacctgcgtgctctaccgcgccggcaccgaaggcctgcacgccatgcaacgcggcgcccaagccgtgctggacgcaggcggcagcgcaagcctcgccggtcgccgccagctgcacgaactcgacgaccaattgctggccctgaatgcctcccccggcggcgccgccgacctgttggccgcctgcctgtttatcgaccgcctcgacggagcgttttgatggaaaccttatcctttgaattccccgccgggcagccgcctaaaggccgtgcgctggtgggttgcgtcggctccggcgacctggaagtgctgctggaaccgggcacgcccggcactttgaccattcaggtgcagacctcggtgaatggcgccgaacagcgctggcagcatctgtttgaacggattttccaggagcacacacctccggccttgaagatcgatatccacgacttcggcgccacgcccggcgtggtgcgtttgcgcctggagcagggtttcgaggagatcggccatgactgacttgctcagcaaacacagcttcgtggaactcggtgcacggcagcgggccaaggccttgctggacgccggtacgtatcgcgaactgatcgacccgttccaacgcgtgatgtcgccctggctcagccgccaaggcgtggtgccccaggccgatgacggcgtggtgatcgccaaaggcagcatcgccggaaagcctgtggtggtggccgctatcgaaggcaacttccagggcggcagccttggtgaagtcggcggcgcgaaaatcgccggtgccttggaactggcggctgaagacaaccgcaagggcgtcccgacgcgcgcggtgctgctgctggagactggcggcgtgcgcctgcaggaagccaacctcggcctggcggcgattgccgacatccacgcggcgattgtcgatctgcgccagtaccagccggtggtgggcgtggtggcgggcagtgtcggctgctttggcggtatgtccatcgccgctgggctgtgcagctatctggtagtgacccgcgaagcgcgcctgggcctgaatggtccgcaagtgatcgagcaggaagccgggctggacgaatacgactcccgcgaccgcccgtttatctggagcctcacgggcggcgagcaacgcttcaacagcggcttggccgaccgctatgtggcggacgatgtggcgcagattcagcagaccgttaccgagctgctgcaacaaggcttgcccacacaacaacgcagccgtcaggtcgatttctacctggcgcgcctggccgagctggatgctacgccgcagatcgacgcggcgacggttcgcgacctgtatcaaggagagcgctcatgagaggcttgcactggttcaacgctttgagcgccggcgccacgccggtggagggtttgccagcctcgctgaaagtcgccgacggcgtattgggtgagcagcccgtgcgctttatcgccgtggtcaccgacgcacaaaaccgcttcccgcgcgcacgcaatggcgaagtcggcctgctcgaaggctggggcctggccaaagccgtggacgacgccatcgctcgcggcgacaagcgcccgatcatcgccatcgtcgacgtgcccagccaagcctatggccgtcgcgaagaagccctgggcattcatcaggccctggccgccgccgccgacagttacgctcgcgcgcggttggccgggcacccggtgatcgcgctgctggtgggcaaggccatgtccggcgcgttcctcgcccacggctaccaggccaaccgtttgatcgccctgcgtgaccccggcgtgatggtgcacgccatgggcaaggcctcggcggcacgggtgactttgcgcagtgttgaagagctggaagccctggctgccagcgtgccgccgatggcttatgacatcgacagttatgccagcctcggtctgctctgggaaaccctgtcggtgacccagattgaacagccgacggcggacgatgtggtgcgggtcagcgattgcctgatcagtgcgatcaaggatgtcagcggccaggatttgagcgggcgcctcggcgccaccaaccgcgccgcctccagccacgtgcgccaactgctgcgggaacagtggtgaacgctcacgacttgctctggggcatgaccccggcgcatctgcccgccgatgcaccggcctgggcggtggacgcgatcagcgccggccacccggtggtggtgcgccgcgccatcgctgagcccggccaagtggcggtcggcgtgcgcgggcgtttgcgtgagcaacgcctggcggcagtgatgcccgttgcggccgtgcagcggcgagtgacgccggaagccttatgcagcgtgatctcgcctagggatttaccggcgttgcgcgcactcgatctactgcggccggtgctggcgcaagagacgtggggtgtcaccggcagcgcaggtttcgagttggccagcggcattcaagcgctgcatgagcagagcgatctggacttgatcctgcgcacgccccagcgtctggagcgcggcgatgccgaggacctgctggcgattctggacaccgcgccctgtgccgtggacctgcaactgcaaaccccgtttggcgccgtggccttgcgcgaatgggcgagcggctcacgccgcgtgctgctcaaaaccagcagtggcgcgcaccttgtatttgacccttggcaggccgtggcatgagcagcctgctggtgtttccggggcagggcgcccagcgcacgggcatgctccaggcgctgtcggcgcaggtgctggaagaagccagtgatgcgttgggtgaagacgttcgcctgctcgattcggcgcaggctctagcgagtacgcgcgccgttcagctgtgcctgctgatcgtcggcgtggcccatgcccgccagttgcaacacacgcctgattacgtggccggcttgtccatcggcgcttatccggcagccgtcatcgccggtgcgctggaatttgccgacgcggtaaaactggtgagcctgcgcggcgaattgatgcaaaacgcttatccacaaggcttcgggatgaccgcgctgatcggcccggagttatccacagtggaaaaattattggacgaaatccacagcccgaaaaccccggtgtacttggccaacatcaacgccgataaccaaaccgttatcgccggcagcgatgaggcaatgaagcgcgtcgccgcccgtatcaagggcaacggcgtagccaagcgcctggccgtcagcgtgccgtcccattgcgcattgctggaggcgcctgcccaggcgctggccgaagcattcgtcacgctcaaggcgccgcgcatcacttacctgagcagcacccgcgcacggccgattcataaccctgaacaactgcgcgacgacctggctttcaacatgtgccgcatcgttgactggcgcggcaccgtgcaaagcgcctacgagcgtggcgtgcgcctgcaaatcgaactgccgccgggcgcggtgctcaccggcctgtcacgccgtgtattcgaacaaggcacggtgatcgcttgcgaaggcgcacgcctggacaccttgcaggccctgctgcaagaggaggaacgccgccaccgataaagcaccacccaaggctttcgaagcacaaaaacaacaatttcgatgaagcactttgaggacaacaacgatgattatttatggtgtggccttgttggcgatctgcatgttggcgggtgtgatcctgggcgacatgctcggcgtgttgctgggcgtcaaatccaatgtgggcggcgtcgggatcgccatgatcctgctgatttgcgcgcgtttgtggatgcaaaaacgcggtggcatgaccaaggactgcgaaatgggcgtgggcttttggggcgccatgtacatcccggtggtggtggcgatggccgcgcaacaaaacgtagtgacagcgctgcacggcggcccggtggctgtgctggccgccatcggttcagtcgtggtttgtggctgcaccattgccctgatcagccgcacccacaagggcgaacccttgcccgccgaagagccgctgatcgctgctgcgggaggtcgctgatatgtggcctctgatcgaaaaaggtctggaaaataacagcctggtcaccgcctttgccttcgtcggcgtggtgatgtggatttccgtggtgctgtccaagcgcctgacgttcgggcgcattcatggctcggcgattgccatcgtgatcgggctggtgctggcctgggtcggcggcacgctcaccggcgggcaaaaaggcctggccgacatggcgctgttttctggtatcggcttgatgggcggcgcaatgctgcgcgacttcgccatcgtcgccaccgcgtttgaagtgcaggccaccgaggcgcgcaaagccgggttgattggcgcgattgcgctgctgctgggcacaatcctgccgtttatcgtcggcgcgagcatggcgtgggtgttcggctatcgcgatgcaatcagcatgaccaccattggcgcgggtgcggtgacttacattgtcgggccggtgaccggtgcggcgattggcgcgacctcggacgtgatggcgctgtcgattgcgacggggttgatcaaggcgattctggtgatggtcggcacgccggtggcggcgcgttggatgggcctggataacccgcgttcggcgatggtgtttggcgggttggccggcacggtgagtggggtgacggcggggctggcggcgacggatcggcggctggtgccgtatggcgcgttgacggccacgttccatactgggctgggctgcctgcttgggccttcgttgctgtacttcatcgtgcgcggtctagtcggctaacgccgtaacccgatcgttcccacgctccgcgtgggaatgcagttctggacgctcccaaaggcgtgacgcggagcgtcacagtaggcattcccacgcggagcgtgggaacgatcagagttaggcctggcggttggcatacattcgacactcggccaacaacgccagcaaatttggatcacgctccttggccttcaaaaacaccacgccaatctgctgctgcaaccgataccgggcttgcagcggtatcagcttgacacggttctcatacaccgccgcaatccgcccaggcagcagcgcataacccacgcctgagctgaccatgctcaacagcgtgaagatgtcattcacctgcatcgccaccttcggctcgaaccccgcctgcttgaacacgcggttgccatcctggtgcgtggcgaagccttgggtgagggtaatgaacgtggcgtcgcgcacatccgccaggtcgatttcctgctcgcggtcgaagggtgaatcggctggggtggcgaggaagatgtcgtcggtgaacagcgcgatctgctcgcaatcagggtcgttggcgcgttcgtcgagggagatcaggatcgcgtcgacttccatgttcttgagcttgtagagcaggtcgaagttggagcccaggatcaggtcgatattgagttcgctgcgcctgattttcaggcccatgatcagctgcggcacagttttcactgtcagcgaatacagcgagccgagcttgaagcgctcggcggagaagccggcggcttcgcgggtcaggcgcacgctgtcgaccacatcggccaccagcttttgcgcgcgttcttccagcacgtaggcgctttccagcggcgtgaggttgcgtccttcgtgtttgaacagcgggcagcgcagcgcgttttccagcgagtggatggcgcggtgcacgctgacgttgctggtttgcagctcggcggcggcgcgggccaggttgccggtgcgcataaacgccaggaagatctcgagcttcttgagggtgaattcttcgtcgatcagcatggccgtggctcttgttcgaatacccccgattgtgcccctaaaaccagttcactcccagccatgcactgcccaggcccagcaacacgccgacgatgatcagccagatcgcgttgagccgcgtgtaatagaccacggcggcgctggccagggtcagcaccaggctggtcgcgttgttttccaggctgttcatcaagatgtaggtcgaggccaggatcaggccgatggagatcggcagcaggctgcgtttgacccgctgcacccacggcgtttgggtatgccgctccagccagccggcgccgacgtacgccagcaccgagcagggcaccagcttggccagcagcgccaccaacgcgccaggcaaccccgccgcctgctggccgataaacaccaggaacatgccgttgggccccggcaatgcctgggacagggcgaagaacgcgacgaattgcgcgtcggtgatccagtgcatatcgaccacggtgtaacgatggatatcgccgatggccacggtgttgccgccaatcgccatcaacgaccacagtgcgcattggatcatcaggtgcagcaggacagtctgcatcagccggccaccttgttcgcgccaataaagctcaaggccagcgagcttggaatgcagaccagcagcaccatccacagcggcaacacgaagacggccatcaacacgaaggtcagcacgaacgcgctgtagttggcgagcgtgcgcggcatggccttgagcaggcgcagggtggtgccgagcatcaggccggtggcaatcggcatcactgcgccgaagatctgctgcaccacgtcgtggctccaccacttggcataggcaaaaccggcgagcacggtgatcaatgaggggaacaggtacagcccacagacggtcacaaccgcacctggcaagccatgcaggcgccggccgtagatgatgccgacgttggcgatattggggccggggaagaactggccggtggtcagcagctcattgaaactttgctcgctgacccagcggcggcggtcgaccatcatctgccgcgcccagggcatgacgccgccaaagccgaacaggccgaccatggcaaagttgtaaaacagctgccataggctgggatgaggcggggcgggttcaagctcgggcatggcaattaccgataggacgcttttatgtgggagctggcttgcctgcgatagcggcgtaacagtcgatggaaatgttgaatgttaggcccttatcgcaggcaagccagctcccacaggatgaagcgaatcatctatggacgtgtgtatttgggcaaatgaagaaagggtgttgcctgataggggttgggtggcgtcagaatgctcaaggtgataacggttattcgaggtgagtgacacatgtatcacggggaacgattcaatgcctggagccatttggccggggcagttgccgcttttgtcggcgcagtgtggatgctggtggtggcgagcctggacggcagcccctggaagatcgtcagcgtggcgatttacggttttacgctgctggtgctgtacagcgcgtcgaccgtgtaccacagcgtacgcgggcggcgaaaagcgatcatgcagaaggtcgatcacttttcgatctacttgctgatcgccgggagctatacaccgttttgcctggtgacactgcgcgggccgtggggctggacgctgttcgggattgtgtgggggctggcggtgatcggcatcctgcaagagatcaagccgcgttccgaggcacgcattttgtcgattgtgatctacgcggtgatgggctggatcgtgctggtggcggtcaagccgctgctcgctgcgctgggcacggccgggtttgtgtggctggcctcgggcggggtgttgtacaccgtcggcatcatcttttttgccctggaagatcggctgcgccattcccatgggatctggcacttgtttgtgatcggcggcagcttgctgcactttgtggcgatcatgcattacgtgctttaaagggcaatgcggtcaaaaaaatgtgggagcgggcttgctcgcgaatgcggtgtgtcagtgacagattaagtggctgacactgcgccttcgcgagcaagcccgctcccacagtggttttgtggtgttctcacaggcgatcgagcagatcgcgggcgcgagcgccaaagatctccaccaggttcgccagcatatgcggcggcggctcatccgcgcgggtcagggcatacagggtgatcggcagcggcgggctgagcgtgcggatgcacgtggtggccgttgaggcgcccaaggccgtgaacgggtcgatcacggtcaagccggcgccggattccaccatcgcccgggccagggaataggtctgtacggaaatgttcacccgtggcggcgggtcgacgttttccaggtagctgtcgagcttggccgccaacgggtcagcgctggacaagccaatcaacggcgcgcctgccaagtcatccaacggcaagggtttgctcatctccgacgctggccaataacctgttgacgccaacgccaccaaccccccatcggccaacacttgcgtggtcaagccggggtggccggagaagttgagggtgagcgccaggtcaatctcgcgcatcaacagcttttgcaccagctcgcggctatggtcgctggacagctcgcaggcgatgtccgggtaatcgcgcttccattctaggaccgcgggcggcagcaacgacagggccagcgccggaatggcgcctatgcgcacactttgcccaggctcacgacgcaagctcttggccaggcgccgcacgccttgcaggctctgggtgactttctcgacttcgctttccagtgccagggcttccggggtgggctgcaattttccgcgtacgcgcagaaacagcgggaaacccagttgcagctcggcgtgctgcaacaccttggtcaccgccggttgcgagacgtgcagcagctgcgcggcggcgctgattgagccggtttggcggatggcctggaaaatttcgatatgacgtaagcgcatggcttgcccataacctttgtttataggtgaccaagctttagtcattattcagcgtttgtcacttaaccctactcttgaattggtatcaataaatgtgaggttttcttgtgacaaagcaggtttgtatcatcggtggcggcgtcatcggcttggctagcgcttatgcgttggtgcgcgcaggcatggacgtgactgtgatcgaagcgcaaaacacgttgggcagtgcgaccagtttcgcgaacggtggccaactgtcctatcgctatgtcgcgcctttggctgacgccggcgttccattgaaagccctcggttggttactgcgttccgagtcgccgctaaggatcaaacctcgcctggacccgttgcaatggcggtggatggcagcctttgtgggcgcttgccgctcttcggttaatcgcattaacggcgaacacttgcttcgcctggcgctgatgagccaggagaccttgaagtgctggcgtcaggaggacagcctgggcggctttgactggaaacaaaacggaaaactggtgacctttcgttccgctgacagttttgaccatgcgcggcgaaaagtgatggaccccctgcataaacaggtgttatcggccgacgaatgtcgccagctggagccttccctgaccgagcgcgcctttgtcgggggcatttacaccccgaccgaagaagttgctgattgctacgccttttgccaacggcttgcggcgcgtctggaggcaacggggcggtgtcggttcctgctcgggcgcaaggtgctgcgtatccacgaggcctttgggcgtgcggtggccgtggagttgcaggatgaagtattaccggtagagaacgtggttctggcggcaggccacagaagcttgcgcatggggctgtcagacttgcgtctgccgctctatcccctcaagggctacagcctgagtgtgcccatcagtgagcagcacaacgccccgcaaatcaacgtcaccgactatgaccgcaggaccgtgtacgcccgaatcggcgagcagttgcgcgttgctgcaatggtcgacatcgtgggtttcaacagcgctgcggatcctggtcgtctggcagtgataaaacggatggcgcgtcagactttcccgatggcgggtaattacgacgctgcggttgaatgggctggtatgcgtccggcgacgcccactggtgtacccctgattggccccagtgcttatcgcaatctttggctcaaccttgggcatggtgcccttggcttcacgcttgcctgcgccagcgggcagttattggccgaaatgattggagcgaagccgacgtctatcgacacccaggcgtttcttcccaaggctgcctgaccttagatatcagagcgtaacatcgatgagcattgatcgagtccaaagcagtcagcaactttgtcgggccactacgttggcctcggctgaggtaaatgtgatcggcggccctcgcgagcaaccgctatgacacggttcgtatttagaacctgtgctttcgtgtccctggtgctgggcgggcatttggcgatggcgcatgagtccagtggaacactcaggaagatcacgaccaatcagcagatttcccttggctaccgagatgcttcagtaccgttctcctatgtgggggaccacagtggcaaaccgatgggctactcagtggacctggcgaacaaaatcgtcgagcgcatccagacaaaaaccggcgtggcaaacctcaaggtgaagtacaacctggtgacgtcacagacgcgtatcccgctggtgcaaaacggcacagtggacctggagtgcggttccactgccgtgactgccgagcggcagaaacaggtagcgttttcctacggttttatcttcgtgaaggggcagttgctgacggctaaagacagtggcatccatggctttgaagacctcaagggcaagaaggtggtgaccaccgcgggcaccaccaatgagcggtatatcaagcgctacaacgcagagcacaacagcgatatatcggtgatcgccgccaaagaccacggcgaagcgttcaagatgctggagactggccgggcggcggcgttttacatggatgacgcgctgctctacggtgagcgcgccaaggcccgtgacccgcaacgctgggtggtggtgggcgagcagcaatcgcgggagatctacagctgcatggtgcgcaaggacgacccgcagtttcttgcagtggtcaacgagacactcggcgatctgtaccgctcaggagaaatcaacggcatttaccagcgctggtttgaacagccgattccgcccaaaggtttgaacctggagtttccgatgacggctgagttgaaggcgattattgccaagcctgtcagcgacccggtggaatagcgacgtataaagccgatcactgtgggagctggcttgcctgcgatagcgtcagcacattcaacatctcggcgctctggtacaccgctatcgcaggcaagcccgctcccacagtttttattgggtttgcacagcggggttagaagtcgccccacaattgctgggctactgccagcgccaccactggtgccgtctcggtacgcaacacgcgcgggccgagacgggcggcatggaagccggcgccttgggcggtgtcgacttcgttatcggtcaaaccaccttcaggcccgatcaggaacgccaggctggcaggcttggcgtggctgatcatcggctcggccacggggtgcagcaccagcttcaaatctgcctcgacctgcttcaaccagtccgccagcaacagcggcgggtgaatcaccggcacggtggagcgcccgcattgctcgcaggcgctgatcgccacctggcgccagtgcagcaggcgtttgtcggcgcgttcgtccttgaggcgtacttcgcagcggtcgctgaaaatcggcgtgatcgccttcacgcccaactcggtggctttctgaatcgcccaatccatgcgctcgccacgcgacaagccctggccgaggtgaatgtgcaggggggattccgtctggcctgcaaagcgttccgtgagttgcacgctgacgcgttttttaccgacttccagcaacgtgcccaaaaactcctggccggagccgtcgaacagttgcacggcgtcgccttcgcccatgcgcaagacgcggctgatgtagtgcgcctgagcttcgggcaactcgtgatcgccgaggctcagcggggtgtcggtgaaaaagcgggacagtctcatgtgtgttctctggaaaatacaaaacctgtgggagcgggcttgcccgcgaaagcggtgggtcagtcaacatcaatgtttgctgggccgacgtcttcgcgggcaagcccgctcccacatttgagtgatggtcagccgggatcgcggaagcctgggtgaaagtccttcggcactgcaacgctgactttatcgttggtggcaatatcgatgccttcgctggccacttcagccaaaaagtcgatctgctccggcgtaatcacatacggcggcaggaaatacaccacgctgcccaacggccgcaacagtgcgccgcgttccagggcgtgttcgaacaccttcaggccacggcgttcctgccacgggtaggcggtcttggtggctttgtcctggaccatctcgatggccagtaccatgccggtctggcgcacttcggacacgtgcgggtggtccaccaggtgcgcagtggcggtggccatgcgctgggccagggccttgttgttttcgatgacgttgtcttcttcgaaaatatccagcgtcgccagggctgccgcgcacgccagcgggttgccggtgtagctgtgggagtgcaggaaggcgcgcagggtcgggtagtcgtcgtagaaggcgtcgtagacatcgtcggtggtgaccaccgccgccaacggcaggtagccgccggtgagggccttggacaggcacaggaagtccgggcggatgccggcttgttcacaggcgaacatcgtgccggtgcggccgaagcctacggcgatttcgtcgtggatcaggtgcacgccgtatttgtcgcaggcttcgcgcagcagcttgaggtacaccgggtgatacatgcgcatgccgccggcgccctggatcagcggttcgacgatgacggcggcgacgctgtcgtggtgctcggccagggtctgttccatggccaggaacatcgtgcgcgaatgctcttcccagctcacgccctcagggcgcaggtagcaatccgggctgggcaccttgatggtgtcgagcagcagcgccttgtaggtctcggtaaacaacggcacgtcgcccaccgacatcgcggcgatggtttcgccgtggtagctgttggtcagggtgacgaagcgctttttgttcggcaggccgcggttgagccagtagtggaagctcattttcaacgcgacttcgatgcacgacgaaccgttgtcggcataaaaacagcgcgtcaggccttccggggtcatcttgaccaggcgttcggacagctcgatcaccggctggtggctgaaaccggcgaggatcacgtgttccagctggtcaacctgattcttgatgcgctggttgatacgcgggttggcgtggccgaacacgttgacccaccaggagctgacggcgtcgaggtagcgcttgccttcgaagtcttccagccacacgccttcaccgcgttttatcggaatcagcggcagttgctggtggtctttcatctgggtgcagggatgccacagcaccgcgaggtcgcgttgcatccactggttgttcaagcccatcgttttatctcctcgaagcggtcctgcggccggcgcaggcgtaacaatcgcgcaagcctatgcaatggtcggctgtgtcacaacccattacggataaattcgcggtaaacgcaggacggtctgtcacgtttcttaggaatagtccttaatccattgttaacgtactgtgcataatctcaagatcgtatttctcgatatttcaaagctaaattttcggctttaattcgataggtaaatctttagtcttgggcacagctcttacgggatttgggacatgcaactacgtaattcatcggcccgctatggttgggtcagtatggttttgcactggggcgttgccctggtggtgttcggtttgtttgcgctgggcctgtggatggtcggtctcgactactacagtgcgtggcgcaaagacgcgcctgacctgcacaagagcattggcatcacgctgttcgccatcatgctggtgcgcatcgtctggcgtttgatcagcccgccacctccaccgctggccagctacagccgcttgacccgtattggcgctgcatttggccacgcgttcctttatctcgggctgtttgccgtgatgattgccggttacctgatttccaccgcagacggtgtcggtatcccggtgtttggcctgtttgagattcctgccgtggtttccgggctaccggaccaggcagacaccgccggcgtggtgcatctgtacctcgcctgggtgttggtggtcttcgccggcttgcacggcgtggctgcgttgaaacaccactttatcgatcgtgatgcgaccctcacgcgaatgctggggcgcaaagcctgatgttcaacctcgactcacaaggaatagaaagcatgttgaaaaagactctcgccgctctggcaatcggttctgctctgctgtccgctggttcggcgatggccgctgattatgttgtcgacaaggaaggtcagcacgccttcgttgatttcaagatcagccacttgggctacagcttcatcaccggtactttcaaagacctggacggcaagttcagctttgacgctgccaagcctgaagacagcaaaatcgagttcaacgtccgtaccgccagcgtgttcaccaaccacgccgaacgtgacaagcacatcgccagcaaagacttcctggacgttggccagtttgccgatgccaagttcgtttccaccagtgttaaaaccaccggtaaaaatgctgcaggccaagtcactgccgacgtaaccggcaacctgacctttcacggtgtgaccaagccgatcgtggtcaaggctacgttcctgggtgaaggcaaggatccatggggcggctaccgtgccggttttgaaggcaccaccagcttcaaccgtcaggacttcggcaagcagatggacctgggcccagcgtccaacactgttgagctgtacgtgacctttgaaggtgtgaaagcgaagtaatttttcgctgtttcacaatcaaaacgccgaccctggggtcggcgttttgctgtctgcctgtttataagctgccctgatagatcacaacttgatctttgagccaggtgtgcagtgaggttaattgcgctgaatgtttactgccggccggccagaccaggaaatagcgcgaggtgtgaattggctcaatgtcggtgagcctgaccagttccccgcgttgaatcagcgaatgggcaatcgagcgacgggtcagggcgacaccgtgccccagcctgacggcttcgagcatcaatgttgagtcggtgaactccagcgaggcttgagggcgttgctcttccacgcccgctgcacccagccagatgggccagctttcactggcgtgcagcagcggctgctcaaggatggcttgcgcggtgtcgggcagcacgccgtggttgaagtcgcgcgcggcgaccaccagcagtgaatcgcccatcagcggttcacagtgcacatccggccattgaccatggccgaagcggatcgcgcaatcgagcggaccttgatcgaagctggcgaattccatgctcgactccagcctcaggtgcagctccgggtgtgcagccctgaaatcttgcaggcgcggcagtaaccaatgcatggcataggagggcagcaccgacacggtcagttgcgggtgcttggtttttgccatgagtttttccgttacccccgcgatttcacccagcgcctgcctgatttgataggcatacacacggccctcatcagtcagcgcaagggcacgtttgttgcgcatcaccagcgccatatccagatactcttcaagcgaacggatctgatggctgacggcactgtgggtaacgtgtaactcggcggcggcaaggttgaccttgcccagccgggccaatgcttcgaaggcccgcaaggctgcgaggggggggagtttcaatgtgtgaattcctttcacggtaaagcctaataatagccgctatacgtgaaatgtgtgcgctcctgataatacgcgaccggtgagttacttaaataacgtcgtgttaaacagtcaggagttgtcagttgtgatagatgaaattcaagcgtttctgaaagactattttagtgtcttgcaaactcaggatctgaaggcgttcgatcaagtgtttcatcgcgggtgcgtgttatatagcgcgcaaaatgcggacgtggtcgtacggccctttgccgagtaccggaccatggttcaaggccgtcagtcgccgcaggcaggcggttttccgcaacttgatgaagtgctgatgattgatgtgatgtcctcggaaatggccatcgtcaaagtgcgtttgcgcttgtttaataatgtaatggtcgactatttgaacctgatgaaagttgacggtcgctggatgatcttcgcaaaactttttcataaggcgggcgaagcatccgatcaatgaaaaaagcgccagatgcaaaaacgccccgaacagtcggggcgtttttttttgccgtctgaaactcagcggttgcgggtcagcaacgctggtttctcaccacgagggcggcctggcaactgatccagctgctcaggtgtcgggaagcggtcagctttcgactccttgtggatgatcttcggcgccgggccaccgcgcgggttctgcacggccggctcggacaagcgtggctggtcatcacgggcggggcgacggttgttgctgcgcgaatcttcacgacgcgcctggccgtcacgcggtgcgccattgcgcgggccgctgcgcttggcaggcggagtaccggtggtgccgccgctgctgttgcgcgggccattttggcggccgccttgtggctggccgccacgtggggcgccagcgcctgcgccctgtgccggagcacctggacgacggccacggccctgggccggtttggcctggggcacgtagtcaacgcggttaccgaagttatccacgtcgtcgtcgaggaactcgtccggggcgcggtcggctgcagcgcgtggcggctggctcggctggcgctgttcgcgggccggggtgccttcacggggtttctgctcgcgggctgggcgttcgccacggccgttggtgggcgctttttccttgccgcccttgtctttgcccttgtcgcgacggccaccgccaccaccgccgccgttcgggccatcgcccttcggaccgcgtgggttgcgtgggttacgcacgtccggacgctcgcgcgcttcaggcttctcggcctcaacggcgctggcatcgaagcccatcaggtcgccgtcggcgattttctgcttggtcatgcgttcgatgcttttcagcagtttttcttcgtccggtgcgaccagggaaatggcctcacccgaacgcccggcacggccggtacggccgatacggtgcacataatcttcgtcgacgtttggcagctcgaagttgaccacgtgtggcaactggtcgatatccaggccgcgggcggcgatatcggtggcgaccaggatgcgcacagaaccggccttgaagtcggccagggctttggtgcgcgcattctggctcttgttgccgtggatggcgacggcggtcaggccgtgcttgtccaggtactcggccaggcggttggcgccgtgcttggtgcgggtgaacaccagcacttgttcccaggcgccggcggtgatcaggtgcgccagcagcgcacgcttgtggctggcggccaggcggaagacgcgttgctcgatacgctcgaccgtggtgttcggcggcgtgacttcgatgcgttccgggttatgcagcagcttgccggccagggcagtgatgtcctgggagaacgtggccgagaacagcaggttctggcgtttggccggcaggcgggcgaggacctttttcacgtcatggacaaagcccatgtcgagcatgcggtcggcttcgtccagcacgaggatttccacgtgggacaagtcgacgctgccttggccgcacaggtcgagcaaacgacccgggcaggcgaccagcacatcaacgccgcgggacatggcctgaacctgtgggttcatgccgacgccgccgaagatgcaggcgctgacgaacttcaagtcgcgggcatacagcttgaagctgtcgtgcacctgggcggcgagttcgcgggtaggggtcaggaccagtacgcgcggttggcgcgggccatgacgctgggatttgtctgggtgaccattggggaacaaccgctccagaatcgggagggcgaaaccaccggttttaccagtacctgtctgagccgcaaccatcaggtcgcggccttgcaacacggcgggaatggcccgctgttgcaccggagtaggctcggtatagcccgctgcctcgatggcgcggactaaagcctcggagagaccgagggaagcaaaggacatgagtaatcctgttttagttagggcttggcccaaagggataatcttgccgggcgtgaatggcgcttaggggagcgcaaccccgtccggtcctgctgcgtctggcgggcactccaccggctcgcgcgggctgaaagctgcgcagtagcggggttaggtgcctttttcaagacctcagcggccgggcgtgagcctggcggaaaggccggagtataacagagcaatcacggcgcgccgctttcctgctgctcaacggtgtgttctgaggcagtaatggcttggactccgccatatttggcactcaagagggcgtacgccggctcctgtttgaagcgcttgagttcggcggcgaagcgctgcaccagcaggtccatgcctgcgccgcgacgcacggcgagaaactgcgcctggcggctgaccaccacaggggcctggctgaccttgtcttccaggcccatggccttgatcacatgctggcccacccggcgatccgtaatcaccagatcgatgcggcccagcgacagcttgccgaagttggcttcgtggctgggcgccggctcgcggttgaacaacgtggagtcgctgaagctgtccccatacaggtaacccggcgaagtacccacggtcagcccgcgcaaatcatccagggtttgggctgggtgagggcggtcgttggcgtagaacagcacaaactccacatccgacagcggctcactggggtagagcagcaaggcgtcgcgttcatggctgtggaaaatatccagcgcgccgtcggcgtggccttggtcgagcatggccaggcagcgtttccagggcaggaactgccactccacgtccacccccaggcgttggaacacgatcaccgtggtttcgtaatccaggccgcgcatgctgccgttttcgtcgtatacgtaaggcgcccagggctcggtgacaatgcgcagtttctcgccgtaagcggtgaggctcaggcaagtgaaaagcacagcggtcaacagcttgagaatgacgggcatgccctgaggttacgacgctcctgccctaaagagaagctctggcacacgcattcgcgggcaagttgatgtggcgcatttaaaacaaaaaggccctcgtattgacgagggccttggcgtatcggagcgagcctcagcgtggcagcttgaggttgttccagatggccaggctcggttcagcctggttcagggtgtagaagtgcaaccctggtgcgccaccttgcaacaaacgctcacacatctcactgataacctgttcgccgaaggcctggatgctcttgacgtcgtcgccataggcttccagttgcttgcgcacccagcgtgggatctcggcaccgcaagcgtcggagaaacgcgccagcttgctgtagttggtgatcggcatgatgccgggcacgattgggatgtttacacccatcgcgcgtacacgctcgacgaagtagaaatagctgtcggcgttgaagaagtactgggtgatcgcgctgttggcgccggcgttggccttgcgcacgaagttgtgcagatcgtcttcgaaattacgtgcctggggatgcatctccgggtacgccgccacttcgatatggaagtgatcgccgctttcttcacggatgaaactcaccaggtcattggcgtagcgcagctcaccgctggccatgcccatgccggacggcaggtcaccacgcagggcgacgatgcgcttgatgccggcttgtttgtactgggtcagcaggccgcgcaggtcggccttgctgtcgcccacgcacgacaagtgcggagcggcggcaacgttggcttcactttccagctgcagcacggtgttgatcgtgcgatcacgggtcgagccgccggcgccgtaggtgcaggaaaagaagtcggggttgtagctggccaactgcttggcagtcgccatcagtttttcatgcccagcatcggtcttggtcgggaaaaactcgaagctgtagcgacggtcttgggacatggtaatacccttggaaactcagaatacctgaaggcatacacagtcaatgtgggcacccagcttatgtgggagccgggcttgcccgcgatgcaaacactgcggtatgtcaggcatatcgcagtgatgctatcgcaggcaagccagctcccacataaagccggcgcctacagggctgcttagtagcggtaagcgtgcggcttgaacgggccttcaaccgtcacgccgatgtagtcggcctgggtcttggtcagttgagtcactacgccgccgaagccgcggaccatttccagggccacttcttcgtcgagtttcttcggcagtacttctacggtcaggcgctcggctttctgggctggcgacaggtcggcgtatttctggtcgaacaggaagatctgcgccagtacctggttggcgaacgagccatccatgatgcggcttgggtggccagtggcgttgcccaggttaaccaagcggccttcggccagcaggatcaggtagtcatcgttttgtgggtcgaatttgccagcgccggtacggtgaaccttgtgtacctgtggcttcacttcttcccatgcccagttcttgcgcatgaaagcggtgtcgatttcgttgtcgaagtgaccgatgttgcagaccacggcgcgctttttcagggctttgagcatgttcgcgtcgcacacattcacgttaccggtggtggtcacgatcaggtcgatcttgcccagcagggccttgtcgatgctcgcttcggtgccgtcattgacgccatcgatgaacggcgaaaccacttcgaaaccgtccatgcaggcttgcatggcgcagatcgggtcaacttcggagactttaacgatcatgccttcctgacgcagcgactgggacgaacccttgcccacgtcaccgtagccgatcaccagggcttgcttgcccgacagcaggtggtcggtgccgcgcttgatcgcatcgttcaggctgtgacggcagccgtacttgttgtcgttcttgctcttggtcaccgagtcgttgacgttgatggccgggattttcagctcgcccttggccagcatgtccagcaggcggtgaacgccagtggtggtctcttcggtcacgccgtgaacgcgctcgagcacctgtgggtaatctttgtgcaacagttcggtcaagtcgccgccatcgtcgagaatcatgttggcgtcccatggcttgccatccttgaggatggtttgcttgaggcaccactcgtactcttcttcggtctcgcctttccaggcgaataccgggatgccggctgcagcgatagcggcagcggcctggtcttgagtcgagaaaatgttgcaggacgaccagcgtacttcggcacccagggcaaccagggtttcgatcagcacggcagtctggatggtcatgtggatgcagccgagaatcttcgcgcccttgagcggctgctcagcggcatacttgcgacgcagacccatcagggccggcatttcggattcggcgataaaggtttcgcgacggccccaggcagcgagggacatgtcggcgactttgtagtcggtaaaatctgcaggcgtgattacagcgctcatgaagagcctccattcgtagtgtgcgaatgggcgccgttgtgcgtttagtatccagctggctaaccaggccggacaacgccccatccgagcctgacaggtcgagcctgctgcagcgcccctcggacaggtggcgggagaacggtatcaatcagagatgaccgttttgaagcggtggcgattatagctgtgtgcgccagacttcccaagcctttctgtcagccatatgaagatcgctcatcggcttgataggcaatggttcatagagcttgggcccgcgctctgccatgatgttgcccatcattcggcaagacgctttggagtgaccatgaacttccacacccgcaaatgggtaaaacccgaagacctcaaccccaacggcaccctgttcggcggcagcctgctgcgctggatcgacgaagaagcggccatctacgcgattgtccaattgggcaaccagcgcgtggtgaccaagtacatctccgaaatcaacttcgtcagcgcctcgcgccagggcgacatcatcgagctgggcatcaccgccaccgagttcggccgcacctccatcaccctgacctgtgaagtgcgcaacaagatcacccgcaaaagcatcttgaccgtggaaaaaatggtcttcgtcaatctgggggaagacggcctgccggcacctcacggccgtaccgagatcaagtacgtgaaggaccagttccaggaagacggcatcagcgaataaccctgcttcggtttgattcgtttcgggatcattcccgacggattctttttgggctctctcgtcactcaggactacaacctgtagagagagccatgtatgaaagtttccaattcggctgcaccgaatcaaccttcattgcctcaaagcaccggccaggacgtgaaaacgcctctggtaaaaggcgtgggcgagcgcaacttgagtgtgtatcgccatagcgatggtcgggtggatgtgatgctgtcgccgccccctcccgcccaccttgtgctcagcggcggtggcgccaagggcatcgcctttccaggggtggtgcaagcgcttgaagaggccaacaaactctcgggcatcaaggtgatttccggctcttcagccggtgctatttccgcaacgttgctcgccagtggcatgggcgccaaggcgtttggcgcgctgtcgaacagcattgacttgcctagcctgctcaacagcaaagaccctttgactgccaagctgcaaacgctcagctccgagctgggcaagctcgccggtcgtctgcccggccccgccggcaatatttcccaactgctgctgacgatgctgccgcgcctgcagaccgaggcgcagcccttggaagagctgatgcgcaacgaatcgcgcaaatcgattcttgcccatatcgcgggcatgccccaggccacccgacccgccgacgtcataaaaatcgccgaccggctcaacgcgagcggggcgccgacgtttcgcgaccttgaggtgctgagccgtcacatcccggcgatcaagcagctcaacatcaccggtacgggcatgttcgatgggcgaccgcagttggtggtgttcaacgccagcctcaccccggatatggacatcgcccacgcagcacgtatctcgggttcgctgccggggctgttcaagagcccggacgagcaaggccatgatttccaggcggcggccgaagtcacggcctttcaggacggtgggctgctcgtcaacaccccggcccctggcgtcattgagcgttcgtttccggagagctcgttgggcaaggacgaatcgttgatcgtcaaattcgagcccgaaaaggcgacagcgccccaaacaagcggcggttttttcagtcaccttggcgacctcattaccggtacgccacacgcggcggcagacgcctaccaagaggaacggctcgaatcgtatgccgatcagtccgtcacgttgccactgaacacggacaaaggcgactttcgcggcctgctcaatggcaccgtcaacttcaccatgacccccgagcaaaaacagcggctgcagaccctggcgcgtcaaacggtggaggggcacctggaaaagcgcgcactggtgcgtgagcagcatccgttcgcttccctggaagatgctgtgttggcgatggacgataaaatgctgtccagtgcgcaggatcaactgcagaaggacccggcaagcgctgcggcgttgttgtttcgaaagaacgcgcagcaggcgctgcaaacgttggacagtgcgatcacgcaagcgaatcaaaccggtacgtctctggtgttcacgccacagctgacctcggcactccgtaatctggacgcgctcgcgcgtcggcccgagcatatcgagtggttggggcggcggcttaatgccgcgggccagcacaattttcagcaattgctgcaagtggcggctaaacagaaatcgggcactgactttcccctgtccaaggtcatggccagtggcgtggcgcacatgcgccgacgcgatattgcggtgaaggctgaaaactttgtgcgagaggtcatttacccatcgctgtaccgtcccggccagccgaagtccaatgtcgagctgttgcggcgtgcggcgcgtgacttggctgacgcaaccacgccggcggagttcaacagtgtgcttgacggcatcattaagcactataaagcacgcaataagccctggagtaagccgcgcagctctaccaccgtagagatggctaaagcctggcgcataccggtttagtcgtctggccactgaacagccaccgtcgcggcgtgtcgtagctaaaagcccccccctcggactcggtacatcatggccactcaagcagacggtaaaacccccaacctgtcgcaggaagaacagcaagacgttgacaagaaccagccgccccgcgcggcggttctgcatgaaatcatccgtactcaaggtgaccaggaactggagcgcagtgtcgccgccttgtggtggtcggcactggcggccgggctgaccatgggcctttcgctgatggccatggggctactcaattctcgactgccgtcgggcgaggcctttaaggtgatcgccagcttcggctactgcgcgggctttctcgcggtgatccttgcgcgccagcagctgttcactgaaaacaccctgaccgccgtattgccggtgatgagcaaacccacatggagcaatgccgggcgactgctacggttgtggacagtggtgctggtgggcaacctgtgtggcaccttgctggtggcctatgtgatgctgcacctgccgatctttgacaccaagaccgacatggcctttctcgaaatcggtcgcaagatcatggaaaacgacgctggccagatgtttgccaagggcatcatttcgggctggatgatcgccaccatggtgtggatgatcccgtcgatggaaagcgccaagatgtggatcatcatcctgatcacttacttgatggcgttaggggacttcacccacatcgtcgtcggctcggcggaagtgtcttacctggtgtttgccggtgagctgccgtggaaggacttctggctggtgttcgccgggccgaccctggcgggcaatatcatcggtggcagttttatctttgccctgatcagccatgcgcagattcgcagcgaaagcagcctgccagggaaaaaggctgcggacccgaggcatccgcagcagatcaacaaggatcagtgatgctcaggcgtggcttggggctcgtcccgggtcacgcgcttgaccagcttgccgatgctcaaaccctgcaacaggatcgacgacagcaccacgatgtaggtgatgctcagcagcaggtcgcgttccgggcccagcggcaaggccagcgccagcgccactgaaaccccgccgcgcaaaccaccccaggtgagaatgcggatagtgccgcgcggcaccgtgcgccagcggcgcagcagcaggatcgccggggccacggtcagcaggcgtgaaagcaggatcgccacggccagcaaactggcggccaacacgtgcagccagttgaacggcaacagcaacagctccatgccgatcagcgcaaacagcagggcgttgagcatgtcatcgagcagctcccagaagccgtccaggtagcgccgggtcatgtcgttcatcgccagcttgcgccccaggttgccgatgatcagcccggccaccaccatcgcaatgggcgccgagacatgcagttcggtggccattgccgagccgccaatcaccagcgcgagggtcagcatcacttcgatctggtgttgctcgatgctcttgatcatcaagtacaccaggtagccgatcagcccgccgaacaccacgccgccaaccgcctcatgggcgaatagcatggcggtggcgcccacggtcggtgtttcgcccagttgcgcaatccccagcagcacggtgaacaccaccaccgccgtgccgtcgttgaacagtgactcgccgacgatggtggttttcagcggtttcgatgcgttggcggttcgcagcacgcccaatacggcaatcgggtcggtgggcgaaatcagcgcgccgaacagcaggcagtaaaggaagctcacatgccagccgaacagggcgaagatgtagtacgccaagctgccgatcaccacggtggcaatcaacacgccgaaggtcgcgagtaggccaatgggccagcgataactgcgcaagtcattcaagttgacgtgcaaggcgccggcgaacagcaggaacgacagcatccagttcatcagcagatcgccgaagtcgatctggccgatcaattgttgaatacgctcttccaggcctggatagccgatgaagctcaagccttgcaggatcagcgaaaacagcagggccgtgaccatcacaccgatggtgggtggcaggccgataaagcggtagttcacatacgtgagcagcgtggtgaggcaaatgaaggcggcgacaagttcaagcatccggggtccctggaaggtgatgtgagcgttggttagtgggtggatggaccgcagcagtggcgggatgttgcaagccaacgggcaaaaggccggcagaaccttttgcggtggcgtggttcatagcggttaagtgcggtgtggcatttttagtgctaaaactctaaccgctggctaaaactacaaaaggaatcagtgatgacggtggctttctggtgtgtgttgatcgcaattttcctgccttacctgtgcacaggtgtggccaagttcagcggcggcaagttcgggccacgccagaaccacgacccgcgtgcttttctggacacgctcgaagggttcgccaaacgcgcccacagtgcgcaactcaacagctttgaagtgacgccggcatttgcggcggcagtgatcattgcgcacctggccggcacggcgtcgctggtgaccatcaatgtgctggcggtgatgtttatcaccagccgcttgctgtacatcatttgctacctggcggactgggcgatgctgcgctcgctggtgtggttcgtgggcatggcgctgattgcgagtttcttctttgtttcgatctaaggcgtaacacacgtcgcttgtgggagcttgcttactgtggtgagcgggcttgtcgtggcgagcgggcttgttgtggcgagcgggcttggcccgcggtgggccggggggcgggccccagggggaacgcgggggcgttgcgcctatgcccagcgggcggcgccgacgggtagagggggcgtgg

SEQ ID NO: 78 - DNA, 29448 bp, Pseudomonas poae FL10F
atggctttccgacgaagttggctcgccgcaaagtgtccaccatgtccccgcacacccgtcaaccatgtgtccggtccgtacacgctgttcaaaagtgagccgccgtaagggcggaacccatagccgccctgatccaaataacggatatgtacccgacggccccgcgccaaccacagtactcaacccggaaaaatgtgtagatacctatggctatcccaggcaagccagctcccggagattacagagcgaacggaatagtcaacttggcccacaacatatcgccttccggccggttcttcacgtcaaactccttggcccagcgcacctcggcactcgcgtattggaggaaggtgaaatacaccgccgggccaatcgcaaacacctgccccttgacgccgtcatccacatcctcgccgtagatattcaccaccgtgcgtccgtactgcttatcgtcggtggtctgcttcaggtagtagccgttgaccccaaggctgaggttgtcggtcaccttgtagctggccgaataatcgaagtggaagatttgcccggagcggtagtcggtgtcgtggttctcttcgttgaagctgtaggtggtcttgatcgacagctcggtgcgttcgttgggcatccaggtcgccgagagcagcggtttgtaggtgtagaagttattgctggtgttggccaggcgcgtggcgtcgtattcgccggtgggcagggtgatttccactgcggcacccagggtcaggtttttgcccatgtcccacaggatgatcggcgccagggtggtatcgcccatgctttcgcgggtatcggacaggccgaacagcgacacctgttgcttgagccagggttgggcgatatagccgcccaggcgcccgccgaaaatgcgcaccgggctcaggtagtccaggcgcgggatgacggcatcggacttaatgcgcacctcggagaccttgccgcccagggagctgatgtccagcttgcgcgcctggtaatggttgtaatacaggttgaaggcgaacatgtggtccggcaggttgttcacgtccaggggcaggatgtagaaaccatcggtgccggggccgatattgtcgacgccgccttcggtggccagggccggcaggctgatcaggctcagcaacgcaagttgcagcgggtgaagcgcacgggtggggttcatgtctggcctcattattattgttagggcactgctgcccttagaaataagccctgggcattcgacagggcagggttttggcggccagatagggggactttgccggacaggtttcactcaggatgcagcggctcttgcaagcgcctatgattaacaggatgtttctaaaacaagaactgaagtactcagtcaggaacccctgatccatgcaaaggaaagccgttgacccgcagtttgaactggcgctggtgtcgccattcctgttgcaaacccttgggcacgtggtagcgcagaagggcgcggatgccgaatctctgtgccgtggcctgggctttaccttggctgacctggatgacccgtcccaacgtatttcctatcgccaggccgtcgcgatgattcaacgcgcgctcaaggtattgcccgaccaagggctgggcctgtgcgtgggcgatcaaaatgtcctgggcactttgggcctgctcggccatgtgatttccctgtgcaagaccctgcgcgatgcctttgccatcggcgagcggcaccagcacacctccgggggcattgccaccacccgcacccatgaaagccttggcgaagtgtgcgtcgacgtcgagtgcctgctgccgtttgcgcaagtgcaggtgtttgcggcggaagagttctttgccagcctgatggtctacggccgcgccttggtgggtgcggatttcaggccgcaacgcgtggagttcgtgcacgcggcgccgccttacgtggcggagtatcaacggctgtttggcgccgatgtgcgcttcggctgcctgcataaccgcatgatcctggcgccgcattggctggacgtgcggctgcccaatcaccacccgttggcgctgcgccaggcgctggaattgctggagctggaaagtgcccagctgcatcagaaaatggacctgatccaggcggtggagcgcgccatttcgcgggacttgcagggcagccaactggagaaggtcgccagtgacctgaacatgagtgggcgcaccctgcgccggcgcttgaccgagcacgggttgaccttcgaagccttgctggaacaagtgcggcgcgcgcgtacgatggggttgctggggaatccggggctgtcgatcgagcgcatcaccgaagaggtcggctacagtgacgtgcgcagttttcggcgggcattcaagcggtggacggggctgagcccgagtgcgtttcgcagtgacggaggagggttggcttagcccgtcgggtggtcccgtagggaggtcggtttagagcggtttcaggaggccgacgaattttctgggcgagcgcgcaaaggtttgctttttggcgaatcaaaaagcgcgccgatcgcctgacgcgcacgtgacaaccggctcatgacggtgccgatcggcaggtcgagcatctcggcggcttccttgtagctgaagcgctcgatgcccaccagcagcatgacttcgcgctggccttcggggagtttctccaccgcctcgataatctgccggtgcatcaagtccgtttccgggttcggtgcctcggggtcgctgacggtttccaggaattcgtcgttccagtccatgcgcgaacggctgcgcaccttgcgtgaacgcagttcattgatccaggtggaatgaacaatcgaaaacatccagctcaacaccgacgtatcgggttgcaactgatgagaacgctccagcgcgcggacacaggcgagctgaaccaagtcttcggcatcgtgcttgtcaccggaaatgcgcagcgcgaacgcccaaaggcgcggcagcagttctggaagcagtgcgggtaagtcagcaccggtgatcgacatatttcctctttttatttcttgctgcctaaaatgatgcggtcaggctacgaggtcgataccgtagcggatgcctgtgtcgcggcgtcctttttgcggtgctgagggtccctgggtgacggtgaattgtatcaatatgctaacaaggtgtatcgattgggatcgtcattgaaaggttattgacagcttatgcatgtaataggccaatgattctgacaatcatgtcaggaaaaatacccagacacatggtgaaacatataagatttattcggccctgggaatattttcacttacagggtgttttcttaaagtatttgtacgtgtcactgagtgtttgctgattgctttaaagtttttatgacctgttgcaacactgaagatgatatcaatatgatggcttgtcgctacccgctgacgggtcacctcggctcacaaagcctgcaatcacacagcaataattgctcaagacaaacggagagataaccccatggtagcggatgatgccttgctaatggcttatgttgacggcgagctttcgccgcaacagaaccaggagctggagcggctcatagacgcttcgccggacctggctgagcgagtctctcggttgatggcgtccaacctgccttatgaggaagcgtttggccgccaaaacgtgccgcctgttcccgagagcctcaagctcagtattgcagccctggctgctcagcattcgacggctggcgacgccaaaaagccgtctacgcattctgctgccgagaacacagaccgcggttttgcacgtctgttcgcgttcctccaacctaaatttgcctggcctgcgctgagcttcgtcgcaggtgcggcgtgttatgccctcgtgcttcagatcggtgcattcgatggcgcctccaagccgggttttgatgcgacggcgccggccgttgcccagacgtctccctgggtgcaacaagcggctgcctatcagcatctgtacacccgcgagaccgttgcctacggcgcccaaccggccgatgtggtgaccaagaccctcgctgatattcgcgctatcgacggcttggccctgcgcgttccggacctcacgtccgccggcctgactttccagcgtgtgcagcgcctgcgcttcaacaacaaggcgttggtccagttggtttacctgccggccaatggcgcgccggtggcgttgtgtgtgatgaaagagcccaagccggaccagtccatcgcccagcaaagcgtcgcgcagatgaacgtagtaacctggcgccagtctgaactgggctacgcgctgattggcgagcccgaacaaggtgtagaccttaacgccgttgcccgacttgtcgccgaccgaagtgccgcccagctgtttgctgacgtgcctgcaccgatgtggatcgccgctatccagaaatgaccatgccggggtcgggcattggttctcaatgtcgtgatcccagatagcgtgatgaaaaaaacctctctgctgaaaaatcgccatcgcctgcctcttgccttcgctgccgtggtagttgcaggcctcggcgcctggctgttgccttctttgtattccccgtcacccacggccgcgaaaatcgtcgatgagatggaagctgtcgccggtggtgcccatcagggctttcgtcgtaaccatgccaagggccaatgcatcagcggccactttgaaagcaacggtaatgctctagagatctcgcgcgcgtccttgttacaacctggcagcgtgccgctgatcggccggttgtcggcagccggtggcgacccggcgcaagccgatgcgcacggcatgatccgcagcatggcgctgcgcctggccggggacgacggcgagacctggtacatggcgatgaattccgtgccggtgttccccgtaaatacgcccgagggcctgtacgagcagttgcgcgcctcgatccctgaatatggcggcaccgggcccgatccgaaaaagatgcaggccttcaaaagcgctcaccccgaaatgcgcgccttcgagacgtggcttgcggcccaccctggctcatcggggttcgataacaccgcctactacagcgtcaatgcttttcgcatgacgaacgcccagggccaggtgcacttcgtgcgctggagcatggtgcctgaggcgcctttcaaacccatgacagccgctgagtccagcgacccggacttcctcgccttcggcttcgccacgcagctggagcaaggccccgtgcgctggcacctgatgattaccctggccgaccctggcgatgtaaccaccgacgccaccgtgcgctggcccgaagggcgccgccagattgacgccggtgtactggtcatcgacagccagcagtcccaggtggagggcgcctgtcgggatgtggacttcaacccgctcgagctgtcggcagggatcgggccgtcggatgacccgttgctgctggcccgcgaggccgcgtatgccgaatcgcaccggcggcgtgtcgaggaagaaggcgctcattaagaaaattcttcagccagcggaataaatcgtttccctcgcttgttctatccccagaacaacttgaacgagggacgtacgatgggcctgcccaccgaagctcaaccactggatttcaccgcgctggcccagcctctgggcgaggccgacggctgtggccggaaccttgagtacgaccccgaattcctcgcgctggaagaggaagccctcggcaagcccgaggtgcaatacggcgacaccatcacccaagccatcgagccgaactggaagcgcgtgatgctgttggccctgccgttgctggagcgcagccgcgacctgcgcctggcgatctggctgacccgcgcgcaactcaacctgcacggtattcccggcctggccgctggcctggagctggtgtatgccttgctggacaattgctgggacggcctgcacccgcaactcgaccccgatgacgacaatgacccgctgctgcgcatcaatatcctcgcgttcctgtgcgagcctgcgggtttgctgcgtgacgtgctcgatgcgccgctggccagtgcccgcagtgtaggtgcagtcagcttgcgccaggtcgacctggcgagtggcgaggagggcgagaatatcagcctggcgatgatcgaaggtgcgtttgccgaggctgatccggttgaactcggcggcactgaagcggccttggcaaaggccctgacgctcagcgtgcagatcgagcaattgctcacggagaaggtcggtgttggccgtgccatcgacctgagcgggctggccacactgctgcgccgtgccggtgaggtgatccaccgtcgcttgccgggtggtgcgccgacggcggctgaaccgctcgcggccgaaccggtaaagactagcgccgcagccgttgcagttgccgccacacccgcgccgcgtggcgagatcaacagccgcgaggacgcacgccagaccatcgaccgtctgtgcacctatttccagacctttgaacccgcgagcccggtgccgattctgctgcagcgggcgaagaaactgatcgacaaaaatttcatggaattgctgcaagacctcgcccccgatggtctcgcgcaactggcgctggtcagcggtattcgcaacagcgacgactgaccctttttgtactaacccctaatcaccggagcttttcctgtggccaaagaaagcagtcagaagttcatcgcccgcaaccgtgcgccgcgcgttcagatcgaatacgacgtggagatctacggggcggaaaaaaccgtgcagttgcccttcgtcatgggtgtgttctcggacctctccggcaagccggccgagccgttgccgccggtggccgagcgcaagttcctggaagttgatatcgacaacttcgacgagcgcctcaagtcgatgaaaccgcgcgtggccttccaggtgcccaacaccctcaccggtgaaggcaacctgccggtggaaatcacctttgaatcgatggacgacttcaccccggccgccatcgccagcaaggtgccgagcctcaaccagttgctcaccgcccgcagccagttgtcgaacctgctgacctacatggacggcaaagtcggcgcggaagaattgctcgccaggctgctcagcgacccgaccgtgatgcaagccttgagcagtgcgcccaagcaacccgaataactgaataaccgttgacgctgccggcgcctcatttggcccggtacgggaacgctttgcccaaaatttgaggataccgtcatgtccaccccgcactcggaacagccagggcagcttgctccggccacggaattcaacgccggcgacttcgccagcctgctgcaaaaagagttcaagcccaagaccgacaaggccagggaagcggtcgaaaccgctgtgcgcaccctggctgagcaagcgttgcaaggcacgcagctgatgcccaacgacgtgctgggcaccatcgaaggcctgatcgcagctcttgaccagaagctcactgagcaggtcaaccacatccttcaccacgaggaattccagggcgtcgaaagcgcctggcgcggcctgcattatttagtcaataacaccgagactgacgaaaccctgaagatccgggtaatgaacatctccaagaacgaagtgcacaagactctgcgcaagttcaagggtgtggcctgggaccagagcccgatcttcaagaagttgtatgaagaagaatacggccagttcggcggcgagccgtatggcgcgttcgtggcggactactacttcaacaacagcgcgccggacgtggaactgctgacccagatggcccgcgtcagcgctgccgcgcactgcccgctgatcacggctgccgaccccagcgtgatgctgatggaatcgtggcaggagctggccaacccgcgtgacctgaccaagatcttccagaccccggaacacgccgcctggcgcagcttccgcgccagtgaagactcgcgttacgtgggcctggccatgccgcgcttcctgtcccgcgcgccttatggcgccaagaccaacccggtggaagccttcgacttcgaagaaaccaccgacgctgccggcgccaaggatttcacctgggccaacgccgcctacgcgatggcggtgaacatcaaccgctcgttcaaacactacggctggtgctcgcagattcgcggcatcgagtccggtggcgtggtggagggcctgccggtgcacaccttcccaaccgatgacggcggtgtggacatgacctgcccaaccgaaatcgccatcagcgaccgccgcgaagcggaactggcgaaaaacggtttcatgccgctggtgcacaagaagaacagcgacctggccgcgttcatcggtgcgcagtcgatgcacaagcccgccgaatacgacgaccccgacgccaccgcaaacgccaacctggccgcgcgcctgccgtacctgtttgccacctgccgtttcgcccactacttgaagtgcatcgtgcgcgacaagatcggctcgttcaaagagcgcgacgacatgcaggtgtggctcaacaactggattggccgctacgtggaacacaacccggccaccgccaccgacgccgacaaagcgcgtaaaccgctggccggtgccgaagtggtggtcgaggaaatcgaaggcaaccccggctactacggcgccaagttcttcctgcgcccgcactaccaactcgaaggcctgaccgtgtccttgcgcctggtctccaagctgccgtccaccaaatccaactgatcaacctgaaaggtaaccaccatgatcctgcttaacttcaaaggcacccaaatcaagggcacttccaccgtcgacgcgcacaaggactggatcacggtcgacgcgatccagatgggcgtgggccgtgcgatttccatcagcggcggcggcaccgaccgcgacaccagcaacccgtcgttctcggaaatctccatgaccaaggccaccgacctggcttcggccgacctgttcatgcaggcggtgtgcggcaagagcctgggcgatgccgaaatccacttcatccagaccggcggcccggacaagaagcaacaggtgttcctcaagctgatcctcggtgaagccatcatcagctcctactcggccagcagcaacggcgagcgcccgagcgaaaccttctcgatcaacttcaccaccatcagctacgagtacgactccttcaccggcgacaccgtgatcaccggcacgccgaagaagtgggacctggaaaagaaccagaaaatctgatccgggcctgcctgtttgtggtgggtgggctgctgtggttgtgacaagcgggcttgttgtggcgagcgggcttgccccgcgttgggctgcgaagcagccccataacagacaccgcgtttccacaggatgccggcgtcgtctggttttggggccgcttcgcgccccaacgcagggcaagcctgctcaccacagcaagcctgctcgccacaacaagcctgctcaccacaaccacaaacggtattggagattgagagccatggctgaactcaccagtcgcgaacgcctgcagccgtccttgctcgatcgcctcagcgatgacgacaccgagcacaccgtggagccgcgcgacaagcgtgtgctgtccatgcgcggcctgcgcaaggcggtgttgcgggacttgggttggttgctcaacagcaccagcctgggcagttttcgtgacctcagtgcgcaccccttggccatgcaatcggtgctcaattttggtctgccggatcttgccggcaagaccgccgccggtttggaccgagaagcgctggggcggcgcatccgccaggcgatctgggatttcgaaccgcggattttacgtgacagcgtgcgcgtggtgccggtggcgccctcgggcgcgacggccagccctaaccagatggcctttgaaattcatggcgagctgtggggccaaccgttgcccgagcgcctgtacctgaagaccgaactcgacctggaagccggtgaggcgcgggttttcgatattgagacaagggacgtgcggtgaacgccaaactgctgcgctattacgaacgtgaactggctcacctgcgggaagtcggcggtgaatttgcccgcgactaccccaaggtcgccggtcgcctgggcctggaaacctacgcctgcgcagatccctatgtggagcgcttgctggagggtttcagctttctcgcagcaagggtgcagctgaagatcgacgccgaattcccgcgttttaccaaccacctgctggaactggtctacccgcaatacctggcgcccacgccgtcgatggccgtggtgcagctgcagccggacatgagcgaaggcagcctggccgccgggttcaaggtgccgcgcgataccgcgttgcacagccagttgggcaagggcgaccagaccgcctgcgaatttcgcaccgcccatgatgtgaccctgtggccggtggaattggtcgaggcgcgctactttgcctgcggcgcccaagtggccggcgtcgacctgtcacgcctcggcgcggtcaaggcggcgctgcgtctgcgcttgcgcgtcggcgccggcctggccttcagcgacctggcgctggacagcttgccgttgcacattcgcggtggcgaagccatgccttcgcgcatcctcgaacagctgctggcgcaggcttcgggggtgttggtgatgcccgtgcaagcgcatgtggactggcaccagttgctgcccaaaagcgcgattcgcagtgtcggttacagcgacagcgaagccttgctgcccagcgggccgcgttcgttccagggctatcggttgttgcaggaatacttcgccatgccgcagcggttcatgttcgccgaggtggcggggctggccaacagcgtgaaccgttgcagcgccgaacaactggacgtgatcgtgctgttcaagaagctcgacccggtgctggagcagagcctcagcgccgccaacttcggcctgtactgcacgccggccatcaatctgttcccgatgcgcaccgagcgtgtgcacctgtccgaccagcaatcggaataccacgtgatccccgaccgcacacggccgatggattacgagatttaccaggtcgaagccgtcaccggctatggcagcggcgccgaggccagccagaccttcgaatcgttttatcgcgccaatgatttgcacgcgcgtacgccgcccaacgccttctaccaggtacgccgcgatacgcgcgtgctgtccgagcaacaacggcgccaggggccacgctccagctacatcggcagcgaattgttcctgtcgctggtggacgctcaggaagcaccgcaccgcagtgatttgcgccagctgggcatcgacacgctgtgcagcaaccgcgacctggtgctgagcatgccggtgggcagtggccgcaccgacttcacggtcgagtccggcgcgccggtgcagtcggtgcgttgcgtggccgggccgacgattcccgcgccgtcgtttgccgaaggcgagacggcgtggcggttggtcagccacctgtccctcaattatttgtcgctgctggaccaggacaaggagcagggcgccaccgccttgcgcgacctgctgcgcctgtattgccgcgttgacgacgaggccgcgcacaaacagatcgaaggcctgcgctcagtcaccgctgaaagcatcgtgcggcgcctgccattgccggggccgatcacttatggccgtgggttgcaggtgtgcgtgagcctggacgagtcggctttcgaaggcgccggcgtatttgtgctgggctcggtgctggaacagttttttgccaagtacgtgtcgctcaattcgtttaccgaaacggtgattaaaagcacggcgcgcggcgtgatcatgcaatggccggcacgggtgggcagatgcgagatcctctaaccctgctcggtgcccttgaagcgcatccggggcgttttgatttctatgctgcgttgcgccaattggagtgcgcctacccgcaattgccgcggatcggccaggccgcgcgcccggcggatgaggcggtgcggttcggccagcaaccgtcgctggcgttcgagccggcgatgatcgcggcactcaagcctggcgtgacgccgaaactgctgctgaatttcttcggcctgatgggcgccaatggcccgctgccgattcatctcaccgagtacatccgcgaccgccagcgcaatctgaatgacccgacgctggcggcgttctgcgacgtgttccaccaccgcatgatcagcctgttctaccgcgcctgggccagtgcccaaccggcagtcagcctggaccggccgggggcggatcgctttgcccaatacctgggctcgttgatcggcatcggccaggcgtcattgctccaccgcaacgccgtgccggacgtggccaagctgcatttcgccgggcgcctgggcccgcagacccgcaacgccgaaggcttggcggcattgctcagcgactacctcggcgtgccggtgcaggtcgagcagttcgtcggccactggatgagcttgcccgccgacggcctgtgcgccttgcgcagcggccccgacgccgccgtactcggccagaccacggtgatgggcaaaaaggtctggaacacccagcacaaattccgtttgttgatcggcccgctggacctcgcgcaaacccgccgcttgctgccgggtggtgacagcctgcaacgcgtgcaggactgggtgcgccaatacgtcggcctggcaatggattgggacgtcaacctgatcgtcaagaaagcacaagtgcccggcctgcgcctgggttccgcgcctttgggctggaccagttggctgagcagccaaccccccgaacacgatgatcggcaattgctgatcaacccccgcatctcttctcaaggacctgcccatggctgatatcagtcgcgtcgcgcttttcggcaaactcaacagcctgtgctaccgggcgatcgaaagcagtaccgtgttctgcaagctgcgcggcaacccttatgtggagctggtgcactggttgcagcaaatcctgcaactcaccgattcggacctgctgcgcctgattcgtcactatggcatcgaccccgccgtagtggcccgcgatttgaccgccgccctcgaccgtttgccgcgcggctctacatcggtcaccgacctgtcgagtcaggtcgaagaagccgtcgagcgcgcctgggtctacgccactttgatgctcggcgaatcccaggtgcgttccggccacttgctgctggcgctgctcaaaaccccgagcctgcgcaacggcttgtacggcgtgtcccgcgagttcaacaaggtcggtatcgacaacttgagcgaacagttcagcgccttgctcaaggactcgcccgaatcgcaaatgaccgccagcgacggctatcagctgccgggtgaagacctcggcgctgttgcccccgccaagcaggaagccctgaagcgctttaccgtcgacctcaccgagcaggcgcgcggcagcaagatggaccccatcgtcggccgcgacgaagagatccgccaggtgatcgacattctgatgcggcggcgccagaacaacccgatcctggtgggcgaggcgggcgtcggtaaaacggcggtggtcgaaggctttgcccagcgcattgcccgaggcgacgtgccgccgagcctgagagatgtgcaactgctcgccctggacgtgggcctgttgcaagccggcgccagcatgaaaggcgaattcgagcagcgcctgcgctcggtgatcgacgaggtgcaggccagcgtcaaaccggtggtgctgtttatcgacgaaacccacaccctggtcggcgcaggcggcgctgccggcaccggcgatgcggccaacctgctcaagccggcattggcgcgtggcacgctgcgcactgtcggcgcgacgacctttgccgaatacaaaaagcatatcgaaaaagacccggcgctgacccggcgtttccagaccgtgcaggtcgatgagccggacgaggcccgtgcgctgctgatgctgcgcggcattgccgaaaccatgcagaaccaccatcaggtgcacatcctcgattcagccctggaagcggcggtgcgcttgtccaatcgctacattccggcacgccagttgccggacaaggccgtcagcctgatcgacaccgcttgcgcacgcgtcgccatcagcctgcacgccacaccggccgaggtggacgacagccgccgtcgcattgagtcgctggaaaccgagctggcgatcatcgagcgtgaaaccgcgattggcgtggacacgctcagccgtcgcgcctcggtcgacgccttgctcgccaccgagcgtgaacgcctggatgaagtggaagggcgctgggataacgagctggcgctggtggagcagattcaacgcctgcgcagccagctcgctgattcaaccgaacgtgacgccgggctggtggagttgcggcagttgcaggacgaactggcggcgcagcagggcgagcagccgctggtgctgatcagcgtcgatgaacaagcggtggcctcggtggtgcaggactggaccggcatcccggtggggcgcatggtcaagaatgaaatcgaaaatgtgctgcgcctggccgaccgtctgggccagcgcatcatcggccaggaccacgcgctggagatgatcgcgcggcgcatccagacgtcccgcgccggcctggacaaccccggcaaaccggtcggcgtgttcatgctcgcgggcacctccggcgtgggcaagaccgagaccgccctggccttggccgagtcgttgtatggcggcgagcagaacgtcatcaccatcaacatgagcgaataccaggaagcccataccgtctccaccctcaagggcgcgccgcccggctacgtgggctacggcgagggcggcgtgctgaccgaagcggtgcgacgcaagccttacagcgtggtgctgctggacgaagtggagaaggctcacccggatgtgcacgagctgtttttccaggtgttcgacaagggctggatggaggacggcgagggccgcatcatcgacttcaagaacaccctgatcctgctcaccaccaacgccggcacccagctgatcagccgcctgtgccgcgacccgcaaaccatgcccgcgccggatgagatcgccaaggcgttgcgtgagccgttgctggaagtattcccgccagccttgcttggtcgcctggtggtgattccgtattacccgctgagcgacgccatgctcggcagcatcattcgtctgcaactggggcgcatcgagaagcgtatcgccgacaaccacaaaatcccgttcagctggagcgacgacgtggtgcagctgattgccagccgctgcactgagctggaaagcggcgggcggatgatcgacgcgatcctcaccaactcgatgctgccggcgatcagtaccgaattcctcaagcgcttgttgctgggcacgccggcgactcaggtgcaggtcagcgtggaaggtggcgagtttgcctacgcgtttgccgaggcggtgaggtaaaccctatggcgacgactcagattcatcgcgagattcaggtcaccagcaccctcggcgccgatgtgctgttgtttcggcgcatgcaggcgacggaggggctgtcccagctcagcgagtaccacgtggagctgtacagcgagcgcgccgacctgaatatcgacgacctgctggcgacccatatgaccgtcgcggtggacttgcccaagggcggcagccgctatttcagcgggcatgtcagccacttttcgttcagcacgcgccagggtcgctactcgacgtacaagacggtgttgcgcccgtggctgtggtttctgacgctggccagcgattgccggattttccaggagctgagcgtgccggacatcctcaagcaggtgttcgcgtcctacagcatcgccgatgtcgacacctcgggcctgagtggcagctacaaggcgctgacctattgcgtgcagtaccgcgaaagcgatttcaatttcgtcagccgcctgatggagcaggagggcatttactactacttcaagagtgccgccgggcgccacaccttggtgctggccgattcctacggcgcgcactcgccggcgccgggctatgcccaggtgcgcttcatgcccgccgaagatcacgccatgcgcgaaagcgaagtgatctatgactggcgcatgggcggcgatgtggagccgggcggctacacgctgcaggacttcgactttgaaaagccgacggccaacctgctggccaagtcgacgctggccggcagttacccgcagtcgcgccatgagcgttacgactaccccggcaagtacaccgagcgcaagagtggcgaaacctacgcgcgcagcctgattgaatcgctgcacaccggcacccagcgggtcaacggcgccacccgcgcgcgcgggctgtttcctggtgcgctgctgacattgaccgagcatccgcgcagcgagcagaacgcgcagtttttgttgctggaggcgcgttatgcgttgtcgtcggacacctatgagccgacgccaccggccgacccggcgccggtgctgagctgcgagtttgtcgcgctgtcgcgtcagcagcagttccgggcgccgtgtgtggcgcgcaagccgctgatgcacggcccgcagaccgccatggtggtgggcaagcagggcgaggaaatctggaccgacaaatacggacgcatcaaggtgcagttccactgggaccgcgagggcaagcgcgatgaaaacagctcgtgctggattcgcgtggcccagggctgggccggcaaacgctggggcagcctgtataccccgcgtatcggccaggaagtggtggtgagctttctcgaaggcgaccccgaccagccactggtgaccggcagtgtctacaacgccgacaccatgccgccgtatgcgctgccggaaaacgccacgcgttcaacactcaagagcaactcgtccaaaggcggcggtggctacaacgagctgcgctttgaagacaagaagggcgcggaacaggtgttcctgcacgcgcagaaaaacctcgaccagcgcgtgctcaaggactccctggactgggtcggtggcgaccgccattccagggtcgatcaggacctgcgcgagaaagtcggcggcgaccggcattcggcggtgggcggccatcgcaatgagaaggcaaccggcgatgtgtcgatggccgccggcgccaacatgatcatcaacggtggcctgaagaccggcgtcaccgcgggcctggacatgtacatcaagggcggcgccaacgtggtgatcgaggcgggcgcgaccatcaccctgaaagtcggctcgaccttcctcaccttgaccccggccatgatcgtcgcgtcgatcatccccttgccgctgcccgaagccgcgtcggcggcgactgccctggcgctcaccgccgccaccggacctgccggcgtgccgctgccgcccaaggaagccgacgatggccaataactgtttttggagcccgctatgaacctgatcctgctggttaaaagctaccgcgaccaaccgatgcccggcgaggtgatttgtcgctttaccgaagtcggtggctccatcgggcgtgggccggacaatgacctgaccctggacgacccaggcaaatacatctcgcgcgtgcatgcgcgcgtcgagctgcgcggtgagcagttttacctcaccgacaccggcagcaaccccagcctggtcaacgaacggccactgggcaatggccgcgagcgcttgctggaggccggtgatcgcctggtgatcggcgattacgcccttgaggtgcgcctggagcaacccgccgcgccggtgcccgaagacgacgccttggcgacacgcatcctgccgccgctgtttgtgccgccaccgccccccgtcgctgcgccgttgccgcccctggaagtaccgcaaccgttgctgcgcgacccgcaagtggtggtgccggtggtgttgcacgacgacctggcaggcgcgcggatactggagggccattcgttgttcgatggcgcgatgccgctgtccgacccgctgggtttgaacccgtcgctgacccccgtgtttcgcggcaccgaaagcgaccacgtggcgccgcagatgcaggcattcaacatgccgctgtggcaggccgaaccgcaggtgattccggatgattacgatccgcttttcgggctgtccgccgggcccacggctgcccgcgatttaactgtgggagtggcggtgcgacgattcgacttgcccgcgatggaggtgaacgataacgaggtcctccagaaagaacccgtcgcccatgagcccatcgcgggcaagcccgctcccacattgaccgcgtccacaggtgataacgcggtgcttcaggcgctgcttgcgggcctcggtttgcccgacctgcacacctcccgcagccccaccgagctcgcccaactggtcggcgaaatgctgcgtgccgccaccggcggcaccatggatgtgctcatggcccgcgcattgaccaagcgtgaaagccatatcgacatgaccatgatcggtgcctattccaacaacccgctcaagtttttccccgacgccgacagcgccctgacccagatgctcacgagtgattcgccggcctacatgcgcccggtcaaggcactcaatgcgtcgttcgatgacctcaaggcccatgaactggcggtgatcgccggcatgcgtgcggcccttggcgcggtggtgcagcgctttgacccggcacgggtcgagcaacgccgcaccacccacggcgcgctcgacaagtggatgccggcacggcgcaaggcacgtttgtgggatcgcctggtggagcgttacgaagacctggcgcgggatgccgatgaggatttgcagcggttgttcggggagctgttttccaaggcttatgaggagcaggtggcgcggatgcgctcttgatctcaaccactttttgagaagaatttatgtcctggaataacaaagtagtctggtccgaaggcatgttgttgcagcctcagcacttgcagcaacacgaccgtttcctgcaaacccagttggaagctcgcgtcgctgccttgcgggcttatggctggggcttttccaaattggaaatcgacccgcagcagttggccatgggcaaactgtcgctgctcgcctacagcggcgtattgcccgacggcacgcccgtcggcctgccatttgacgatgaaatgccgctgccgctggagattcccgacgacgcccgcgacctcaaggtggtgctggccttgccgagcctgcgccccggtgtgtcggaggttgacgacaacccaagctttgaaaatttcgcccgccatcgcagcagcgaatacgaagcctgggacagcaatggcctggacagcagcgcgctgatgagcatcggtaagttgcgcttgcgcctggcgtttgaaggggatgtggccgatgcctacagcgtgcttggcattgcccatgtggtggaaaagcgcgcggataaaagtgtggtgctcgaccgcgaatactgtccgccgtgcctggatattcgcgccgccgaacgtttgcgtgcgtttgtcgatgaactgctcggcctggtgcagcaacgggtagaggcgctggcctcgcgcctgacccggccggatggcagcggcgcagcggagatcgccgacttcctgctgttgcaggtgctcaatcgcagcctgccgctggtgcggcatctgtcggccatgaccggcttgcaccctgagcagctgtaccgcgacctcgcggccctggccggtgaattggcgacctttacccgcgacgataaacgcgcggcttcctacccggtgtaccgccacggcgcgctggcggaaaccttcgccccggtgatgctcgacctgcgccgcgcattgtcggcggtgatggatgtacgcgccatcgcgatcccgttggaggagcgtcaatacggcattcgcgtggccgtgctgccggaccaggaattgctgcgctcggccacgtttatcctcgccgtgcaggcgcagatgtccgccgaaaacgtgcgtaacggcttcccgccacaggtcaagatcggctcggtggagaagatccgcgacctggtcaacctgcaactgccgggcattggtttgcgcccgttgccggtggcgccacggcagttgccgttccacgccggctttacctatttcgaacttgatcgcagcagcgaatattggcaattgctcagccagtcggccggctttgccatgcacatcgccggggttttcccagggctggacatgcagttctgggccatccgcaattaaggcaaggtgactgacgtgaacgacacttttgaaggcggccaggaccctgaccgcaccttgctgatccccacgcctggcgggcgtcgggccgcgccgccgacggctgcggccatcgatacgcaacgggcggcgcctgtattccacggccaggggctcaacccgctggtgcgtgcggccaaccccttgctcgacctggtggtgccgttgcgcacaatgacggcgataccggacatggaaggcctgcgccagcgcttgatccaggcggtgcaagcctttgaggccgaggcccgggccagccaggttgatgtggaaaccgtggctgccgcgcgttacgcgctgtgcacgctggtggatgaaaccatcgccagcacgccgtggggcgccggggtgtggggcagccgcagcctgttggtgactttccacaacgaggcctggggcggcgaaaaattcttcatgattctgcagcgcctgagccaggacctgcgcacccacatcgatgtgttggagttgatgtacttgtgcctggcactgggcctggaagggcgttatcgcgtgctggatcgcggcctggatcagttgggtctgctgcgcgagcgattgctgcaattgatcaaccagcagcgtggcaatcaggaacaggaactgtcgccacgctggcgcggcgccgaggcaccgcaagcgtcgatgctgcgtcgggtgccgttgtgggtcttggcttcggtggcggcggtgctgttgctcagtgtgcaactgacctacagctggttgctcaaccgcgcctctgacccggtgtttgcgcagttgggctcgattcgtgtggcctcgccgctcaaggtcgcggtgccggcggcaccggcgccggtgcgcctggccgggtttctggcgccggaagtggcccagggcctggtggcggtcaaggacagcgccgatcgctcggtgatcaccctgcgtggcgatggcgtgtttgcctcgggcagcgccgaagtgtcgagtaactttgacggcttgctggcgcgcatcggtgatgccctggccacggtgccgggggatgtggtggtggtcgggcataccgacaacgtgcggccgtcggcgacttcgcggctgggctccaacttcgacttgtcccaggcccgcgccaaaaccgtcgcacgcttgctcgcccagcgtgccgggccggccgagcgttaccgcagcgagggccgaggcgaaaccgagccgctggtccccaacgattcagcggcgaatcgcgcgcgtaaccgccgcgtcgatatcaccgtgctgattccttcccaggcgcaatagccatgaacttctctacgttattttcgttgttatggtccccggtggagcgcttcattctgtggctgctcaagccctggctgctgtcgctgatcggcgtggcgttgctgtcgctgctggtgtggtacgaaggcccgctgctggcgttcaacggcagtgagccgctggcgcccgaatcgcggcgctggggcttgattgcgctgtttgtgctggtttgggcgggttactttgcctggcgcctgtggcgcgcctggcgtgccaaccgggggttgatggccggtgtggccgaggcgccggtggtggcgcccggcgtacgtgaaacccaggccgaggtggcggaactgggcgaacgtatgcgctcggccatggccgtgctgcgcaaggccaaccccggctggaagatgagcgggcaatacctgtatcagctgccgtggtacatgttcgtcggcgcgccgggcagcggcaagaccaccgcgctgacccattccgggctgcaatttccgttgcgcgaagccatgggttccggcgccatcggcggtgtcggcggtacgcgccattgcgattggtggttcaccgacgaagccgtattgctcgacaccgccgggcgctacaccacccaggacagctattcggaagtggacaaagctgcctggggcggctttcttgacctgttgaaaaaataccgccgccagcgcccggtcaacggcgtgatcgtggccttgagcgtcagcgatttgctgcaacagcccgacgcccagcgccaggcccaggccgtggcgatccgggcccgcatcaatgagctttacgagcgcctgggcctgcggtttccggtgtatgtgatcatcaccaagtgcgacttgctggcgggcttctcggagtttttcgagacctttggccgcgatgagcgcgcgcaggtgtggggcgtgaccttccccttggcgcaaccgccgcagccggacaccgggttggcgtcgttccccggcgagttcgatgcactggagcgccagttgcaacggcgcgtgctggagcgcttgcagcaagagcgcgacctgtcgcgccgcgccttgctctatagcttcccgcagcaattcgccagccttggcgaggggctgacgcgtttcctaactacagtgttcgaagccaaccgctaccagcaaccggcgctgttgcgcggcgtgtatttcaccagcggcacccaggaaggcagcccgattgatcgggtgctgacctcgctggcggcgtcgttcggcctgggccgcaaggtgctggcgccgaatgtggccagcgggcgcagttacttcattactcgcctgttgcgcgaggtgatcttcaaggaagccgggcttgccggggtcaatcaccaggaggagcgtcggcgccgcctgctcggcagggccgggcggattactgctgcggcggtcttcgtgctgttgctggcggcgatgaccatcagctacaaccgcaacctgcaattgatcgccgatgcctcaagtgctgccaccaacgtcgcgcaactggccaaagcactgccggccgaaggtgatgtgctggtgacgttgcccttgctcaatgctgcgcgcgcattgcccagtggctacagcgacggcgataacagcgtgccgctgctcagccgcatgggcctgtatcagggcaataagctcggcgccggtgccgtcacgctgtatcgacgcttgttgcgcagcacggtgctgccgcacatcgtcgccaacatggaaaatgccctgcgccggggtgatgcaagcaaccaggagttcctgtatgaaaccttgcgcgcctacctgatgctcggcgagcggcaatacttcgatgccgcgtcggtgcaggcctgggtcgatgtggattggcgccgtgaactgccccaggccagcccggcgcagttgcagcaactgtcggaccacgttggcgcgctgctcgaagccgacgacgaagccgagccggtgcagctggacagcgcgttgatcgccaaggtgcgcctggccctggccagcatgccgttgtcccagcgtatctataaccgggtcaagcgcctggtggaacagcagcacctgccggagttgagcgttaacagcgcggtggggcgggatgtgtcgtcgctgttcacccgtgccagtggcgaaccgttgtcccgtggggtcagcggcgtgtaccgcatcgccggttaccgtgagctgaccgacaagaccccgcaggccgtggccgacatggccaaggacagctgggtgctggaccgccaggaatcggcgcaggtcgccggcggcaacccggcgatgcaggcggcggtgctggagttgtattacgccgactacatccgccagtgggacaccttcctcgcggacgtgcacttgtcgccgttgaccagcctcggccaggcgtcgctggtcagccatatgctggcggccagcgattcaccgttgcgcgcgttgctgcaagcggtgtccaaggaaaccaccctggacggtgccttgacctcggccaccagcaaagacaccgaccagcgcgtgcgcgacaagatcgccgccgccacgcaaaagctgcaatcagccctgggcgctgacagcccggcaccggtggcggacgcctcggccaacccggtggaccagcactttgctgcgctgcatcgcttggttggcaacggcaccgggccgcaaccgctggatgacgtgctggcctcgttgaaagacgcagggcagtttttcgacagtgctgacgctgcccgtcgcagcgccgcgccggcaccgtccaatgaagtgctggggcgtttgaagcgctccggcgatacgctgccagcgccgctgtcggccctgctacgggatgtggaatccggtggcactgcgctgacgctgggcaacgagaaagcacgcttgaatgcgctgtgggaggcttccggcgcaccgttttgccgggcggcgattgacgggcgttacccgctggtgcgcagttccggtcgcgatgccaccgccgatgacttcggcaaattcttcggcccgggcgggttgatggatgactttttcagcaagaaccttgcggcctatgtcgacatgagcggcaaccaatggcgctggcgctccaccggcgtcaccccgctgaatatctcccaagacgtgctcaaccagttccagcgcggcgccaagctgcgggatatgttctttgtggccggcgcccgccagccctccatgcgctttgacctgaaaaccctaaatgccgacccggcgctgaccaaggtcagcctggacatcgacggccagccggtggtgtatgacgcaggcaccgtggcggacttcaccagcatctcgctgccgagcggcaagtcgggcggcctggtgcgcctggatgccacgccggcgctggtcagccctctgcgcagcgatggcccctggggttggctgcggatgatggacaaggccgctgtcagcgcccagggcgagcagttgcaactgaccttcaacctggagggccatcgggtggtgtacctgttgcgcgcgagcagtgtgatcaacccgtttcgacgtgatgggctcgagtctttccattgccccagcagcttctaaggattggccatgaatggtttttttggcaaggtcgtcagccacggggactttgtcagtcgccgtttgccagccgtgttcttgaacacctgggatgcatggttgcagggcggtttgcagtgcagccgcgaacgactgggcgcgcagtggctgcaggtgtacctgtgcagcccggtttggcgttttgcactggcggcgggtgtgtgtggcgagcagggttgggcgggggtgatgattcccagtgtggatcgtgtggggcgctactttccgctgaccctcgcctgcgccggcgaagacgtgccgctgctggcccggctggagcgggatgcgctgtggtatgggcagttggaacgcctggcgttgtcggcattgagcgaggggttttcgctggaagcgtttgatgacggcgtgttggcgatgccgcgaccgggttgttgggcgctggcaagctattcaaacgtggcggttacgccgccacgctggtttgaattgccagatgcggagcgaatcggcgagggcatgccgcaactgagtgctcagattgagccaccgtcacggcattcgttgttttggaccgaaggctcgccgcgtgtagcaccgtcagtctgggtgggggaggggttgcccgacagtgagacctttgccgatatgcttggcggctttgacgtaccgtaattctgtggcgagcgtcttgttgtggcgagcgggcttgccccgcgttgggttgcgcagcagccccaataaaaacgccgcattctttcagaaagaacgcggcgtgtggttttagggctgctgcgcagcccaacgcggggcaagcccgctcgccacaacaagcccgctcgccacaacaagcgggctcgccacaacaagcgggctcgccacagttgggtccatcaacctaatgcggcgagttgcgccacggtttccggaaaccgcgccaccaggcgaatcaaggtggtggcctgggcgttcggcttggcgcgaccttgctcccagttttccagggtgcgcaggttggtgcgcaggtacatggcgaacaccgagcgggacaggttgagctgttggcgcacggccaccacctcttcggcggtcagcggggccaggttgttgagctggaccttatgggtgcgcagggtgactttgccttggcgctcgtcggccagggcgtcgaagccttcgaccagttcggaaaagatttcacgtttcatgttgtgttctcgctttgatttccctgtccagcaggtgtttcagggcttttttgtgatggggggccaggtcgtcctgttcgtgtttgccgtacagggtgaacagccagaattgcgtaccgcccgaccaccagtaataaatgacccgcaggccaccgcgtttgcctttgttgcgtcgctcatcaacgaagcgaaccttgcgtagcccaccggtcccttcgatgacatcgcccgcttccgggtttctcatcagctcctgttgaaagccttggaaaagctcgtcgctcagatagtccttgcgatgccgttcgaaggccggcagttcgataaatagagcatccatgttctgtacgtagcctgcgtatagtttgctggcccacgcgcactgggtcaagtgacctggctgtgggaactttcctaaaacgcagacaccatacggcggccctcagcgggtagatgccggacgcggcgacagagggaagcggaattttccgtgatcgaaagaggataaaagcactgcaagcgcgcagagccctgtcggtcgacagggctctgcggggggaagggcgaaaggctttagtaagcggctatcaaaccgtctttgcgcgggtcagttccgcccacatagccatgctgggtgcgctggatgatctgcgcgccaccaaacgcgaacacgccgcttgggtcttcaaccttgatggtgtggcctttgtcgcgcagtgcctgcgccacctgttgatcgaacgcgcgctccacgcacacctcaaggcccgcctcgacccgccagcggggcgcattggcggcggcttgcgggttctgtttgtaacgcaggatgcgcagcatcatctgcaggtgcccttgtgtctgcatcggcccgcccatcaagccgaatgccatcaatggcgtaccgtcggcattcatgacgaagcctgggatgatggtatgaaacggccgcttgcgcggcgcgacggtattcacatggtcagggtcaagcgtgaacgccgctccacggttttgcaggctgataccggtgcccggcaccaccacgcctgagccgaaccccatgtagttggactggatgaacgacaccatcatgccgctttcgtccgccgtcgacaggcacaccgtaccgcctgccttgggtgaaccgtggccggggttggccgcctgctcattgacctgcgcggcacgttcgcgcaaataggccggatcgagtaaacgctcggggtcgaggcgcatatggttgctgtcggtgacgtgatgctgcagatcggccagcgccagtttcatcgcctccagcaccgggtgcagggtttcgacgctgtcgaccggatgttcgccaacgccgagcgcttcaagcatgctcagcccggccagtgtggcgatgccttggccgttgggcggcaactcgtgaaccacggcgccggcgtagggcaccgacatcgtctgcgtccactcgacgctgtgatgggccaggtcatcgagggtcatgacactgccgttggcctgggcatgggcaatgatggcctgcgccagctcgccacggtagaaggcttcgccctgggtatcggcgatgctcttcagggtttttgcgtgatctttgagccacactttctcacccgccacaggggctttgccaccgggtaaaaaacactcggcaaagcccggttggtctttcagtttgtcggcgcccaggcgccacaattcactgatgataggcgtgacctgataaccgtcttgcgcataggcaatcgcaggttccgccagtgtggcgaagggcaatttaccgtagcgttcggacagcgccacccaggccgacaccgcccccggcacggtcaccgagccccagccgagctgcggcatttcggcttgcccggcgaaatgctcgggtgtccagccttcaggcgagtggccggaagcgttcaggccttgcagttttttcccgtcccagacgatggcaaacgcgtcactgccaatgccgcagcctgtgggttcgaccacggtcagcaccatggccgcggcgatggcagcgtcgaccgcattgccgcctttgcgcagtatgtccaggccagcctgagcggccaggggctgggagcaggcgaccatgttgctgcccatgacgggcgagcgcgcggacggatagggttggctgtaatccaggtcatcaaacatgagtggctctctttcggcagtcgtcaatttttgggggccagggcgtcacgcagaccgtcctccaacgtgcgccgcttttgcgtgcgcttgggggtgggtgtaaatcggcttaaatgtgggagctggcttgcctgtgatggcggcctctgggccgaccagcagggtgggttagtacgagtacatatccgttgctgcggtaacggcggcttagggtttcgctcttacagcgagtcacttttgtaaagacacaaaagtaaccaaaaagtcttcgccccaccactcggcacctcgctcacgcttcggtgtgccctcactccggcttgaatccgtgggccgccgcaatgggccatccctggcccagtgcggctaacccggcgtcctgccgggttacccacggattcaagcctgcgttcggccagcgtggttgatggggcgattccagatcaagatcaagatcaaaatctacagcacggcggcctagtagccgacctgagtggttgaagcaaaagcacagcaaaagcagggcaaaagcacatctacctgattgactgagatccaaaatgtgggagcgggcttgctcgcgaaggcggtggggcagtgacacatgagctggctgatacaccgctttcgccagcaagcccgctcccacagttttgaccaagttcgaccgtcagtcctctgtgctctgcttttctgtgggagctggcttgcctgcgatgcaggcacctcggtgtatcaggcagaaccagttgatgccatcgcaggcaagccagctcccacatgtgattgagttcagcttcaatgaaaaggtcggctgtcaggccgcctcggccttgcttttgatctaaccactcaggtcggctactaggccgccgtgctcttgcttttgatcttg

SEQ ID NO: 79 - DNA, 27911 bp, Pseudomonas poae FL10F
cagtgaaacgatgcatcgccgatggtagtgtggggtttccccatgtgagagtaggtcatcgtcaagattaaattccaaaacccctgtttgctgacgcaaacaggggttttgttttgggcggtcggaaaggaaccgcggtgccgataaggcttacattccgccagcccattaaagtaacgcgctgcacgggtgtaagagccacccgtttagatcgatccctccagtttctcccgacaaatttgcacagttatttctgaaccagaccactagaataggcacctaaccttttttagagttcgagccctatctatgcccgatccagttgatacccttaaggtgtcggacttaccactggaggatctggtggcatgccacgagtgcgacttgctgatgcgcaaacccgtactcgccatcggtgaaaaagcccaatgcccgcgttgcggttacgagctgtacgctcaccgtcacaacgtcgttgaacgaagcctggccctcgtgctcgcggcgctgctgctgtacatccctgcgaactttttacccatcatgcagctcaatctactcgggcagtcctcagaagacaccgtgtggagcggcgttgtcggcctgttcgataccggcatgcaaggcgtcgcggccgtagtgttcctgtgcagcatgggcattcccctgctcaagttgctctgccaactggcagtgctgctcagcattcgctggaaggtcggccgcagttacgggctgttgctctaccgtatttaccatcacctgaaggattgggggatgttggaggtgtacctgatgggcgtgctcgtggcgatcgtcaaactcgccgacatggcctccatcacgatcggcctgggtctgggctgcttcatcagtctattaatggttcaggtactgcttgaggtggtgatgtcgccccaccagatctggcaagcgttgtcaggagaggatgatcatgcgggcgattgatgcaggcattctgatttgtaccgaatgccacgagttgaacaagcaagaggccgataccgatgagcagctctgcacgcgttgcggtgcattgattcatgcccgccggcccaacagcctcacgcgtacctgggccctactgatcacagcggcaatcttgtacatccccgccaacctgttgccaattatgaccatcaactcccttggccagggcgatccaagtaccattatggccggcgtgatccagctggttcagcacggcatgttccctatcgccgcggttgtgtttatcgccagtatcctggtgccgacgttcaagctgatcggcatcggcctgctactgttttcggtgcagcgtcaccagccgctgtccgcgcagcaacgcattatcatgtaccgctttatcgaattcattggccgctggtccatgctggatatcttcgtgatcgccatcctggtggcggttgttaactttgggcgacttgccagtgtcgaggccaatctcggtgctgcagcgttcgccagtgtggtgatcttgacgatgcttgccgcagtaacttttgatccccgactgatttgggacaacacggagtcggacgacgaccatgagtgatttgccaaaagctaaaacccgcccagcctccaactggtcggccatttgggtgttgccactggttgccctgatcatcggcggctggctggggtggcgtgcctactcccagcaaggtctggagatccaggtgcgctttgaaagtggcgaaggtatccaggccaacaagaccgaagtggtctacaagggcatgtccgtcggcaaggtcaagaccctggccctggacgacgagggcagtaatcgcggggtgattgccaccatcgagatgaacaaggatgttgagcagtacctcaagaccaacacacgcttctggctggtaaaacccagcgtcagccttgccggcatcactggcctggaaaccctggtctcgggcaattacattgccgccagcccgggcgacggtgaacccacccgcaagttcaaggccctctccgaagagccgcctttatccgacgccaaacccggcctgcacctgacgatcaaggccgaccgcctcggctcgctcaaccgtggcagcccggtgttttacaaacagattcaggtcggccaggtcaaaagctacctgctgtcggaagaccagagcacagtcgagatcaaggtctacatcgagccgacctacgccagcctggtgcgcaaacacacacgtttctggaacgccagtggcatcagcatcgacgccaacctctccggcgtcaaagtgcgcagcgaatccctttccagcatcgtcgctggcggaattgcgttcgccacccccgagaatcgcaaggacagcccgccgaccgatccaagcctgcctttccgactctacgaagatttcgacgcagccgcagccggcatcaaggtcaaggttaaactcaccgacttcgagggcctgcaggccgggcgtacgccggtcatgtacaagggcatccaggttggtagcctgaaaaccttgaagattgacccggacctgtccagcgccaatgccgagttgaccctcgacccactggccgaagactacctggtgcaagacacgcagttctgggtggtcaaaccgtccatttcgctggccggtatcaccggtttggaggcactggtcaaaggcaactacatcgccattcgccccggcgacaaaggcagcgctccacagcgtgagttcgtcgcccgggccaaggcgccaccgttggacctgcgctccccaggcctgcacatggtgctgttcaccgacaacctcggctccctggatgtcggcagcccgatcctctacaaacaagtcaaagtcggttcggtgcagagctaccagttctcgcgcaaaaacaaacaattggtgatcggcgttcatatcgagaaggagtacgagaacctggtcaacggctcgacgcgcttctggaatgccagcggtgtcacgctcactggcggcctcaccggcggtatccaagtgaaaagtgaatccctggccagtctgatggccggaggtatcgccttcgaaaccccggaaccgaacgtaccgctgaaaaaacgtatcccgcgtttccgcctgtttgccgaccgcgaggctgccaaccaacatggcaccctggtgaccatcaaggttgaccgcgccgacggtctgcgccccggcacgccggtacgcttcaagggcctggacgtaggcaagatcgaaagtgtcgacctgagtgccgacatgcaatcggtattgctcagcgcgcgcatcactcaagtcgccgatcggatcgcacgcgcgggcagtcagttctgggtggtcaagcctgagctgggcctgatgaaaacctcgaacctggaaaccctggtgaccggccaatacatcgaggtacagccttcggcgaaaaacgccggcccgcaaaaggccttcgtcgcgttggacaaaccaccagaggcagctcatcaggaagaaggcttgagcctggtcctcagcgccgcacgccgcggctcgttgaaagaaggcgtaccggtcacttaccgcgaagtcaccgtcggcaaagtcaccggctacgagctgggccagaccgccgaccgcgtgctgatccacatcctgatcgagcccaaatacgcgccgctggtacgcagtggcagccggttctggaacaccagtggcttcggcctcgacttcggcctgttcaaaggcgcgacggtacgtaccgaatctttggaaacgctggtcgcgggcggtatcgccttcgccacgccggacggcgaacgcatgggcaacgcggcacggccgcaacaaaccttcccactgtttgataagtttgaggatgaatggctgacctgggcgcctaagattccgctcggcaaataaaccgaggcgcgtctatcgcgggcaagcccggctcccacaggcgatatgcattccaatgtgggagcgggcttgcccgcgatgaggccatcagcaacaccgcaaaaaaccaacaaaaaaggccgcgatccataaaatcgcggcctttttgcatttcagctcagccgatcaaacctcatccaactccggctcatccgcctgcacattcaccgtggccttcaccacatcgtggcgacggatgtacttccaatccgcctcatcaatgtagataccattcggcccgctgccgccttccaggtcgatcgccacttgggcggacacctgcggcttcacactggccagaatcggcacaaatcccagctgcaagctggtttccagcaacgccgcctggttcttctcgtcgatgtccgccgcttcatccaggtagtacggcaagcgcacgcgccctgcctggtcacggtccatcaagtgcaacaacaagtacatgttggtcagcgccttgatggtcatggtggtgccgttggacgccgcgccgtcgatgtcggtgtgaatcaccggctggccgtgcactttggtgatctcgaacgccagctcgaacaagtccttgaggcccaactggttatggttggcggccacgaggcgggccaggtattccttggcctcttcgttcttgttgtcctgctcggcgctctggctgagatcgaacactgacagcgtctcgccttcttcatactgaccggcactgtggatgatctggtcgatatgcttgagggcttccttattcggtgccagcacgatacggaagctctgcaggttggacacctggcgcttgttgatctcgcggttgaacaacgccaactggtgttccaggctgtcgtagtcgctgcggatattacgcaaggtgcgcgcgatatcggtcacggcggcacggcgtgccttaccgagggtcagcgcctcatcggtacggtgcgcatacgcattgatcagcagttgcaggcgacgctcgacgtcatcctcgctgtcgaacttggccacacctttgagacgcacctgcgcatacaaggcttcgatctggccatcggcgcgcagcaggccttgccagctgtcctgatagtcattgagcagcggcagcaggttgtccatggagtcgtcgaccgggtccatgaacggcgtgccgaacggcaagtctgccggcaacagctggcgacggcgcagcgcatcatccagcgtgcgttgcttggcttccatatcgccgatctggcggcccaccagttgcagtttggccgacagttgctgcacgcgttcggtgaaggcatcgctggagcgcttcaactcatcctgcgcggcttccatctgcgccaggttttccagcttctcgccttcttcggcgctcagtgtctgcgcgcgacggaagtcttccagcgccttctgcgcatccagtacctgctggtacagcgcttcggtctgggtcttgctcgcggcacggtcagaggctacagcctgctgggtcttgagctgcttgagttctttttccaggcgctctttctggtcgcgcaacgccgcgcgatccgccagagcctgcaacgccggtggctcgatgtgggagatgtcgatggacagccccggcacttcaaaacgctcacctttgaaaccgtcgaggatctgctccagggatttaacccactggccgtcctcatccagcgtaatgccatgctcgcccaatggcaggctgaacaacgaactgttgaacaagcgcatcaaacgctcgacatcctgttgcgaaaattcttcgcgcagtttggcgtagctgttgttatcggcatgatcaagctgctgcttgaccgacttcaagcgcttttccaaatcgcgcagacgctcgtccaggtcctcggcgctgaactgtcgcgactgcgccagggcacccgccaattcgtcgtgggcatccttggccgccagcaattgctgctcgagcaccttgacgtcatcgaccaaggcaaaacgatgcttgagcaccgacagctcgcccagccaacgttgaatgccactgatttcccgctccagacgcatcagctcctgggtgccgccacgctgatcgttttgcagcgcgtcctgctcattgcggtagtgctcggcctggatggtcagctcttccttgcgcgcactggcgtagtccgaccaggtgccgagcaacgagtccagcagcggcgacaggcgatgcaatttgccgcgcaaaatgtcgcgctgtttcacgccgttggccaaggcttcaaccagcggaccggcagctaccagcgagtggtagtcctgctccatacgtcgcacatcgcggaaggcttcttcgcacgcggcgatgtaatccacgctgccggaacgcaggctgtgctcgaaggcatccaggaacaactgcttgagcttggccgcggtgatttcgcgcatgtgcagcaagttgataaacagcgcgcggaaggtcttcaggctctgctcgctggtggagcgcagcggaatcagggtcaggtccagcgggatcgatgtgtggccgcccaccagcaaacggcgcagttcatccggcttgagttcgtaggctttcaggccttcgcgctcaaggttggtgaacagctctttctgacgcaggcaggtgtcgttcttctggtaatgcgccaggtccagcttgccggcataggcaaagaactggtggccaaaaccgccgcccgggccgcgtccgaccacaccgatcacgtgcgggccgtggggcagggaaacctccacgaggatgtagctggtgtcggtggcaaagtagaagcgccgcgattgttccagggtgtacttgccgaaactcatgtccgacatgcgcgccagaatcgggaattgcagggcgttgatcgacgcggatttacccaggttgtttgcgccgtacaccgacagcggctcttccagtgggaacaggcccaaactgtaaccggcggtgttcaatagggcgaagcggcggatgccgtagcgttccttactcatgcatcggtctcctgttcttcggcaatggcgcgggcaagggcgtcttcttcgctttcttcagcgaagtcactgaggtccagcgggtcatcggtcttcagcagtttttcatcgctgtcttcgtcgatgatcaccggcgccggcaatggcaacacgctgtgcacactggccgcgaggtcgcggtcctgctgcaccgacaggcacacgtcgaggaaacggtgcatcggcggcaggaagcgatacacgccgttgtcttcgctggcaaaacccagttgggtcatgcggcgcatgattttttcttcgagttcttcctgggtctgcacttcggcctggataaacaggtcgcggtacttctccagcagcgacggcaactcatcgcggcccaggctgccaccgtcgagcacggcaatcgggtcacggccctggtcggccaagtgctcaacgatgatgaaggtgaacagcgccaggcgttgggcggtcttgttcacttgcgcggcggccacggcggtgtccggcacgaagtagtagaagccacgcgtgtcgcacaccagctcaaaacccaaggccttgaacagcgtgcggtactggtcctgaaagttcgacagttgcgcgtacagctccgggtcacggcggctgacgtggtaacccttgaacagctcgcgaaagatcggcgccagctgggacagttcggaaagatcaagatgcataaggtgtgctcgcagaattctcggtagcgtcggcgccggccgggagcagggcgaatgagcgcaggctgaccaggtgctcgtgtgtgtggtaatcgcggcgttccaggcgttcgcgcttgaagcgtttttcacgcgagagtcgcgagaaccagtacagcaattcgtcggtggcgccgtctggttcctgctccagcagccaggtcatcaggtccggcatcggcagcgcgtcttcgcagcgctcgagcatttccttgaccgtgcgcggtgcgcgttgggcgtcgcccttgtaggatttgtgcgctttggggaatttcgctggtttcggctcgaagttcgccagcgcgtacacataggcttccacctggctcgcgctgccgagaaaggtgctttgcggccgcgtgaacatcggcatcgccgcctgaggcaccgcgtccaggcctttacggcgaatggccgacagggccagcgccgcaccacgggtcacggcgttgtgccggcgcgcttcttcacgcagcggcagcagcaattcgcgggcgtgacgcaaggtcagctgggcgctggtttgcatttcgaggatgcgcgcgtgggtgcgcagcagcatgtcgtcgtcaaccaggtggccgaggcgctgttgctcggtgagcatgcgcaacagcacattttcgaccttgcgcacgccttgttcgaaggcgccgtcggcgttcaccagttggatcatcggttcgacgtactcatcccaggtcgccaggacctcggcgtaccgttggcgcaaagggatctgccggtcgctggtcttggcacggtcggccacggcggcgagggcttgttcgtcgttggcgagctttttcagtacatcgcgtacgcgcatgtccaacaggcgcagttggcgggccaggtcgtggccatcgcggatgtcgaaggcgtcttggatgtagccggccaggcgctcgaggtggcgcaggtaggcttcaatttccaggcacaggccaagccggtgctccttgcgaagataggcgagaaagtcgtggatctgcgcgttgagctcgaaacggttcgggctcttggcgacaggcaccaggatatccaggcgaatccacacgtccagcaggctggtgatgtcctggggcgtgctgtccagttgttgggccgccagttgtgcgcgcagctcgcccaggctcagggtgccttggtcgaagtgttcgcacagtggctcaagcagggcccagtgttcggcgagggcgcgcaagacgcgcttgggttcgatcatcggaatggccggctggttggcgattaaaagtcgcgattgtactgcatcgggcgcgggatttatccacagccggtcagtgcacagtgggcgattgttaccgaacagcggtagaatccccgctctttacttatccacaagtggccgagctgtgcttatcgagtcccgacgtcgcgcttacttgaccgccatgcaggtggtcaactggctgccccgcaccgaactgccgtttgccgccccgtcgcggcccgagctgctgcaggcgcttgagccctatgaggcgttcgaggtgtcgggcgaggaagcggccgcgccggttgccgtggtcaagcccacgcccgaatcgcgccctggcgttgagcgggtgaaggtcgaagtgccgcgcccggcgcccatggccaagccggtggtcgccgaagcagtaacgccggtggccaaggccccagtggtgccgccgccgcgttttgccctgcaattattgcgcgccgggcgctgcctgttgctggtggagttacccacaggcgagcgcttccagacccgcgacccggcgtacatgctgctcaaggacatgctgcgcgctgccggcctgcccgacagcccgcaaatcgtcggcgacccggtgcgctggccgctgctggttcgcggcaccatggatcaaggcccggaagccgcgcgagattttgtccaggggtttgtttcggcacgcctggaagacgaaccctgcgtgtgcctgtggttgatcggcctgcctgcggtgcggtttgccggtgaagcgaatgccgaagcctggtatcgcgaactgcaggtcgaaggcctgggttcggtgtgggccttgccgggcctggaattattaatggaagagccacagcgtaaggctgatgtctggcaagccatgcgccggctgatggcgcgctggaaaacgaccgatgagtgaggctttatccttccgcccgatgaccgaggcggatctcgatgctgtactgaaaatcgaatacgcggcgttcagccatccctggacccgagggatttttctcgatgggctgggcaagtaccagatctggctgatgttcgaaggtgagcagcaggtgggtcacggcgtggtgcagatcattcttgatgaagcacatctgctgaatatcaccgtgaagccggaaaaccagggccgcggtctgggcctggcgctgctggaacacttgatgtctcgcgcgtatgccgccagtgcacgggaatgcttcctggaagtgcgcgacagcaataccggggcgttccgtctgtatgagcgctacggtttcaatgaaatcggccgtcgccgcgattactacccggcggtgggtggccgcgaagatgcggtcgtgatggcctgcaccctcgtcgactgaacaaacaacccaatgtgcaagcaggcctcagtgggagcttgcccctgtaggagccgggcttggccgcgatgcaggcgcctcggtgtctcagtgagaccgaggtgatgccatcgcaggcaagccagctcccacaggggcattgtttgccattagggcaatgttgtgtcagcggttaccgtcgaccgggtcgacatcggccaattcggcctcatccagcccgttgccgccgccaatctcatcttcatcgacgatgctcaagtcgaaatctgccgggttatcctcgccttgctcccgcgcatcccgcgcgccatcctcacggatcagcgtttccgggctcatgtcatcgtcagttggctcatggtccgccgtcgatgcgccggtcatgcccgcttcgcgtacccgttcgtcgggcatcagctgctcgcgctctctcggtggaatctcatcaccgatttcggccgtcggctcttcctcgtcaaagtccaactcgcgcatcgagcccatgcggtcttcgttgtcatcaatcggttccggctgtgtagcgccgtagggacgtcgtgattcagtcatggccaatcctcatactgtggggcttatagtgtgtggacaggcacggcgccctaaaaattcaagctaattgacgctttgcgtgacccggacgagcggttgtctgtcacacagctgcgcatcattcctgaggctttccctgatgaacgaactacaagacctgcttgataacaacgaacgctgggcggacgcgatcaaacaggaagatcccgaattcttcgccaagctcgcccgccagcaaaccccggaatacctgtggatcggctgctccgacgcccgcgtgccggccaacgagatcgtcggcatgctgccaggtgatctgtttgtgcaccgcaacgtggccaacgtggtgctgcacactgacctcaactgcctgtcggtgatccagtacgcggtcgacgtgctcaaggtcaaacacatcctcgtcaccggccactatggctgtggcggcgtgcgcgcctcgatgcaggaccgccagttcggcctgatcgacggctggctgcgcaccattcgtgacctttactacgaaaaccgcgacgtgctggcccagttgccgaccgaagaagagcgtgtcgaccgcctctgcgagctgaatgtgattcagcaggtcgccaacgtcggccacaccagcattgtgcaaaatgcctggcaccgtgggcagagcctgtcgattcacggctgcatctacggcatcaaggatggccgctggaagagcttgaacaccaccatcagtggctttgagcaactgccgccgcaatatcgcctgcgcccgttgggtgacgcttaatcgcgtttgtcacggtcgcgctgctccaggaaccgctggccttccgggctgagctgttcctctgggcctttgatccagccccggcagttggggctggcgcattcacaggcgaactggcgggggaggacgtcgccggtggtggcgtagtcaatagtcagccaggtgtcggcggcaatcggcatgactgaccagagctccagataggacgtgtcgaagtacacattcggctcgcaggagtgttgcagctggccgcacacccacgggtcatacagccggatgcgcgccgagatctggaaggtatgcaggcggcgctcgctcaacgcatagccgaacaccttggcgatgagcgtgcggctgtcgaaggccacgcgagacttgatgcccatggcttcgcctttctcgtcgcgtaccagctcaaattggcgggtcgacgggtacccgcattccgccagcgttgtcgcaaacgggtaaaggcagtcatcgtccgtgccagcagccttatccttggcttgagttttcatcactctccttgggtgggctgcatcgacctgcgaatggtgtctgactgccagtcttgcagcgaatgggcccagctcaagactcgccgaacagatagccgattgctactgtcaactttgacagtagcaatcggctattttttatgcgcactacaaggcgggtgcggtgatggcgggcgttggggcaggagtcttcagctgtttgagctgggccttgatcgggggcgtggcgcatttggcgttggcttgctccgaggtcaggttacgcaccgaggtgtagaacagctcacaggtctgctccttgcgcgtgacctgccaggtgttgatgcacgccttgagcaacacgttcgggtcgctggcaggtttctgccccatgccggcctgccaacaggcagcgctcaagtcttgccccatcaccttcaagccggcttcgtcggctttttgttcattgccgtcgtaggttgccgggtctgccgcataccaaatgtagctcgggtggttggcgcccagcaccgacacggttttgcccgccgccgggctgatctgcgccaggcccagcacgcccactgtctggccgtattgttgcttgatccagctgcgcaccggtgcgccgaacgccaccatcggcaatgagccgctggtgcgcaggctcagttccttgaccatgcgtgtctgatagtcggtgaagtagctgtagacgctttcaaggtccttgcccgcgttggacggtgcggcgatcggggcgatatcgatgatggtctggtaggccggggtttcggtagccgggatgccattgtcggtgagcaaggtggcccaacggtcagtggtggccgattccaggtaatcctgggcctgggtcagtgagtaatccggcgggaagtgcagcagctcgatgcttttgcggttttccagggccatgcccagcggcaggaacaagtaccagttgtaagcccacttgccgtcgctgttgagtttgctcgcgccttggtaggcaaggtcagcggtattgagcagcgtggtcaagggctggtcgtagtggtcgggcacgccgctgaaggtggcggagacctggccgtcgtgggttttcacactcaccttggcacggctgtagccgtcgcgttgcaggctctggttcaggtaatgctcggcggtttgctccagcgaccatggccgaaagcagatcacgttgcagttattggggaacgcgaacaactgggtgacgcgttgcgtgctgcccagtggtacttcgatatcggcgtgtacgaccgcactggccagcagtgcggccagggtgaaggacagcctggtcggtttaaacatagttggttccttgtcagcgaaagcccgtctgcgcggggtgaaagcccaccccccacacagtagcggctgacccgtaaaaccgcgtgttaaatcgccaggcgtgtcgcttttggataagaaaccctacaccttgaattgcaacgcgttgctcaagtcgcccatgggcttctggccacgggcggccatggcgtcatcgcgcagcttgaggccgtcgagtttctccagctggaacactcgggtgatcaagcgcaggatcgacgcggtgtcgtaaaccgtgtggtccaccgtgcctttgcgcgcaaacggcgacaccaccagcgccggaacgcgtgtgcccggcccccagcggtcgcccttgggcggtgcgacgtggtcccaccagccgccgttttcgtcgacggtcaccaccaccaccatatttttccactgcgggctttcctgcagcaccttcaaggcgcgggcgatatgacggtcgcccgacgccacatcggcatagccggcgtgcatattcaggttgccctgaggcttgtagaagctcacggcaggcaacttgccggcctcggcgtcggcgaagaatttgttggtgctcgactcatcacccaggccgccgtcacgcaggcgtttatcccgctcgacgcggttctctggcccttgctgcttgaagtagttgaacggctggtggtggtattggaagttaggaatctttggaatgccgcccgagtccttgtactggtcgagggtcgcttgccatgccccggcgtaccaggcccagtcgacgttctttttcgacagcttgtcgccgatgtgctcgtgggtttgcggcaccagcacgttgggcaggtcgggtttggaatagtccgggttttccgggtcgcggatccaggtcggccaatagggcggggccaaggtgttcacgccataaccatcgggcgtcagcgcgctggggccgaactgcggcgggccggtcatcgcgctggccggggacttgtccagcggcttgaggcgcgggtcggtggggtcatcgctttgcagcgtggcgatctgcgccttggccaccgattgggcggcgttcggataaaacggcgcggtggcgctgatcaggtactgatggttcaggaatgagccaccaaatgcgccctggaaaaagttatcgcagagcacaaattccttagccacatcccacaggcgcagggaataacggctctgggcgtaatagcccatcaccaggccgccggaatcgccccaggcgacaaaattgtcgttcttgccgccgttgatctgcatctggttctgatagaacacgtgccacaaatcgcgggtgaccaggctcagcggcaggtcttcggcgttcgggcctttgagcgcgaagggcgcattgggcaggttttgctggaattgcacttcgctggggtaagtcaccccgtccacactttgcgggccgacttgcaatacgccgccccaggtgggtggcagcgtggtcagcaggctgccgtcgcggtcgcgttgttgcgcatccgccgcagaaagcgccgacaagggtttctcaactccagggaagtccgcaaacaaattgttgaagctgcggttttcggcatagatcaccaccacggttttcacctggtcgtgcaaggccttgtccagttcctgtggtgtgagcggccgcgtcaccggcgtgctcggggcctcgctggtattgccgcaggcactcaaggtcgcgccgacccccagcaccgccgcgcccccaaggaaacgccggcggctggtgtccaccggcggttgggcgatggaatcgggggaagggcggtcttcgtgctcgtcactcattgctgggagtccctgcggggtggttgttgcaagatatttcgcaggacggtagcaatggaatatgacgaaaagaagacagttatgccgatgagacgattacagcaggctcagtaccaaatggctgccggcacgcaaatactccacttgggccgtcaccgcgtctttgacgatggcttcgccagtagcggtcaatttgagttttttcgcatcgcggacactggtctgcaatagctgcatggcgacatccatggctttttggaaggctgtgacgttgttatgcagaccaaactcctgaataacggcagccatgcgtcgatccgcgtcgtctcgcagggtgatgtactcacagaacgatacgtggtcgtccttgtaaatttctttgagcaactcttccagcgatttggataggggcgtcatcggatgttccttggcttttgtgagagggaatccgagtcaggttaatcaaaggcgattgtcgtggaagtcagggtttgccgtcgcgtgaagtgggaaaaccctatgcagttcgccgggggacggcaattcaatgtgacggaatgaagagatggatgcgaggagccaggcatgtctacacgcgccgagcactgctagactggctcgataatggatgtcaccgaggtgaaccgtgaaaccttcaatcgcccttgatctaaaacgagccgctgtcagagaagttgtcggccgttttcgcatctcaaacccaagagtatttgggtctgtattactgggtacggatcaagaaggcagtgaccttgatttactggtcgatgctccgccaggaaccaccctttttgatcttggtgggcttcaggtagagcttgaggatttgctgggcgttcatgttgacctgctgacgcctgccgacttgcctttgaagtttcgggaaaaagtgttggctgaggcgcggccggtatgacggcaaatcggctcggggattatctggatcacataaggcaagcctctacggacgcgatcacttttgttgaaggtttgagcaaagaggcgtttctggaggacagacgtacccaacaagccgtggtcatgagtctgatcatcattggtgaggcgtcgacaaaaatcatggatcagcatccggacttcactgtgagccattcacagattccttggcgtagcatgcgtggcatgcgcaaccgaatcgctcatggctacttcgatatcaacctcgatgtggtttgggatacgatccaaagcgcattgcctgacctgttgaggcgccttccagtggctcatccatgactgcacttgctgcaacaacaagtgcagtcagccgctgatcgcgtattacggcatcaccggcggcaaatatttcaacgtcgtccccagtgcccacaacaggaacaacaccagcggcgtgtgcaccagcaactgcacaaacgaaaacccgatcagatcccgcgctttgagccccagcacgcccagtagcggcagcatatagaacgggttgattaggttcggcagcgcctcggcggcgttgtagatctgcaccgcccagcccaggtgatattgcaggtcattggctacttgcatcacgtaaggcgcttcgatgatccacttgccgccgcccgacggaataaagaagcccagcaccgccgagtacacacccatcaacagcgcgtaggtgtcgtgggacgcgatagaggtgaagaaggtcgagatatggtgcgccagggtttggccgtcgccgcccttgaccacggtcatcagcgccgcgatggagccatacagcgggaactggatcagcacgccggtggtggtcggcacggcacgcgccaccgcatcgaggaagctgcgcgggcgccagtgcagcagggcgccgaccatgataaacaggaagttataggtgttcagccccgagatcgcgctgatcgccggtttggtcgagaactcatgaaacagccagccggctgccagcaacgccagcaaaatggtcaacagcgggctgtgttccagccattcgccggggcgggttggcgcttgaaccttgggcaggttgaaggccgggtcgacgccgcaggcttttgcatcacgggcgctgttcggccctggcgcagtggcgtaggcgatgatcagcgagaccacgatcagcgccagcaacatcaccccggattgccacaggaagatcgtgtcggtgaacggaatcaccccggtaatcgacagaatcgacggtggcaaactggccgggttggcctgcaactgcgcggccgacgacgacagccccaacgcccagactgcgccaaggccgaggtaggccgcagcaccggctgcgcggtaatccatgcgcaaatccgtacgacgtgccagcgcgcgcaccagcaagccgccgaacaccagggacaagccccagttgagcaaggaggcaaccatggaaatcaacgcgacccaggccacggctgagcggccgttcttggggatgcgcgccaggcggtcaatcagcttcaccgccgggggcgagctggccaccacgtaaccgccgatcaccacaaaggccatctgcatggtgaacgggatcaggctccagaacccgtcaccaaaggctttggcagcctcggtcggcgcggcgcccatgcccagggtcgccacggcgacgatgatcaccgcgagggcggcaaacacccaggaatcaggaaaccagcgttcggcgaagttggaacaacgcagggcaaatcgggcatagcggctttcttcgatagcatcggccacgaggcattcctcttgtatttattatgggtgttggcagttttacggcatgttccgctacggccattgataagggaatgcagttatcttcatcgatccatgagtaaaacaaatatatctgtcgcgattgccatgattgggctcagctcataacctgcacgccattttgtttgtctgccgagcttgcacatgactgccaccttttccccacaggcgcagcgtttttcccgctccgactacaaaaccctgggcctggccgccctcggcggtgccctggaaatctacgacttcattatcttcgtgttctttgcgctgaccctcagccagctgtttttcccgccggaaatgcccgagtggctgcgcctgctgcaaagtttcggcatcttcgtgaccggctacctggcacgaccgctcggcggcatcctgatggcgcatttcgccgatcacctggggcgcaaacgcgtgttcagcctgagcatcctgatgatggcgctgccgtgcctgctgatcgggatcatgccgacctacgcgcaaatcggctatttcgccccgctgatcctgctggcgctgcgtgtgttgcaaggcgcggcggtgggcggcgaagtgcccagcgcctggaccttcgtcgccgagcacgccccacgtcatcaccgcggctacgccctgggcttcctgcaagccgggctgaccttcggctacctgctcggcgcactcaccgcgacgttgctggcgcaagtcttcaccccggccgaaatcctcgattacgcctggcgcttcccgttcctgctcggcggcgtgttcggcgtgatcggcgtgtggttgcgccgctggctcagcgaaaccccggtgttcctcgaaatgcaggcccgccgccaggctgcggctgaaatgccgctgcgcaccgtgttgcgcgatcatcgcgccgtgctgctgccggcgatgatcctcacctgcgtgctcacctcggccgtggtggtgctggtggtcatcacgccgaccatgatgcaaaagaccttcggcatgagccccagccacaccttcgccttgagcgcgttgggcatcgtcttcctgaatataggttgcgtacttgccggcctgttggtggaccgcatcggcgcctggcgcgcggtgctggtctacagcctgctgctgccggtgggcattgccgtgttgtacgccagcctgatcagcggcggcgtgtggctgggcgcggcatacgccgtggcgggcttgagttgcggcgtagtcggcgcggtgccgtcggtgatggtcgggctgttcccggcgcaggtgcgggtatcggggatttcgttcacctacaacatcgcctacgcgctgtgggcgagcaccacgccgctgctgttgattgcgctgatgccgaccagcccgtggatttgcgtggggtattgcgtggtgatgggcgcggtgggggtggtgagtgtggcgctgtttggcaagcgccacacattggcgacctgagggttacgtcaggaagtgccagagcaccagcgtacccaccagcccgacgacagaaacaatcgtctgcaacaccgaccatacccaaatcgtctgcttgagttgcaagccgaagtactcgcgcaccatccagaaccccgcgtcgttgacgtggcagaagaacaccgagcccgcgccaattgccagcgccaccagtgaactctgggtcgccgccagcccggccatcatcggcgcaagaatgcccgcggtagtggtggtggcgacggttgccgagccggtcgcctggcgcagggccacggcgatcaaccacgccagcagcagatacggcatgtgcgcgccttcagcgactttactgatggtctggctgacgccggcgtccaatagcgtttgcttgaggccgccaccggcgccgatggtcagcaacaacacggcgatgggcgcaagggccttgcgcagtgtattgccaacttcggcgcgcggcatgccggcggcccagcccaggcagatcactgcggcgatcacggccaggcccagggcgatcagcggttcaccgaggaacttcaaggtcaatgccactgggttttccggcgacatggcgactttggccaaggtgctgccgagcatcagaatcactggcaacaggatgatcagcaacgacacaccgaagctcggctggcgcggcgccttgggcggtgcgctgaacagcgcgccgatgtcggccggttcatccacgtgcaggcgcttggacagccagttgccatacagcgggcccgcgagaataaccgccggcaccgccaggcagaagcccagcaacatggtcaggcccaggtctgcgtgcagcgcgctcaccgcaatcaacggccccggatgcggtggcatcaaggcgtgcaaagtcgtcatgccggccagcgccggaatggcgattttcaataatggctggttcgaacgtttggccatgacaaagatgattggcaccatcatcaccagccctacttcgaagaacagtggcaagccgatcaccatggccaccagcgccatcacccacggcaacgtcttgcctttgcccagcccgagcaacgtggtggcgatacggtcggccgccccggattcggccatcaatgcaccaagcatcgagcccagggcaatgatgatcccggcttcaccgaggattgccccggcgcctttgctgaaggccttggcgacttcttccgggggcaacccggcgcccacaccggcgataaacgtgccgatcagaatcgacaggaatggcggcagcttggtcgcgctgatcaacacaatgatgctggcaatcgccagcagaacgcagaacatgaggcgggtgtcgtgaaccatccacgcggcagtcgataactccaaaacgggactccttatcgaacaggttggctaatttgtttctttttgtttcctgctggaaaagcatacctgatagaactgttccagagcgttcatgtgcgattttggtgcgcagcgtttaacggcgacctgtcgcgcgcatgacaaatttgcaacccaagcgcggggatttggcctatagctctatgatcaacgcaccccaccttttgaggacatttcatgagcgcaggacataaccacggccaggcacgcgccggccacgagcgtcttttgtggatcgcgctgggcctgaccggcagtttcatgattgccgaggtgatcggcgcctttatcaccggcagcctggcgttgttgtccgacgccgcgcacatgatgaccgacgccctggccctggcgatttccctggtcgccatccaggtcgccaagcgcgctgccgaccgcaaacgcactttcggttatgcgcgtttcgagatattggcggcggcgttcaatgcgttgctgctgttcgccgtggcgttttacatcctgtatgaggcctatcaacggctgcaggcaccggctgaaatccagtccaccggcatgctggtgatagccgtgctggggctggtcgtcaacctgatttccatgaagctgctcagtgccgccagcggtgaaagcctgaatgtgaagggcgcttacctggaagtgtggagcgacatgctcggctccatcggtgtgatcatcgcggcggtggtgatcatgttgaccggctggggctggatcgactccgtggtcgcggcggccatcggcttctgggttttaccgcgcacctggaccctgctcaaggaaagcatgaacgtgttgctgcaaggcgtgccggatggcatcgatatcgatcaggtcgagcaggctattcgcggtgtgccgggcgtgaaggacgtgcatgacctgcatatctgggcgctcaccagcggcaagaacgtgctgagcacccacgtggtggcggattcggcgctgggcaccgagcaacagatcctcacgcgggtgacggaattgctgcacgaacaattcgatatttcccacgtcaccttgcaggtcgaaggcgaaggttttcagcacgacgagcatgatgaggtgcatgcctgatccaggctaacggatttgtaatgttgcgcccaccgccctgataagtaacgaaagctacattgcccccgctgggaaatctcagcgacttcatgggcgtggaactctcgttatggcactttccgttaaaacacttttgggggcagcagcgttttgggtgaccgcaagcgctgctcaggcccaaacccttaccctcgactcagccctgcaagccgcgttcgccaacaatcctgatttggctgccgcgcaatgggaaatcgacattgcccaaggcggtcgtcaacaggcgggcttgatccccaacccggtggcgtcctgggatgccgaagacactcgccgcaactcgcgtaccacctccatcaaactcagccagaccctggagctcggtggcaagcgcggcgcgcgcatcgacgtggccacacgcgcacaggacgccgctgcgctgaccctggaacagcgtcgcaacggcctgcgcgctgatgtgatcgacagctattacggcgccctgcgcgcccaggaacgtctcgacctggcgcaacgctcaatggccttggccgagcgcggcctggtggtcgccaatggccgcgtcaaggcgggcaaatcgtcgccggtggaagccacgcgtgcccaggtgcaggtgtctgaaattcgcctggagttgaaccgcgcgcaggttggcttaagcgatgcttatcgtcgccttgccgccagtaccggcagtgccacccccgacttccaggccgtggccacgcaaagccaatccgcaccgccgttgccggcttccgcgcaattgctggcgcggcttgagcaaaccaccgaactgcgcctggccgagctgcagattgttcaaagcgaagccagcgtgggcctggaaaaggcccagcggattcccgacctcgatgtgtcgatcggcagccagtacgacgccagcgtgcgtgagcgcgtgaacctggtgggcgtgtcgatgccgattccgctgttcaaccgcaaccagggcaatgtgctcgctgccagccgtcgcgccgaccaggcccgcgacctgcgcaacgccgtcgaactgcgcctgcgcaccgaaacgcgccaggccctggacctgtggcaaaccgcgaataccgaagtgcgcaccttcaaccagcaaatcctgcccgccgctcaaagcgcggtggacagcgccacccgtggtttcgagatgggcaagttcaacttcctcgacgtgctcgacgcccagcgcacgttgatcgcagcccgcacccaatacctcacggcgaccgcccaggccaccgacgcctgggtgcgcatcgaacggatttacggcgacctcgcccgcttttgattttttctggagtcttttatgaagcataaacacggtgtggcgctcgccgtcgccctgggcctgatgctgtctggttttgcacgggccgacgaagaggaaggcacactcgagctcaccgagcagcagatccaggccgccggtattcaactcgccaaggcccaaccgcgcgcgatcagcacgttgctgacgctgccgggcgaagtgcgtttcgacgaggaccgtacctcgcatatcgtcccgcgcgcgggcggtgtggtggagtcggtgaaggtcaacctcggccagtcagtgaaaaaaggcgagctgttggcggtgatttccagccagcagatttccgaccagcgcagcgagctggcagccagtacacggcgcgttgaattggcgcgcaccacgttccagcgcgagcgccaattgtggaaggacgagatctccgccgagcaggattacctgctggcgcgccagaccttgcaagaggccgaaattgccctgaacaacgcccgtcaaaagatgaccgcgctcagcggcagcgcagtattggtggggggcaatcgctatgaactgcgcgcgccgttcgccggcgtagtggtggaaaaacacctgggcgtcggtgaagtggtcggcgaaaccagcaacgcgttcacgctctcggatttgtcccaggtgtgggtcaccttcggcgtgtttcccaaggatttgaacaaggtgcgcgtcggtaagccggtaaaagtcagctccacggaaatgggcaccgaagtgctcggcaccgtggcttacgtcggcaacttgctcggcgagcagacgcgtaccgccaccgtgcgcgtgaccgtgcccaaccccgacgacgcgtggcgcccggggctgttcgtcaccgtgcaactggccaccgacacctaccaggccaaggtcaccgtcccgcaaaccgcgatccagaccgtcgaggacaaaccctcggtgttcgtacgcactgcggacggtttcatcacccgccatctggaactgggtgtgagtgaaaacggctacgtcgaggtgcgcaaaggtctcgacgccggggcacaagtggcgaccgaaggcagcttcatcctcaagtccgaactgggtaaaggctcggccgagcacgcccattgatcctgcgagtgattccccatgtttgagcgccttatccaattcgccatcgagcagcgcatcatcgtgctgctggcggtgctgttgatggccggtgtcggcatcgccagctatcagaagttgcccatcgacgcggtgcctgacatcaccaacgtgcaggtgcagatcaactcggcggcggccgggttttcgccgctggaaacggaacagcgcattacctttccgatagaaacggccatggccggcttgccgggtttgcagcagacgcgttcgttgtcgcgctccggtctgtcccaggtgacggtgatcttcaaggacggcaccgacctgttcttcgcccgccagttggtcaacgagcgcctgcaagtggcgcgcgagcaattgcctacgggtatcgaaaccgcgatggggccgatttccaccggcctcggggaaattttcctatggactgtcgaagcggaagacggcgcgctcaaggacgacggcacgccgtacacaccgacagacctgcgcgtcattcaggattggatcatcaagccgcaactgcgcaacgtgccgggcgtggcagagatcaacaccattggcggcttcgccaaggaataccagatcgccccggacccaaaacgcctggcggcctacaacctgacgttgaccgatttagtcacggcgcttgagcgcaacaacgccaacgtcggtgccggttatatcgagcgcagcggcgagcaactgttgattcgcgcacctgggcaagtggcgtcgatagatgacatcgccaacatcgtcatcaccacctcaggcggcacgcccattcgcgtgcgcaacgtggcgcaggtcgagatcggccgtgagttgcgcaccggcgccgccaccgaaaatggccgcgaagtggtgctgggcacggtgttcatgttgattggtgaaaacagccgaaccgtgtccctggcggtggcgaaaaaacttgaagagatcaaccgctcgttgcctgaaggcgtggtggccgtcaccgtctacgaccgcaccaacctggtggaaaaagccatcgccacggtgaagaaaaacctcttcgaaggcgcgttgctggtggtcgcggtgctgttcctgttcctgggtaatatccgcgcggcgttgatcacggcgatggtgattcccctggcaatgttgttcacctttaccgggatgttcaccaacaaagtcagcgccaacctgatgagcctgggcgcgttggacttcgggattattgtcgacggcgcggtggtgatcgtcgaaaacgccattcgccgcctggcccatgcgcagcaacgccacgggcgcctgctgacgcgcagcgagcgcctgcacgaagtgttcgccgccgccaaggaagcccggcgcgcgttgatttacgggcaactgatcatcatggtggtgtacctgccgatcttcgccctcaccggcgtggccgggaagatgttccaccccatggcgttcaccgtggtcatcgccctgctcggcgcgatgatcctgtcggtgacgttcgtgccggccgcgatcgcgctgttcgtcaccggcaaggtcaaggaagaagaaaacctggtaatgcgcaccgcacgccgcacctatgcgccggtgctggattgggtgatgacgcgccgtccactggtgttcggcctggcggtgctgaccatcgtcgcctctggggcagtggccagtcgaatgggcagcgaatttatccccagcctcagcgaaggcgactttgcccaacaggccttgcgcgtgcccggcaccagcctgacgcaatcggtgcagatgcaacagcagttggaaaaaaccttgatggcccaggtgccggaaatcgagcgggtcttcgcacggaccggcactgcggaaatcgcttccgacccgatgccgccgaatatttccgacagctatgtgatgcttaaaccgaaggaccaatggccggatccgaaaaagtcccgcgaggctttgatcgaagatatccagcgcgccagtgcgattgtgccgggcagtgcgtatgaactgtcgcaaccgatccagctgcgtttcaacgagctgatttccggtgtgcgcagtgacgtggcagtgaaggtatttggcgacgacatggcggtgctcaacaagaccgccggagaaatcgccgagaccctgcaaaagcttgagggcgcttcggaagtgaaggtcgagcagacctccgggctgccggtgctgaccatcaatatcgaccgcgacaaggccgcgcgttttggcctgaatgtgggcgatgtgcaagacaccattgccgtcgcggtcggtgggcgccaggccggtacgttgtacgaaggcgaccggcgctttgacatggtcgtgcggttgtccgacgcgctgcgcactgatatccacgggttgtcgcggttgttgattccggtgccggcgctcgccggtagtgtgtcggggcagttgggctttattgccttgtcccaggtcgccagtctggatctggtgcttggccccaaccagatcagccgcgagaacggcaagcgcttggtcatcgtgagtgccaacgtacgcgggcgagatataggttcgttcgttgacgaggccgaggcggctatcaacactcaagtgaaggtgccggcgggttactggaccacttggggcggccagttcgaacagctgaaggaagcctccgagcgtttgcgcattgtggtgccggtggcgttgctgctggtgttcgggctgctgttcatgatgttcaacaacctcaaggacggcctgctggtgtttaccgggattcccttcgcgttgaccggcgggatcatggcgctgtggctgcgggatattccgctgtcgatctcggcgggcgtgggctttatcgcgctgtccggcgtggcggtgctgaacggcctggtgatgattgcctttatccgcaacctgcgtgaggaagggcgccttttgtcggtggccgtcaacgaaggcgcactcacgcgtttgcgcccggtattgatgaccgcattggtggcgtcgctggggtttatccccatggcgttggccaccggcaccggcgccgaagtgcagcggccgttggcgacggtggtgatcggcgggattatttcatctacgttgctcacgttgctggtgctgccggcgctatatcaatgggcgcatcgcaaagaggaatgaggcgggcgcggtactgaaatccagggatcaactgtgggagctgtcgagcttcagcgaggctgcgaaagcggtggttcagtcgacacttctattggctgtgccgccgccttcgcggcctcgctgaagctcgacggctcccacatggatctgcttgagtttgaagtacctggcaggctgcacacatcacacagtgggcgcatcgcaaggaggaataaggcgggcgcggtgctgaaatcccagagatcaactgtgggagctgtcgagcttcagcgaggctgcgaaagcggtggttcagtcgacacttctattggctgtgccgccgccttcgcggcctcgctaaagctc

SEQ ID NO: 80 - DNA, 27756 bp, Pseudomonas poae FL10F
tgcagtacgacgctacacgtgtgttgaaagcaccacaagcagacacaagcggcggagtacgaggcatcaggtggatcagatagctcatgtcgaagccgtgcggtcatcgcgcgtcgcgccagctgcgccgcatcccgccaccacgcgtacctcgccggttcgccacaacaaccccgctcgccacaggaagcccgctggccataataagcctgcgcatcacaccacggccctcggtttatactcgccccccattgcaaaccttcaaactcaaacaacccgagatcccccatgagcacctctctctccctggcccccgcgcgtaaacctatcgcgccgctgctggcgtttatcatcctggtggcgggcgccgtgttcctgcagaacagcgtcggctcgcgccaggtgctgttgctggtggtcggcgcggcgctgggcttgaccctgtatcacgccgctttcggcttcacctcagcctggcgcgtgttcatcaatgatcggcgtggcgccggcttgcgtgcacagatggtcatgctggcggtggcggtcgtgttgtttttcccggcgctgggcgcgggcacattgtttggtcagccggtggtcgggctggtggcgccggccggtgtgtcggtggtgttcggtgcgtttatttttggcattggcatgcagttgggcggtggttgtgcctcgggcactttgttcaccgtgggcggcggcaatgcgcggatgttggtgacgctgttcttcttcatttgcggttcattgatcgccacccagcatgtcgactggtggtttgcgctgccggcgttcccggcggtgtccatcgtcaaaagctttggcgtcgtgccggcattgctcttgagcctggcggtgttcgcgatcattgccgcggtcagcgtgcgattggagaagggccgtcatggccagctcgaagcgggcgtgaccagcgaacacaccggcctgcgccgtttcctgcgcgggccatggccgttggtgtggggcgcgattggcctggcgttgctcaactatgcaaccctggcgctggccgggcggccatggggcattacttcggccttcgcgttgtggggcgccaaggtcgccagcggtgtaggtgtggacgtggccagctgggcgttctggcaaatgccgggcaatgccaaggccctggccgcgccggtgtgggaagacatcaccagcgtcatggacatcggcatcgtcctcggcgcgctgttggcggcaggcctggccgggcgtttcgcgcccagcttgaacatcccggcgcgctcgctggtggcggcggtgatcggtggcttgttgctgggttacggttcgcggctggcgtacgggtgcaatatcggcgcgtacttcagcggtatcgcctcgggcagcctgcatggctgggtgtggttggtggcggcatttatcggtaacagcgtgggcgtgcggttgcgtccatggttctttgcaggcgagcggccgcaggtggcattgagcggttgctgaatcaacccatgaggtaggcggcatgatcagagagttgaggacgtttgtcagcgcggcgcggcgcggcaccttcgccgccgccggccagcaggtggggctgacgcaatcggcggtgagcgcgcaaatcaagcaccttgaggacgcgctcggggtgaagctgtttgaccgtaccggccgctccgccacgctcaactcggcggggcagcgcgccgtgccgctggcggaggaaatcctcgatatcttctcgcgcatgggcaccccggataaggccaacaacttccacggctccttgcgcatcggcgccatcggcagtgtgcaaacaggccttttgcccaaggcgctggtggcgcttaaacagcgcgcgccgttcattgaggtcaacttggtgccgggggtttcgctgaacctgctcagccaggtcgatgccggtgagctggacttggcgatcatgatccacccgccgttcaacctgcccaaagacctgaacatcgaggtgatcgcccgcgaaccctttgtgctgattaccgccaaggacgtgccgggcgacgacccgttgcagatcctgcgcgagcagccctttgtgcgttacgaccgtggctcgttcggcgggcgccaggtcacgcagtttctcaaggagcagaaaatccagacgcaacaggcactggaactcgacgagctggacgccatcgtcaagatggtccgcagcggcctcggcgtgtcactggtgcctttggccggtttgtggctggaacacgacagcgacgtgcgggttttgcgattggacgcgctcacgttctatcgcgaaatcgtcttgctgactaagtacacccagcgccaactgccgctcttcgagttattcagggcgtgcgtcatagaagtgctgggtgcgccgaagtagggcgcgagcatcgaaaaaattgaggctcagggcgaaagatatgcgctttattgcgcggtctttctggtgaagaatcgggttctgaataacagaacccgcaggtaaccgccgtgagcctttcgcctttccatttagctattcccgtctacgacctcgccgccgctcgccacttctatggcgacgtgtttggcctctccgaaggtcgctccagcgcccaatgggtcgacttcgacttttacggccaccagctggtgattcacgaacaccccaagactgaatcccaggaatcggtgcactccaacccggtcgatggccacgacgtaccggtcccgcatttcggcatcattttgcagtgggaacagtgggaagccttggccgagcgcctgcgagcgcgtggaacacagtttgtgatcgaaccctacattcgcttccagggccaggtcggcgaacaagccaccatgtttctgtttgacccgtgcggcaacgcgctggagttcaaggcgttcaaagacatgagcctgctgttcgccaagtaagtgcccccgtgcgaccgtcgccagccgagcgacggcgttaataagacgtgtagctgcatgcctgccgcctgagagaagtgccgtgatgtctgacgttgactgtgagtttcggcccgtgcgtgccgaacagcgctggcagttcgaaccctgtggcgacagctgcatcgtggtggtgtttgcgaccgtgttcagtgcgcacgccaaccgccgcgccgtggcgttcagcgcaaccctgcatgacctgctggcgcgcgggctgctcagcggcgttaccgatgtgatcccggcgatggtgtcggtgggcgtgcattattcccccgacgtgttcgccacgttgtaccccgaattatcgccttacgacgccgttgcccacgtgctggacaacgcgctggctcagcagcagaacgtgccgcgtgtcaccccgaaacggctggaaatccccgtgtgttacgaaggcgattacgcccccgatctgctcgacatcgccagtgcctgcaacatgagccctggcgaagtgatcgcggcgcacagcgggcaatgggtggatgtgctgatggtcggtttcgcgccgggccatccctatatcggcatgcacccgcccgcgctcaaactggcgcgccgggcggtgccgcgcactctggtcaagcaaggcagcgtgggtttggccaactgccaaagcgtaatctaccccgccgatttgccgggcggctggaacatcatcggccgcacgccgttgccgatgtttaccccggccaaccagccgccgtgcctgttgagcggcggcgatcaagtacgctttgtgccgatcacggcgcgggaatttgaacagctggccggagcaacgcgatgagcatccacgtgatccggcccgggttgttttcctcgtttcaggacaccgggcgcgtgggcttccagcattggggcgtgccggtcaacggcgccatggaccaggacgcgcatgcgctggccaatctgttggtgggcaacccgacgagcgccgcgaccctggaaatgaccgttcaaggcccggtgctgtgttttcaggcacgggcgctgatcgccctggccggcgcccacctgggcgccagcctggacggtgccgcgctgaaaccggggcaagccgtgcgggtaaaaccgggcacggtactgcgcttcgaaaagcgtgaatacggcgcacgggcgtacctggccgtgagtggcggctacctgctgcaaccggtgatgaacagccacagcacttacagccggggaggctttggcgggttgtgcgggcgtgcattgcaggcgggtgatgtgctgcctatttgttcatcctttgccaacccgccgcgcttgaatattccctcgggtttgctggtcggcaaacagaccggccccgtctcgatccgtgtgctgcatggccgtgagtgggcgcagttttcggagtcggcgcggcatgcctttctccatgagccctatgcgatgaccgccatgtcggaccgaatgggctaccggctggaaggccccggcctggacctcacccagcccaggcaattgctgtcgcaaagcgtggccttcggcaccgtgcaagttcccgcgggcggccagccgatcgtgctgatggccgaccgccaaaccaccggtggctacccgcgcatcgcacaggtcgcgagtgtggatttgcccaaactggcacaactgatgccaggcgatgcagtgcgctttgccctgattgatttgcccaccgcgcagcaactgctcgtgacgcgtgcgcgcacgctgaaacgattggaagccgcccactaaccccacccgtcgctaccgaataataaaaacaggagcgctgcatgatgagtcccactttcaagattcctactgtcgagcattaaaacccctcggtttgcgacgggtttacttctgggtggagcaatccacctcaataactcaaatgacctgtggtcagagtggaaggtgtttatgtctcgaatgatcgctactacagtccgaacaacgtctccaacaacagttccaacagcagttccaacaacagcccccacgagcgcttttggtgagcgcaatcaaaccgcgcaaagcagtgccaccaggatcgccaagcgtgccgccatcgccgccgctacgggcactgcggtggagtattacgagttcggcgtgtacggttttatggcgacgattatcgcgccgttattcttccccagtgataacgccgctgccgcgctgctggctacgttggcggtgtttggcagtgcgtttttgattcggcccttgggcggtattctgctggggcggttggccgaccgtatcgggcggcgcaaagtgttgctgagcacggtaatcggcatgggcagcgcgacggcgatgatcggcctgctacccacgtcggcccaggtggggattgtcgcgccgattctgctggtgctgattcgactggcccagggctttttcgccggcggtgaggtgatcggcgcggccgccttcctggccgagtcttcgcccaaaggccggcgcgggttctacggtgctttcaccccggttggcgtggcgattggcgggtcgatggcggcgatcatctgcggcattactaccgggctggtggacgcgcagcaactgcaagcctgggcatggcgtattccgtttttcctcgccatcccgctggtgatcttctcgtgcatcatgcgccacaacgtcgaggaaacgcctgagttcaaagcctttctcgcggtggaaaaaccgcccacggcaccggtcaaagaggtgctcacgcaaaacctgccggcggtgctgcgcgtggtggtgttcgcctttgcgcagaatgccgggtactacatcggcctggtgttcatgaacatctacctgaccacctacctgcatttcgaaaaatccaggatctactgggtgatcgccggcgtcagtctgtgcatggccgcgctcatgccgttctggggtgggctgtctgaccgcatcgggcgcaagaaagccctggccatcggctttgtagggtatgcagtgctggtgatcccgatgatggtgctgatgaacaacagcagcctgttcatcgcggtcatggcattttttgtcgcgacgctgcccatgccggtgatccagtcggtgggctacccgacgtatgcggaacagtttcccactcgggttcgctacaccggcatggcgatcagcatcaacctgggcgccatcctgggcggcgggatcacgccgtacatcgtcacctcgctgatcggctcgaccggcaacctgctggttccaggctttttcatggccggcgcggcggtgtgtgcgttgattgcgttgaccaccttgcgcgaaacctcccagggcgagctgcgccgctaagcctgtccgaatccgtcctgaagtggtccggcacgcgcctgttgcttgctcgcgggcgtgcctaccatggcttgcatcaaccgcaagccctgaggacacatcatgagtcgcaaagccctgatcgttatcgacgctcaacattcatttcgccattcgagctactggtccgaaactgacctgccggcttacctggaaaaacagcaagcgctcatcgatggctgtgttcaacacggcatcccggtgatacaagtcttccatgtggaagaccaggggcatttttccctggcctcgggcaatgtcagggcgttgagcgaattgtcgatcaaccctgacctggtcattcacaagcgtttccacagcgcttttgccggcacgcccctggcagcgcggcttacggagatgggcgtgacccaggtgatcatcagcggcattcgcaccgagcagtgctgtgaaaccaccacgcggcaggcgtcggacagcggcctgcgcgtggatttcgtcagcgaggcgacgttgaccttcgccatgacccacgcgcgcagcgggcgggtctataccgccgccgagattcgcgagcgtaccgaattggtgctggaagaacgctttgcgcgcatcgtcacggtcgcccaggcattggaggattgaatttgtgagtgtaccggtgctgttcgtactgttgcctaatgtgctgatgctcgacctggcgggcccggccgaagtgctgcgcctcgccgcccaggtcgatgactcgatggccatcgacttcgatttgcagtacgtcagcccggtagcgtccctgcaaacgtccatcggcttgcccctggcggggttggcgccgctgccgcaagccttggctcccggcacgctggtggtgttggtcggctctacgtcgaaggtcaccaaggctgatcgccaggcattcgaggcggcgagcaatacgctgacccaatggcttaaaaccgtgttcgcaccttcgggcgagcgtttggtgtgcgtgtgcgccggtgcattgagcgccgcccgcgccgggctgctcgacgggcgtcaatgcaccacgcaccacgcgctgtgcgccacattgcaggcgctggcgcccaaggcccgggtgctggaaaaccgcctgtacgtcaccgacggcccggtcagttgcagcgccggtgtgaccgcaggcatcgacctgatgctgcacttggtcgccgagctgggcgggccacgactggcctgcgccgtcgcgcgcgacatggtggtgtacctgcgtcgcagcggcgccgacccacagctttcgccgtggctggccgggcgcaaccacgtgcatccggccgtgcaccgggtgcaggacgccctgactgctgcgccgtgcgaggcctggaccgtcacgcgcatggccggcctggcttacaccagcagccgccacctggcgcgactgtttcacgaacacgtcggcatcagcccgctggattatctgcacaccctgcgtttaaccgtggcgcgtgaattactggtggagtcgagcctggacattgaaaccgtcgccgagcgcgccggctttggttcggcgcggcacctgcggcgtatctggggcaaatatgaagcggggacgccttcagctgggcgtgtcggtggcggtggttgacgcttgttcagcctcggcctcgagtttggcgcggtcggctttgctgatgtatttgtctttgctcttgggtgccaatttggcgctggcctttttcgctttggccttaaagagctgctgcagttttttctggcgattcatggtgtgctactcagcgggtaagtgcgtgcatgatatcagctgagtcatggcgtctggtcccggtcatacggaaactcacgaccccatgacggattcagccgcgggcacctcgtccaacccatgaaacaccgccagcccttgctgctgagccatctccaccatcaagtcagcaccctcggaagggccgccgatgcgcagtacgccgtcgcagcgcttgagcagggttttggcgtattgatgaaaatgcgcctggtacacctcgtcaccaatcccgcgtgagccggccagttgcagcaacggtaacgccacccattcggccaccagtggaaagtgcccggcgtgcaacagggcggcggcacttgcttgcatggcctgcacgttcgcggccagggcggcggggtcatcagcggtgccggagcggtaggggccggccaccagaatcatcatggcgggcgagggcggcagcagattcttgaggtattgcagcaggatgatggtcttgccgtccatgatgcgaccgtcatcgaccattgcgagggcctgctcaaagggcatctccagcacttcgatgtcttcgccttcgtgggccaggccgccgccgtcgctgatgcggtcctgcgggtggtattcaccgacaaaaaaatgcaggcgctcagtcaccgagccggggctcatgaacgcttcgtacaccttgcgcaccgattggacccggtaaccggtttcctcttcggcctccaggcgaatccgctcctcggcaccggcgttatccagcagcccggccgccgcctcaatcaagtaaccatcatgcccgttgacgtaggccgggatgcgaaattgccgggtcaggatgaccgtgcgttgcgcccggttgtagagcccgatcgtggcaccatcgcctcggtcatagacctcgcgcgtttgcggctgccagctgccgtcccggcgttgcagctcgaagtcgacctttttcagcagataccagttatccgacagcgtctgttgtttgacgattcgaacagtgcggtttggcatgggcgacggtccttgatagttatttgttaaatatcgtgcataatcgtgcagcttcatgcagaggatcgatgatgttaacccagcagcgcaagcagtttttaaccgagcgacttcgtcgcgacggtcagctcctggccaagcccatcagccaggaactcggcgtgtccgaggacaccatccggcgtgatttgcgcgagatggccaaggccgggctgctgatgcgagtccacggcggcgccttgccggcgtccccggcgatgggcgacatgggcgtgcggcaggcgatcctgcccacgcaaaaagccgccatcggcagagccgcggcgcagttggtgcagcctgggcacgtggtcatactcgacggcggcaccacctcgatgcaggtcgcgcggcacttgccgctgacactccaggccaccgtgattactcacagcccgtcaatcgcggtggcgctcagtgagcacctgaacattgatgtgatcatgctcggcggccggctcttccggcactcgatggtcggcaccggcgcagccacgctggaggccatcgggcgcattcgtgccgacctgtacttcatgggcgtttgcagtgtgcacccgactgccgggctgtcgaccggggattacgaagaggcggtgatcaaacgtgcgttgtgccaggtgtctgcggaaacgctggtgctggcgtcctcggagaaactcgcgacggcatcgccctacatcgtcgtgccgctgtccgagattgcggggttggtggtgccgggggatgtgcctgaggcattgctggcgccttatcgcgcgatgaaccttcaggttcatcgggcagagtagggcacatgcgcagcttttttaaatggacttgtagaatgcgatcaacagacacaagcgtaccgcgaccctcttaccgctggctcgcaaccctgggtgtcgggctgggcctggcagtcgctgtgtggattaccggaaaaggtgagtttttttgggagaatttcgcggcttactggctccctcaagcggcggtgctggcggtggcgctgctgctcaaggcatcccgtgaaacgctgggtggcatggcaatcgccatggcgctgtacttgtaccttttccacctctgggcgtctgaagccatggcgtggctttggtatctcttcagcttccctggcgcgctcatcggcgcattgctcgccgtctttattgcatcgcgaacgtcattcgccgggttggcagggtttggttcggtcacgttgggtatcgtgctgaatctcgtcattctttttttcgtcatcgcgtgaggcgtcaagacacggttaattcacttgccttgaccttcacccgcgttacccgtcgcgccatcacccgccggcggccatcagcgccgccatgtaaattgtttgggccgctggcaagtagccttggactagcgtgacggagccttatcggtagcaacgctgctttggtattgccccacatggtgtttccacggcaggtaatcgacaaaaaccgcgcgcttggccaatccgtcttcgcctacgcgaaagccaggcatttgtcgcagatcgagttgcgcgcactgggtggcgagcgccttttgcaactcaggggccgggtgaaaatactcaggacgaaaagcgtttctctccagcgtcacaccgcagcgtaaaaccttgccctgtgcgtcggcggcgacatcgaagcgcgctgtgccgaacgcatttggcgcgtgtttggcgaccacgttgtcccagaagaatcgacttgccgacgcagaccgttgaagcctcaggtggtactccggcgttaacggcgcggcgcccacagtggttaacggtgcgacaatctcgaggctgccatcagccggtttttgcagaccttccggtatcgcatcccagacaccgctccagcacatgtccgatacgatcctggcgaagtccgtgtgagtatcgccgtcagtcggtagcacctcgcagagcaacacgtcgccttggcgattgagcttcatgcgcaacttcacgctaccttgggtgccttcgccattcgcccgaaaggttctatcagccaacgtagtactcaacgtgctgatgtagcgcctggcctccagctgcttgatttcttctgcactgaggaacgttggagacgacttgccgccgctgtcgatccaggcatccatgcgctgctccggggtcaacgcgtggcagccgcagagcagcgccaaaccggtgaataaaaacagcgtgggggttagacgaccattggcgcgtgacttcagtgtgagggtggacactcatgcgttccttgcaacgataaaagccctattttgcctgtaaggccagaccgtcggctacttccttggccagtgccaaaaacgcccgcgccgccgcagactgataagcccctttgcgctgcatcaacaccgccgtgcgctgcaactgctgcggccccagctcaattgccaccaattgcggatgcgcccgcgcaatcgcggcgggcagcagcgtcgacagcgtggtgcggcgaaccacctcaagcagtgcgccaatcacattggcctccatcgccacgcgtgggcggatcccgtgtttgttgcagtagcggtcgatctgttcgcgggtggcgaattctttactgagcagaatcagcgattctgcattcagcgcctccaacccaatcgcctgctctcccgccagcggatgctgttggccgaccaccagcgcgagggtttccaccagcaggggcgaggcgtcgatgtcttgcgcgtgcacctcatcgaatgcgatccccacatccaactcgtccgccagcagttggttttccatgtgctcctgggcgacctcacgcacgttcagcgtgatgttcggatagcggccatgaaaggcttccgccagcggccccaccaggtaggtggtgaacgtcggtgtgacagcaatccgcagcgtgccccggctgaggtcgcccacatcatgaatcgcacgcttgccttccagcagctcctgcgccgcccgcagcgcatagcgcagataaacctcaccggcatcggtcaggcgcgtctggcgcccggatcgatcaaacaactgtgcaccgaggctctcttccagctgccgcacttgctgcgacagcgccggctgcgagacgtgcagggctgccgccgctttggtaaagccttggtgttctgcaacggccaggaagtactggatatgtcgtgccagcatggttgtactcataagataatctaatgtattggatcatatatgagacttttaccttattgcacgggctccgtaacttttgctccatcgcctcgcgattcaaaggagttacccatgcaagacatcatcgacggtttcctgaagtttcagcgcaacgccttccccgagcgcgccggtttgttcaaagacctggccaaccagcagaacccacgggcgctgttcatctcctgctccgacagccggctggtgcccgagctggtcacgcagcgtgagccgggcgacctgttcgtcatccgcaatgccggcaatatcgtgccgtgctacggccctgagccgggcggggtgtcggcgtcggtggagtacgccgtggcggccttgcaggtccgcgacatcgtgatctgcgggcattccgattgcggcgccatgaccgccatcgccacctgcaaatgcctggaccacatgcccgcggtggccagctggttgcgctacgccgactccggccgggtggtcaacgaggcgcgccagcatgtcgaccagcaggccaaagtcgcctccatggttcgcgaaaatgtgatcgcgcaattggccaatctccagacgcacccatcggtacgcctggccctcgaagagaagcgcgtgaccctgcatggctgggtctacgacatcgaaagtggcggcatccaggccttcgatagccgcaccggcaacttcgtgccgctggccgactacgctgcctgatacctactgtttttacccacggagacaaccccatgatccagtcacaaatcagccagaacactcgccttgccttgaccgacgtcatcctcctggccaaggcccgcaaagacctgtcgttcgcccagatcgccgaaggcaccggcctgcacgaagccttcgtcaccgccgccttgctcggccaacacccactgccggccgacgccgcccaaaccgttgctgacaccttgggcctcgacgatgatgccgtgctcctgctgcaaagcatcccggtgcgcggcagcatcggcaacggcatcccgaccgacccgaccatctaccgcttctacgaaatgatccaggtctacggcaccacgctcaaggcgctggttcacgagaagttcggcgacggcatcatcagcgcgatcaacttcaaactggacgtcaagaaggtcgaagacccggacggcggctcacgcgcggtgattaccctggatggtaagtatttgccgaccaaaccgttctgatcacgcttcacatggcccggcgctgcgaggcgaccgggccacggctgttgcataggttgggtcagtgcatcacgcctaggtattgagataaggcgcgacggtgtcttcaagcagctccatcagttcggggtccatgtagcgaaagtcatccggaatatccaggcagtaaagcggcttgtgttcaagcaaccgcgcgtagtttgcctgcaggcgatgcaggtgtttacgctccatgacgaagatgacatctgcccatcgaatatccgcggcgccgatggttttgcgcgcattcaggctggtgcccgccgagcgcgcattgaagccggggcgacggcgccagatggcctctgcggtagggctacgccactggttgcggctgcacacgaagagcagattgattgggctattcattgcctgtccacgcgtcttggttaagggtgaatgggccgtgccagaaacccggtaatcagccccaccacctgctgctgaatcaccgcccgcggccgcgcgccttcgccatcccggcaaatcatgccatcgcccggcgagctctcttcaatcaacaccatgccacccggcttgcagatcgacataaagctgaagtgcgtggcgtcgctgatctccacgtattgcgtggaggtttcaggcatgcgcttgaccatgtcggcagactccagctcaggcgacatatcttcggttggcacgcccccggcgatcaccagtgccggaaccggcagtgcggccaggctggcgctggtcagcccgcgtgacaggcccaggtccaaagacacaatggcagtgacgcgcttgtcgctcaaatccgcggccagctgcgccttgccggcgggcgtagcggcggggttcatctcgtggtagccgatgcagccgcccagcttcgggtgttcggcgcagtcgcggctgaacaggtcggggtcgaagcgcgcgccggcgatttccatcacggtccagccgccgagggagtggcccaccgcagcaatctggttattcgcgaccgcgccaaattgcttgggctgagccagcactgcgtcgctagcacggctcaagtcggccgggcgctgccataactgcgcggcggcttgcaggctgcggtctttggtggtggtgccggggtggttgaccgccgccacgatataacccttgtgcgccaaggcactcgccagccacacctgtttgccccaattgccaccgtaaccgtgggacagcaccaccaaaggatgcgcgccgcccgccggtggcgcatcgggcacggcgagggcgccgatgaacaccgcgttgtcggcaatcagcttgggttgggcagtggtggcggcggggtaccagaccaccagttccagcgggcggttgtttttggaatcgggcagcgtggcggtcttgaaaccgaccgggctttcggcagcgaaggcgggcgtggacaggcagagcaggaacagggcgcgcaaagcggttttcattgtttttatcgtccttgattttggtggcgcatcattatgctgtggttcatgacctatcgaatacgcagtgttagcgaatgcccatttcttcaggccaggcttgcactccagacattttcgccgcctcaatcaaacagtttttttccgcatcggacgcatcgttcagttcagctgcctcaagcgccgccacgtcatcatcgtttccggcgtgatgccggtcgtcaatatgtttgcaggcaaggaacaatgcgcgggcgatggtttccatgtagatctccaaagtcgccgctcactacaggctcacggcttattcatgaacacgatgatcggtataggcgtaacgcccgtcacaacttggctctttaatttcggtcaaataggtatattgcaccgtgtcggcatcaatgaccttgtagtggtatgcgttgtatttcttgctccctacagcatcgaataaaatcatctcctttcttcccgtccaatagcccattcttctatgtacccggtgcgtcctttcagcgtcgctgtaaaaatccgttctgaaattcccgttgggcttcagctcggtggtccaagcgaggaactggcatttgctcgccggatcacgttgacctttccatttccctacgagagctggatcctgtgaagtgcagcctgtcaggcaaaccaaagcgatcgcaagcaacgtattcgatttcaaccgttctatccttctgaccgcgcacgtgggcgcttacacggtctctatcggccgtgtgcggcaaatgattaaagcgctttctggtgatccgcgcgggttgccagcggccgattggagcctggcagggtgacgttggtaagcatttaagcggagccggcgcattgtacgacgcaggtgctggcgtatgagcggcggggcccgggtactgtagatcaacgcttcagggcatcacactcattacgcaaattgctgtcttgaatgttgccgcagctttgaccgttgattttggcattgcagtaaacgcgttgatcgttgtcattgatgttgccgcagctttggccgttcatttccgccaggcacgtggcccgaagggtactgccctggatattgccgcagctttggccattgattttggcgttgcaataagcgcgttgatcgttgtcgctgatgttgccgcagctttgaccgttcatttgcgcatagcaactggcccgaaggtcgccgtcactgatattgccgcagctttggccgttggtcgtggcgttgcaataagtgcgttgatcgctatcagtgatgttgccgcaacccgcatgagcgtaggtactcaacatcaataacagcgcaataatggctctcatcactctctccatggggtgtcaggaaacagcctgacgctgacagatccaagacgattttgtcgctgtgacgagcaatcaaattgacatcattttttgggggagttccacggggcggatgtgactatcgtgcgtacactttttttgtcggcgacacctgagtcacacatggcttcgtaggcatgcagggtgacggctaccagccaaaaacggacggtcggtgatctgcaagcacagcaacgaatcctgtgccctttaacggcaattcatcactctagcaaaccctccgtcgctcacgggttcagatacttgatgacagcaccggcaaacagttctggctgatcaagcatgatgaagtgaaaactgccgtcaatgcgtctgaagctgatgtttggggttgaggcataggcgttacggaacattgcatcaacctgggacgcctctacgccgtaatgcgagtcgtaggcgtaaacgacctcgacaggcaccttgatgcgtccaagctcaggccggagatcggtaaccatcagttcatacatggcatcggccatagtctttcggtccgagtttatccccgctgccaccaggcctggtctggccgcttcggttttggcaagacgggcgatggaggcatgctgcatagcttccacctgctcgggcgatgccgctaacattgcatcgcgcatcgcagcagcatgcggcgccgcagtttcactggtcgctgaggggtcaaacagcaacgtataaaagggcatcgcatcgacaatcataaggcgtcccacctgatcgggatgacgagcacctaacatcagcgccacctcaccacccaacgaatgaccgatgacgacaggcgcctcgatgcgctggctgcggatgtattcagagatagcctcgaccgtcgacgccactactcgaccgtctggattggttacagcaggcgagccggcaaaaccagctacctgtacgagatggaggcggtggctctgccgtaatctagaggccaaatcagcccatacttcgtaggacgacgcaaaccctgggatcaagatgatatctgttcccgagccttgtaccagaaccgagatgccatgttggttgacggtgagtggcggcagaggcgcaggctgggctggcgatgcagacaacagcgccagcgtggtgccaatcccggcaaggatcattcctgcacgcatggcgctcccctttttgtgcaatgcgaagtggtatttacgctgtcgaagtcgccaattgcaccgatgggcaggccgtttaacggggtcatagccattcctttgaccgaaaaattgttgccactatacggcgcacaaaagcgtcaggaaattaccccacctgcaataatccttggaccgctttgggtcgatagcggtcggtcaaaaacggcggatttcggcccagccttttaagacaaacgcaaacaagtattcagcttactgtctgtgacgtgcaaaccgcagcagtcggccgctgaggcgcaggccgtcacgcatattcagccccattaatgcgagattggtggcccctgcgatcagttcgattacttggacgaagtaaaaacgcgtatcgaagcttcccgctgtcgcccattggttaagcacaatggcgcacggtatcagaaccaacaggccaatgacggcaatgaatggcatgcgtttcttcttcaaagcgaccagtcgtccttgtcgtttacgactcatcagcgctccacttgcaccggtcgcaatcattgccggtaccagtatccaaagcccgggactcacgatcaggtgcttgagtgaggctatcgagtgtccggatccgatgagctcgacaaaaatagtcgacagaaagaaggtggcgatgcacatcagtgccagcgtgctggagatcaaatgtaatcgtctaagcatttatctaataccgtcagacagttggtgagtactcaggccgtgcagacattcgacacagctaccttggtgaacagatgcggcatggccaaggcacttgagggataccgcgccaaggcatcggtgaattctggatgattgaaagcatcgcgaaaccgctctaccgattcccatacggcgtaattcaagaacatgttgctgccaccgatggcctgatggagctgcgtggagatgaaaccggcacgttgtttcatccagttggcatccagctcccatgcgcaaaggaggtcaggtatatcgtctgcgtcgacagtaaagaggttgatcaacaccactggagcttcgctgcaatgcagctgttcagtgatggggacgatcggatcaagggggcgaatagaaagcatggcgacctctacattgtaatcatgatgacaatttggttttcacgctccaaacctactgcgattgacatcatggtgtcaacgtggaaggattcgccctatgaaaaagacaaactacacccccgcaggacgcgccatgagcgatctggttcttgagatctttcgagcaagtgcgcgtctgcttactgcaggcgatcgactcgtcgcagagctaggtctgacaagcgcccgctggcaactactgggtactattgtgtacgccgaacgagcacaaccggtttcatggattgctcgcgacatgggggcaaatcggcaaaacgttcagcggatcgtcaacgatctggtgaaggatggactgctggagtttcagccgaacccacaccaccgcagggcgcagttggttgtcctgactgacgctggaagagcagcattcgacctggcgatgaagcttcagacgccctggattaatgagctggcggaggggttggacatcgatgctatccagactacccatcaggttataaaccacctgcgcaaaaggcttgaggaagaccaggccgactgacccggccagcctcagcataatccagcttgtcaaaagctcaggcaacaaacgatcggatcagcatgtaagcgctggttcacggacgtccgctcctggcccagagtgtgtaaaaacgctcggacaaacccttgctatgatttctgagaaattcatcgtgagggaaacccatgaaacggtttatccaaggtgaacaccgaggccaaagcaccttgcttcctgagaaccttgacgactacgtcagcgatactaatccggtgcgcgtagtcgatgtcttcgtcgatgaactcgaccttgctacgttgggttttgatggcgtcattccagccgaaaccggcagaccttcttaccacccagcgatcctgctgaagatctatatctacggttatctgaaccgcatccaatcgagccgacgccttgagcgagaggcccaacgcaacgtcgaactgatgtggctaaccgggcgtttgatgcccgatttcaagaccatcgccaacttccgaaaagacaatagcaaggccattcgcggcgtctgccgccagttcgttttgctctgtcagcagttgggccttttcggagaaaacctggtcgccatcgacggcagcaaattcaaggcggttaataaccgtgaccgcaacttcaccagcgccaaactcaagcgacggatggaagaaattgagtcgagcatcagccgttacctggctgcacttgatgcggctgatcgccaagtgccaactgcctccgaaccggacgctacgcgcctcgcagagaaaatcgagaagcttaaaactcaaatgaaagagcttcagctgatcgaatctcagctcaacaattcgcctgacaagcaggtctcgctgaccgatccagatgcccgttcgatgattacgcgtggcaacggaatcgtcggctacaacgtgcaaacggctgtcgatacgcagcaccatttaatagttgctcatgaggtcaccaacagcggttcagaccgtgaccaactcagttcaatggcgaagcaggctcttgaagctatcggcgcagaagcgctgtccgtggtggctgaccgaggctactttaagggtgaagaaattcttgcctgtcacgacgcaaacatcacggcctacgtgcctaagccaatgacttcaagcgccaaggctgatggccgatttaacaaagatgccttcgtgtatgacccgacgaaaaacgaatacacatgcccggcgggagaggcactgatctggcgattctccagcgttgagaaaggcatgaatatgcactgccactggagttcaaagtgccagagttgcacgctgaaaacccagtgcacgccaagcacaaatcgtcgagtaaagcgctgggaacatgaagctgtactggaggaaatgcaacgccggctgaaccaagcaccggagatgatgcgcgttcgaaaacggactgttgagcatcccttcgggacgctcaaacaatggatgggggcaacgcactttctgactcgaaaactgaacggggtgagcgcagagatgagcttgaatgtgctcgcctacaacttgaagcgggtgatgaaaatcatcggcaccgaaggcttgttgaaggcgatgaaggcgtaaacacccagcttttactgacccaagaggtgccaaagcgcgtcatacgcgctctgaagcgttaccggcgctgatcgtggtaactaatcgggaaatcgccgcgccctggagcaatggactgaagcacgcacgataaaaaagtgtttttacacactctgggccaaaagcggcccctcactgtctaaaaaccacgagcatattccctgctttcaagaaccagcccccaccaaagtttccaccctccatatcgtaagcaaacgctcaaggttggtaactgcaattgaatcactgcaagtttagacggtcctctgctagcaaggttgatttccccccgactttagcgggatgaacccagttaaaggcggctggggtggcgcatctaactctattagacagccatgccccaggcgagaatggccccaaagcgaaaatggcgttagcattccgcctcaatcggcttaaacagcctgttttttcagatcagggtcgcatcgtggaaaagctaaaacgcctcgaaagtggaatcgaagggctcgacgctctgctcaagggagggctggtcgcaggcgcctcatacatcatccaaggacgcccggggtctggaaaaacgatcctcgccaaccaacttgggttccatcatgcgaacaatggaggccgggttctggtcgccacgctgctggccgagtcgcatgaccgtctttttcagtttctttctactctgagctttttcgacgcttccaaagtcggcgccgacattcaatttgtcagtgcttttgacaccctggagaacgacggtctgggtgaggtagtcaagctgcttcggcgcgagataagccgccaaaaagcgacggtgatggtggtagacggcttgctcaatgcgcgttcaaaagccgattcgcacatcgacaccaagaaattcatttcagagctgcaagggcacgctgctttcgcgggctgcaccgtcctgtttctcaccagttcccgactcgatgacggcagccccgaacacacgatggtagatggcgtgattgagatgggtgaagagctgtatggcactcgctcggtgcgtcgtattcagctgcgtaaaacccgcggcagtggggcaatgactggcctgcatgagtgtgagatcaacgacaacggattggtggtttaccctcgactcgaaagcctctacagccacccatccgccccagacagcgccgacatgacgcgcattgccagtggcattggttcactggacggcatattgggcggggggctttacagttccagtgtgtctctggttattggcccctccgggattggtaaaaccactctgggtctcaaatttctggccgagtcgacggtggatgcaccgggactgcattttggcttttacgagagtccacaacggttgcggctcaagggccagtcactgggtatcgatatcaaagccatggaagacagcggcgcgctgagcattgcctggcagccgacgactgaaggcctgctcgatggtctgggcgcacgactgctgagtatcgttgaagaaaagggcattaagcgcctgttcatcgacagccttagcggcatgacacgtgtctcgacaaatccggcgcgtattactgacttcttcagcgcgctgatgaacgagctgcgatccaggggcgttacggtatttgcgtcctgggaaatgcgcgatctgttcggctccgaggtcagtgcacccaactctgacctgtccagcatcgtcgataacctgatgctgatgcggttctctgagaatcactctgaactaagcaggacgctatccattcttaaagtaagagacagctcctacgatccctctcgatttgaggtcgtcattcgtgaacatgatgttttcctgaaaaaggcttcaagacatgaaccctcagtcaccactgattcatcgcccggttcaatttcttaagcgttttagtaggttgaattaacatgaccaccatcctggtcgtcgacgacgagtatttgatcgctgatattctctgcttcgcgctggaggatgaggggttcatggtggtgacagccagcaacggtcgaaaaggactcgaagttctcaatagagaacagcctgcattgatcattaccgactttatgatgccggtgatggacggcctggaattcgctaccgctgtgcgagccctcccttgcgccaaacatttgccgattatcttgatgagcggtgctcaggcacatattggtatgcagcgatcagatttgtttgatgcggtattggccaagccattcaatatcgatttgatcatcgccgaggttagaagactcttggctttagggtagctcgcagccggtcaggccaatcaccttgctattggccaacacagccccataactatcccggtactcattcagcacaagggcagaccatgaccaaccaaaccgaaaccgcgatcctcgccggcggctgcttctggggcatgcaggacctgttgcggcgctaccccggcgtgctgcgcacgcgcgtcggctacaccggcggcgacgtgccgaatgccacctaccgcaaccacggcaatcatgctgaggcgattgaaatcgtgtttgatcctgcggtaattacctaccggcagatcctcgagttctttttccagatccacgaccccagcacgcccaaccgccagggcaatgaccttgggccaagctaccgctcggcgatttattacctgagtgaagagcaacgcgacgtggccgaagacaccgctgcagacgtggatgcttcgaagttgtggccaggccgtgtggtcactgaaatcgagccggcaggaccgttttgggaagcagagccggagcatcaggattatctggagcgcatccccaatggctatacctgccacttcatccggccaaactggaagttgcccaagcgcgcttgagggtgagcagcgttagagaaaaataggctagaccaccgcataaacggggtctggcctgttttttttcaccacaataacgcttcaacttcgtcgtatttgtccgccactttaagaaaagtgtccgcccaaccactgctgagactgagttcctggagtggtccggttactgcgaatagaacagagacgtccaactttttgggcaaaccacccgatctgagcacgctgaccaaacccagcaactcggccttcgcctgatcctcgtcttcccagctggaccagcagaagtcgttgtcgggaagggaaactagctcaatagcggcttccagcacatggatgagacttccaatcgggtcgtctcgattgatctgtccatgaatcaactgccttgcgcgatccagattcataaagggcttaggcctcactggaggaaagtagcgggcaggccatccgtgttgtggatgtgatctgccccccattttgctgtagtccccatcacgcaaaaagcgtatcgccagtcaatcttctaccagcgcagtcccggtttcttccacgtccgaggtcgcttgggcccagccgatagcgaagacgcctacgaaaaacagcagcgggccggggtaggttctgtagtacatccaggcatccgccgaccctgaaaaactaaccagggcgttgacggcggccaaggctgccatcaacgcagacagctgcagcacggaagttcgccattgcgcgggcgagcgcttcaaccgagcaccgaatatggcgcgcagcaaattgatgcgcagccccatctccaggatcgcgagcagcagcgcaaataccaacagtgcgacggctggcgtgtacaaaatgacgtttctgttggctagcaccaaccggccgaacggcagcccgatcaccagcatgaaggcgatggagtagaggaaaaacacaacgtacgtgcgccatagcaggctgagggccagggaaagtcggcgttttatcattacttcctacatccttgttgtcagaaaagtcgccattgtaggcgcaggacgcgtgcgaatgaatggcacaagaagcggtgcatcgcaaaatcgtaatcgaggccggtttacgctaactatttgatatccgaacaaggaacacttcgatgattcgtcaggcctcacccgcagacgccagggcgattgcccaggtgcacatcagaagttggcaggacgcctatcgcgacctgatgcccgccgactacttgggtgcgttgagttcgacgctggccaggcgcgagtcattttggatggcctcgattgaatcgggcgaatctaacgtgtgggtggcgcaggtgaacaagcaggtggtcggttgggtgtccgtcggtggcagccgtgatgaagatgccccagcgaaaaacgtgggtgaggtcacggccatctacgttgtcgctgagcactggcacacgggcgtcgggctggggttgtggaacgcagccttacagtatttggctgagcaagggtttcagcagctgacgctgtgggtcttggcccgtaatgaacgcgcgatccgattttatcgccgggcaggctgcgttgaagatgcgggcagtgagcgcacgcttgagcggggcggcgtgcagctggtggaggtgaggtatcggttgccgtgtattcgtttgagttaggcaaatgggcggcaggccactgttttagcagtggcctgccgccctttttttaaacgggtaataccgctggaagcttggcctcccgctccatcagcctatccatcaacaagactcccaactcactcaactggtgaatcgccagcgccacatcgcgctgtttacccgtcaggtcttccgacaggtcaagcagcagggcgctcaccgcagaaaaggtttcgtagctgttggtgatcagtgtttcgttgctggcgtcggcggcgacgctgaacaagcctggtggtgcgggtgggtcagtttctggattgagatagcgatcaatcgcgcgatgcgcagcctggttaagtttcaggtccggctcgttcggagggttgggtgtgactttaaacatgtgtgttgtacctgattagggccaacacctcttcgctactaaacgatggggtggcagctgtgggcaggttagtagaccggggaaacacacaaagccggcgcgcccgaggacgccctgcacacagccaccatcaagcacagacaagaacatctgacagatgaggcttatgcactttatgttatcgctcgggctactaaacccgatcactgaatattcagcgaccgagcaaccttagagacgcccactcaagcgcacaagccggcggattctgacgcaagcgtaggcaacggagcaaggcgctgtcgcctaggactttgctgtttcagggcttggtgtaggacatgtactcattctgcaaaacaatatgatccgccacgtacttcgcatcgtgccaaaccccgtagataaacgacgacgcgcggttcaccagattcggcaggccaaggaagtaaatcccgctctgcgccgagatgccacgcttgtggaatggctcgcctttttcgtcaaacgcatcgactttcaaccagctgaaatcgaacttgaaacccgtcgcccagaggatagtggtcacgccagcctcggccaggtccaggctgagggtcgggttaaccaggcagtccgggtcgggcagcaattcccaggcgtcgggctccagtgggaacggcaaaccattggcctcgatgtaggcgtcggcgtcgcgcaacacatcaaagtaggcgcggtcaccttcggccacgttgtcggccaggccgggttcgaaggtcatcacgccgtcgttccaatcgcgcgtgacgccgaccagatgaatgccttggtgggccaggcggcggaagtccacggtcttaccgccttcatagccactgacggcaaaggccacgtgctttttcttcggctgtattttgacttcgtcccacaagcccagggcgccgagccaccagcagtagtcgcggctgcggtaggcgcggggcgggcggtagtgttcgcccacggagaggtacacggttttgccggccttttgcagttcttcggcgatttgcgagccggaggcaccggcgccgaccaccagcacagcaccttcgggcagttgcgcagggtttttgtaggcgcaggagtgcagttggtgcacttgcgcggtggccgggacgatgctgggaatcgaagggcgttgaaacgggccggtggcagccaccacgttagcggcttcgataatgccggctgaggtggtgactttgaagccggggcggcccacgtggcgttccacttgttggacctcaacgccggtgcgcacgggggcctgcaacttctcgacgtaggcttcgaagtagtcggccatgcgctcctttggcgggaaggcctcgggggaaatgccctcgaatttcaacccgggaaagcggtcgtgccaggccgggccgttggcgaccagcgagtcccagcgctccgagcgccagcgttcggcgatgcggctgcgctccagcaccacgtgcggcacgcccatcagggaaaggtgctcgctcatggcgacgccggcctggcctgcgcccactaccagggtgttgatggtttccactgacatgtgcgtttcctaaaagtgagcgacctgggtcggtttgggcgacgcgcaagcatcgacagcctcagtgtgatcacgcagtggaaaccgcgaaattatgctttttgaaggcagaggttaggaaaatcaaaagcccgtcgagcattcgtccataacggcctgagacaattgcatcaaagctgacacaaacttatacatttaattgacgccatcatttcgccaccctatcatcgccgccaattagtggctcagggccatatagagggatctagaaatgtggcgcttggaacgccggaccgggcttggcctgttgtccgctattgtttgtttattgactgccgggctcgcgcacgccgcgcccccgcagaacacccccggcatcaccgacctgatccgtgaccgccaggaccgcctgctcgaagagcagcaaaa

SEQ ID NO: 81 - DNA, 26655 bp, Pseudomonas poae FL10F
aggtgccgagtggtggggcaagagccctttggttactttggggcttttccaaagtgacccgccgtaagggcggaacccatatcagccctaacccaaataacggatatgtacccagcggccccgcgccaaccacagtactcaacccgtaaaaaatatcaggctgcgatagcggtagggcaggcccaacggctgtcactgacccggcgccatcgcaggcaagccagctcccacctatttatgggtgcccaaccactccagcgccgtacgccacacacaaatccccaggaagtaagccgacatcagcgaccacaacccgaacgtccacgggttggtattcggataatccaccaccatcaaaaagctgcacagcaaccagatcgtggtcacggcgatgttgatcggcataaaccgcttgacccgaaacggatgcaaaaacttcatcggcgtcacggtcagcagcgccaggccaatcacggtcagcaaggtgacccaggcttccggctggatgatgtacacgcacagggcaaccacgttccaggcggcggggaagccgacaaagtagttgtccttgctcttcatgttcacattgcagaagcagaacagcgacgacaccagaatcaccgagacggtgaacaggtgggtaaagtccggcaggtcgatatagcggtagataaacagcgccggaataaacacataggtcaggtaatcaatcaccagatcgagcaccgagccgtcgaagctcggcaataccgtgctgacattcacccgtcgcgccagcgaaccgtccacgccatcaaccaccagcgccaggcccagccacagcaggcaggccttgggtgagttttccagcagggccagggtggccaggaaggccaataccacaccggtggcggtaaagccgtgggcgccccaggctttgagtctggctacatgcagggtcgatatcacgggcggttctccaaaaggtgaaacagggcagccgacgacgtaacgccgtcgagtctggccagggaatgcaggtatcgaccgggaaggggaggataaggttcaccgccccggtgtatgacttagcgtagcaagcgcaggacgtttcagcatcaaccctgacggaacaccagcgccttcaggccactttgcgggtcgatatccggaaattcaggcgggttttgcagccgttccacaaagcgcaggcccggtgcttcgcgggtgacgccgtcgatcaggaagtcttcaccgaacgccgggtcgttcatgcacgccagcacgctgccctgtggtgtgagcaaatccggcaggcggcgcagcacgcgctggtagtctttggtcagcaggaaactgcctttctggaaggacggcgggtcgatgatcaccaagtcataagggccgctgtgagtgaccttggcccacgacttgaacaggtcgtggccgaggaacgtgaccttgccgaggtcatggccattcaagcggtggttgtcgcggccacggctgagggcgccacgggccatgtccaggttcacgacgtggtcggcgccgccttcgatggcggcgaccgagaagccgcaggtataggcaaacaagttcagcacgcgctggccctgggcctgctcgcgcacccagttgcggccgtagcgcatgtcgaggaacagcccgctgttctgttttttgcccaggtcgatcaggtaacgcaggccgccctcggtgatggtcagctcgtccacggcttcaccgaccagccactcgatggtgctttgcggcaggtagcggtgttgcagggcgacggtataaacgccgaactgctgcttgagcatttgtttcaacgcctccaactgctcggcgtcgggctctttgaacagcgagaccagcatcacaccttgcaaccagtccaccgtcagttgctccaggcccggccagcagcggccacggccgtgaaacaggcgccgggtctcggtgggcggggcggccagggcggtgcgcaggtgggcgtgcagagtggcgagtacgtctggggtcatcggtcagcgtcggtcattaagcgggcggcattttaaacacagttgcaacgtttcgtgtggcttgagcacaacgtgctgggaaaaagccgaatggcagtgattcatgctcaaaatcgacgcgcctgcgccggataacaggcaaaaaatcctcaagccccgacataaactggaaaaaaagcccggaggtgcccatgaacggtttcgcgagtgcagtcaatcacaccgcgttggatcaagtagagcaggacgagtggcgcgacgccctggcctcgctggtggccaacgccggccccgaacgcgcacggcagatcctcgacctgctggcccgcgaaggcagcgccgcgcacatcgactggaaaccgcgccacggcacgccttacatcaacagcatcagtgtcgagcagcagccggcctttcccggcgacctcgccaccgaagagcgcctggcctcgctggtgcgctggaatgccttggccatggtggtgcgcgccaatcaggcgtatggcgagttgggtggccatatcgccagctacgccagcgcggcggatttgttcgaagtgggcttcaaccattttttccgcgcccgcaacgatggctttggcggtgacctggtgttctaccagccgcattccgcgccgggtatttatgcgcgcgcctatctggaaggccgcctgactgaaaacgacttggcgcactaccgccaggaaatcggcgggccaaaaaccggcgcccgtgggctctccagctacccgcacccgtggctgatgccggacttctggcaattccccaccggctccatgggcatcggcccgatcagttcgatattccaggcgcgcttcatgcgctacctgcaacatcgcggcttgctcgataccaccgaccgccacgtttggggcgtcttcggcgacggcgaaatggacgaaccggaaagcatgtcggccctgaccctggccgcccgcgaaggcctggacaacctgacttgggtggtcaactgcaacctgcaacgcctcgacggcccggtgcgtggcaatgggcggatcatcgacgaactcgaggcgttgttcgccggcgccggctggaacgtgatcaaactggtgtggggctcggattgggatgcgttgctcgccaaagacactgacggcgcgctggtgaacatcctgtcgcagaccgtcgacgggcaattccagacctttgccgccaaggacggcgcctataaccgcgaacatttcttcggtcaaagcgcgtcactcgccaaactggtcgagggcatgagtgacgaacagatcgaccgcctcaagcgcggcggccacgacatggtcaagatccacgccgcctaccacgccgcacgccgcgtcaaaggccagccgacggtgatcctggcccagaccaaaaagggtttcggcatgggcgaagccgggcagggcaagatgaccacccatcagcagaagaaactggatcgcgacgcgctgatcgccttccgcaatcgcttccagctgccgctgtcggatgcgcagaccgaagcgctgagcttcttcaaacccgccgatgacagccttgaactgcgctacctgcaccaacgccgcaacgcgctcggcggctatgtgccgagccgcagccaggccgcggcgccagtcgctgtgccgccggtgacgggctacgccggtttcgccacggcggccgacggcaaggaaatgtcgaccaccatggcctgcgtgcgcatgctcaccaacctgctcaaggacaaagccctcggcccgcgcattgtgccgatcgtggcggatgaggcgcgtaccttcggcatggccaacctgttcaagcagattggcatctattccagcgtcggccagcgctacgagccggaagacatcggctcgatcctcagctaccgcgaagccaccgacgggcagattctcgaagagggcatcagcgaagccagcgccatcagctcgtgggtggcggcggcgaccagctactcggtgcatggcctgcgcatgttgccgttctacatctattactcgatgttcggcttccagcgcgtcggcgacctgatctgggccgccgccgaccaacgcgcccgtggcttcctgctcggtgccacggccgggcgcaccaccctgggcggagaaggcttgcagcaccaggacgggagcagccacctcagcgccgccaccgtgcccaattgccgcgcctacgacccggcgtttgccggcgagtttgcggtgatcctcgaccacggcatgcgccagatgctcgaacacgacgtggacgagttctactacgtgacgctgatgaacgaaaactacccgcagccaagcctgccgcaaggcgtggaagcagcgatcatcaaaggcatgtaccgcctgcaaggcgcggctgacgccaaggtgcgcctgctgggttccggcacgctgttgcgcgaagcccaggcggcggcacagttactggctgaggattggcacgtggcgagcgaggtgttcagcgtcaccagtttcagcgagctggcgcgggatgcacgggaggtggagcgctggaatcgcctgcacccgcagggcgccaagcgcgtcagccatgtgaatgcctgcttgcccaaaggcgcgccggtgattgccgtgtccgactatgtgcgcgcagtgccgcagatgatcgcgtcgtatctggactcccgctacacggtgctcggcactgacggatttggtcgcagtgatacacgggtggcgttgcgtgatttcttcgaggtggacaggcaccacattgtgctggcggcgctgacggcgttggtggagcaggggagtttggcgccgcaggtgtgtgagcaggcgattgagcggtatggcttgcaggcggaaagggacgcgtcctggatctcttgaacaacagagatcacctgtgggagctggcttgcctgcgatggcatcgaccgtgtctttatggctgaccgaggtgtctgtatcgcaggcaagccagctcccacacaagccagctcccacactgttttgtggtgggttttagaacgtggcgatcaaggcaggcccgaacgcctctttcagaaaccccggcgcgatgtagcgttcgtaatgcgcctcggacaacaggaaaaactcccgatcaatcgcgtcacgcaaatccgcaaggctgcgctcacgaaactccggcaacaaggccaagccatacgcatccagcctggaaatcacccgcgcaccccgcgcaatcagctggtacgcccagcaatacggcgattggtgaggcataaagcgaatcttgcgatcttccaactgctggcgcaggcgttgtgggtcgaacacttccaacttgctggccatcacctgcaccagcaactgctccaggcgcagccacacggcctgtttctcgtcagcgttgtagccgttccactgaatcacttcatggtgataacgcttgcagccccgacagaccaggtcgccgtaaacggtggagcacaggccgacgcagggcgttttgatggtttgattgggcataaagggcaatttgcaaagtctatagagcaccgcagatctaatgtgggagcgggcttgcccgcgatagctgtgtgtcagtcaatgcatcagtaattgacccaccgctatcgcgggcaagcccgctcccacaggttcagatctgtgttgttgatcagtcccagctcagcgcgccgccggtttgatactcgatcacgcgagtttcgaagaaattcttctctttcttcaagtccataatctcgctcatccaagggaacgggttagtcgtccctggatactcttccttcaacccaatctgcgacaaacgacggttagcgatgaacttcagatagtcctccatcatcgccgcattcatccccaacacgccgcgaggcatggtgtcacgtgcgtactcgatctccagctgagtcccttgcaggatcatctgggtcgcttcttccttcatctccgcatcccacaagtgcgggttttcgattttgatctggttgatcacatcgataccgaagttcaggtgcatcgactcatcccgcaggatgtactggaactgctcggccacgccggtcattttattgcgacggcccatggacaggatctgggtgaagccgcaatagaagaagatgccttccagcacgcagtagtaggcgaccaggttgcgcagcaactctttatcagtctcgacggtgccggtttcgaacttcggatcggagatcgaacgggtgtacttcaagccccaggcggcctttttagcgaccgatggaatctcgtggtacatgttgaagatttcgccttcatccatggccagcgattcgatgcagtactggtaggcgtgggtgtggatcgcttcttcgaaggcctggcgcaggatgtactggcggcattccgggttggtgatcaggcggtacacggccagcacgaggttgttggcaaccagggagtcggcggtggagaagaagccgaggttacgcatgacgatgcggcgttcgtcgtcggtcaggccttcggggtttttccacagggcgatgtcggcggtcatgttgacctcttgcggcatccagtggttggcgcagccgtcgaggtacttttgccaggcccagtcgtacttgaaaggtacgagctggttgaggtcggcgcggcagttgatcatgcgtttttcgtcaacggcgacgcgggcggcggagccttccagctcagcgaggccttcggcgacgtcgagtttgtcgagggcggccttggcgcgcacgatggcggcggagtcgttggcagtcacgttgcgcgcttccagcgcagcagcggcgcccgcaccgtcgaggcggtccatgttggcttcgctggcatgcccggcgttggcgcccttgatcaccgctgcaccggtgtcttcgttgtcgacttcatcccaactcagcattgaaatactccttcctggtctgttctgacggtgtgtgaacccgtccaaaaatatgcggtttgcaggctactaggcattgaaatattgcgcgtagtgtggtcggtaaataccgatactgcacactatgtagtggtctgttctgtttgtgggcacactatatggtgtgtaacaaagtaggtcaacgcacaagatgtgccgccgccggagtgcttgtgtaggaatgccggcaattgatgtaatgtccagtattggatatgttgtcttgcatgaaaaagacctctcccgaagacaccaccctgatcagccaactcgagcagatcgccgaaggcctgagcaaaaccttcagcccgttctgcgaggtggtgctgcacgatttgcgcgacccgcagcacgcgatcctggcgatccataacaacctttccgggcgccaagccggtgaccccgctaccgagcttggcctggcgcggattgccgacccggactacccgcaggtcattgccaactaccagaaccagttcgccgatggccgccaggtcaaaagcacgtccattggcatcaaggacgccagcggcaagtacgtcgcggcgttgtgcatgaacgtcgatttgtcgttgttccgcggcttgcagggcatgctggaacagttcggttcggtcagcggcgacaagccccacgagtccctggacccgtccggtgccgatgtgattcgcgcgcgtatcgaccaattcgccgcgcgcctggcgaccactccgcgcgcactcaagacggcggatcggcgcgcgctgatgcaagagctgaaggactcaggctgcatggacatccgccgcgccatggaaacggtcgcctcgcacctgggcgtgtcgcgcgcggcggtctacacctacgccaagtagcgcgccatccggggtgtggatgaggtttatggcgcctcgctgagcagggcggcgtagcgctcgatatcgacgttgccgccggtgacgataatgcccacgcgttggcccttgaagcgctcgcccaattggcgcaaggccgccaggcccaggcagccggtgggctcgacgaccagcttcatgcgctgcatgaagaaccgcatgctgtcgaccaattgcgcatcggtgacggtgagaatgtcgttcacctgatcgcggattatcgggaaggtgtagttgcccaggtgttgcgtttgcgcgccgtcggcaatggttttcggggtgtcgatgtgcacgatgctgccggtgcggagcgagcgctggccgtcattgccggcttcgggttcgacgccgaacagttggcaatccggcgccagcgcacgggtcgacaacgccgtgcccgagagcatgccgccgccgccgaggccaacgaacaaggcgtccagcgggccggtgaattccagcaactccttggcggccgtgccttggccggcgaggatgtgcgggtggtcgtagggcgggatcagcgtcatcccttgctcgttggcgaggcgacgaccgatctgttcgcggtcctcggtaaaacggtcatacaacacgacgctggcgccatattcccgcgtcgcggcgactttggcggcaggcgcgtcaatgggcatcacaatcgtcgccggcatgcccagcaaccgcgcggccagggcaatgccttgggcatggttgccggaggaaaacgcgaccacgccggccttgcgctgctgcgcgtcaaactgcgacagggcattgaacgcgccacgaaacttgaacgagccggcgcgttgcaggttttcacacttgatgaacacctgggcgccggtttcagcgtcgagggtgcgtgatgtgagcaccggcgtggtgtgcgcgacgccctccaggcgttgggcggcggcgatgacgtcttggtaaacaggcaattgcatgggacggacctcgtaggctttatctggataaaatatccatatcaagataattagtaaagttccgttcgggcttgctgacatgctagcgtttcgcgcttctctgaccgctcgagggttcgccattgattcgactcactgactacatcgccgacattgcccaaagccctttggcgccgtgggctgacctggcgccctgggcgctggtgacacaggcgccggtgattgtgcgcacgttgctggccgaactgccggctgacgattacgccattcacggcgacgtcgccgtgcaccgtacggccattgtcgaacccggcgccttgctcaaggggccactgatcatcggtgccgagtgttttatcgccagtggctcgctgctgcgcggtggctgctggttggacgcagggtgcatcatcggccccggcgccgaactgaagacctcgtttgtgttcagtggcagcaagctggcgcacttcaactttgtcggcgattcggtgctcggccatggggtcaacctagaggcggggagcgtcgtcgccaactaccgcaatgaacgggcggacaaggaagtattagtgcgcatcgaggggcagttgcagcgtaccggttgcgacaagttcggcgcgttgctgggtgatcagtgccgggtcggcgcgaacgcggtgttggcgccgggtgccttgttggcggctgcgagtgttgtcgggcgtgggcaggtattcgacgcagaggcgtctgcataaacgcaatgttgaaaagaccatggtgtgtcggcacgttattaaatagaatgaatctcatttgagactcactcgcgccgcgcaggtcgcttgccatgaatgatgccgttgtcccgacccacgccgccgaccacacgctgtcgaatttgtaccgcgaccaccgcagttggctggaaaactggctgcgccgccgcctgggcaacgcctgggatgctgcggacctgagccaggatactttcctgcgcgtgctgaccagcacccagccgattgcgcagttgcaggagccccgggcgtatctggtaacggtcggcaagcgcttgctggtcaactttcatcagcggcgcagccttgagcaggcttacttgaatgccctggccaacctgccggaaacttgtgtgccgtcgccggagcaacgctggctggtgctggaaaccctgcaagcgctggatgaattgctcgacggcttaccggtgctggtgcgccgtgcgtttctgtggagccagctcgaaggcctgggttatcgcgagatcgccgaacggctcgaggtgtccgagcgcacggtgaagcgctacatggcgcacgcctacgaacactgcttgctggtcgacctgtgagccgcgatgtcgcacgggcggccgcccagtggctggcgttgctggagtccggcgccgccaccgagcgcgatcacgctgccttgcagcagtggcgcgacagccatccccaacacgagcagacctggcagaaagcccaatccctgcgtcagcgtttcagcgacttgcctcaagccttggcgatggccagcctcgaccgcccgcaagcgacgcggcgggcaattctcaagcgcgccctgggtgtcgcggcactggtgccgagcgcctggctgatcagccggcagttgcccatcgaagcatggcgggccgatgtgcacaccgccacgggagagcgcaggcgcctgccgttggccgatggcagcagcctgcaactcaacacggccacggcggtggatgtcgaccttgcacaacggcgcatcacgctggtggagggtgagctggcgctgactgttccaggttcggcgccgctgaccgtgcatacccgctatggcgaagtactcgtcagccaggccgaggtgtgtgtgcgccaattggcttccggttgccgggtgtcggtgctcaagggcgcggtgcaggtactagatgtgagcgggcgacgggcgaccttgagcagcggccagcaagcgccattgacgccgcaagggctgggcgcctgggtgcccttcgatgtgctgcagctgggttggcgtgacggcgtattgaccgcacagaaccaggcgttgggggattttctgcgtgaattggagcgttaccgccccggcgtattgcgctgggacccgagcctggaaacgctgcgcgtcaccggcagctttcgcctggatgacactgaccgcatccttgccttgctatcccagaccctggggtttgaagtgcgggcgcggacgcggtattgggtgacgttgagccgcacgttggcttgacccattttgttgtggcgagcgggcttcctgtggtgaatgggcatgctgtggcaagcccattcgccacaacaagcgtgctcaccacaataacgccgccctgggacccgaattctagatcacatgcgcccgctgcaactcggtcaacgccagcgccttgagccgcgccagcaacgagtcgcgccggtcgcgtgggtgcggcaactccaccgcgagttcctggcggatgctgctcggccggttgtccatcaccagcacccgatcactcaggtacagcgcctcgtccacatcgtgggtcaccagcaataacgcaatggcatggtgctccgccagttgcagcagcaagtcctgcagtttcatgcgggtgaaggcatccaccgcgctgaacggctcgtcgagcagcaatacttgcgggcgcgaatacaggcctcgggcgattgccacccgttgcgccatgccgccggacaaggccttgggcagcgcctgggcgaaccccttgaggccgacttcctcgatcaattgcgcgacccaggctttgtcatagcggtcgtcgtccgtgaaaccgatgttctgctccacggtcagccaaggcatcagccgtggctcctggaacacgaacgccacttcaccttcggggctgcgcagttcgccttgaaagtccttttccaggccggcgacgatgcgcagcaaggtgcttttgccacagccgctggggcccagcaggctcaccgcttcgcgcggttgcaaggtcaggtgcacatggctcagcacggtggtgctggcgaagtttttacgctcgacgcgaatgtccagtaatggctgcatgctcattgctccgccccttggccattgaacgtgtcgcgccaagccaggcagcgtttttccagggctgcaagcaagccatcactgactttgccaagcagcgccaacacgataatggccgccaacacgatgtccggccgcgaggtttcgcgcccgtcgctgagcaagtagcccaagcccttggtggccgcgatcaactcggccgccaccaggaacatccacgccaggctcaggccactgcgcaaaccggtaaacaggccgggcagggcggcgggcaacaggatacgtcgtaccagtcgacggcgactgaaaccgtacatttgcccgacctctaccagcttgcggtcaatatcgcgaatcgccgcgacgccattgaggtacaccgggaagaacgcgccaatcgcaatcagcacgatcttggaggtttcatcgatgcccagccacagcagcaacagcggcacccaagccaggctcgggatcgagcgcagcccggcaaacatcggttccagataagcctcggcttcgcggctgagccccacccaggcggcgaacaccagggccaggctggcgccgatggcgaagccggccagcacgcgcaacaggctcgcgctgatgtgtttccacaacgcgccttcagccaggtcggtgagggtcacggcgatttcgctcggcgccggcatctggtacgacggcagccagccgatccgcaccaccccctccagcaccagcaggatcagcactggcaacaccaggcctttaagccgccgtggccaggcgctgcggtgagcaatcaccggcaccggcagcggcactgcttgggttttgctggtcatcacgcgccccttactgcttaggcagcgcctggccgaacgaggtgtcgatcagttggtcgatgacctgatccacattcacgccacggcggaccaattcttcggacaccagaatcggcgcagcggacttggacgagagcacatccttacccgtcaacaacgggctgctgaggtcggtgcgcgacagttgcagcttggccacttccagcggcaggccggattcgtcggcgagcagtttggcgaattcatccgggtgctttaccgcccagtcgcgggctttttcataggcaccgagcaccttggtgatggtttgcggatgctccttggcgtacttctcggtgacgctgaccacgccataactgttgaagtccttgttgcggtacagcaggcgcgaaccggcctggatttcactggcggccatgtgcgggtcgaggccggcccacgcgtccacgtcacctttctccagggcgacgcggccgtccgggtgttgcaggtgcaccagttcaacatcgtcttttttcagcccggcgtgttgcaggctgcgcagggtgaacaggtacgggtcggtgcctttggtggcggcgattttcttgcctttcaggtccgtcacgctcttgaatggtgagtctttgcgcaccaccaatgcggtccactcggcgcggctgtagacgtacaccgatttgatcgggctgccattggcgcggctcaacacggccgagaggctggcggaggaggcgaaatccacgccgccgctgttgaggtattccagcgagcggttgctgccctggctgagcacccagccgactttggtctgcggcagcgcttgttccagccagccgaaatgcttgagcaccaggctgaccggtgagtagtaggcgtaatccagattgacttgcgcggggtcggtttcggcagcctgggccagcggttgcaggcacaaggcgagggcgcaggcacccagtaagcgttgggtaaagggtttcatggaacagctccggacaaggcgttgagagaaggcatttcttatattcagaaaatcgaatcggcatgttccatcatgctttgtaggaatatgcagtctctgtgccatctgacgcggaggcgtgtttgctggggtttaagcccattgtgctgtgacgtggacgagcagtttgttgatctgctgttgccaggcaaacagtgcttatatatccatatcgaataaataaagagttatatattccttttaatgtcctttcagatggcgcactttgagggcctgcgcattcgtgcggattgacccaacagccaaaaggaaagccgacatgaccattaaagccatcaacgtgcgcaaccagttcaaaggcgtgatcaaggagattctgctgggcgaagtggtgtccgaaatcgacgtgcaaaccgcgtccggcatcgtcacttcggtgatcaccacgcgctcggtgcgcgacctggaattgaaagtgggcagcgaagtgattgccttcgtgaagtcgaccgaagtctcgattgccaagctctaaactttatccagatgtaggagggagcaagctccctcctatgtttttcagttgatgcgcggcccaccaccacccggttgatgcggttgcggtttgtctggcggggcatcgctcggcaggtttggcggtggtgcgtcggggtctttgtagtccttgtgcaaatcaccatccagtcggttgctcgacgagccacctttgccgggcgtctgctcgaagtgttcccattccgattgctggaagcgaaacaggctgtcatcggtcggcgtatcgcggccgtggtaatggtggatttcgtagtgggcgtactcgactttttccgcccagtcgccttgcaataaaccgtcaccggccaggtcgcggtaccaatcgttttcggcgttggtagccttctgttttttgttgtggtcgacgaagaaaccgataatcccgcccaccaccgccaacaccgcccccaccagaaacaacggcccggtcagtgctgccgccgtgcccgcaccaaacagtgcggccgcgcccaataccccggccgaggcgccgaaagcgccacccgccacttgcaggccgccggcggcttgcgccaacgggtccttgctctgcacgccacttttgatcgccagcgcacccaagacgatatcggcaaagccgccggcgatgtctgtggccgggccgagcaccttgatcactgagccggcgatcttcgccgatttggacgcgcccaacttggccgcgcctgcggcggccaggccgtcatccaggtgggtcgccaggccttcggtggcttcggtgacggctttgtcgccctcgccgaacatcttcgagatgccgtcgtattggctgtccggcacggcgtcgagtgcggtgctgatcttggttttgacatcggcaggcaaatcgctgacgcgaaactcgaagttcggctcctgcaggccggtcttgccccagatctccggcaaggtcttgtccaggcctaggaaatccaccaggccgcctttgcccagcgtctcaccgatcttgtcgcccaggcgcacaaaatggctggaaccaccggcaaagctcaagaagtccttggcgatcgacatgcgctgcgccggcgtttcaccgagcttgccgcctttgccgaccaactggtaaatcgccgagaacatggttacgccagcgccgagggagccgaggatgcccttgctgttcagcgtgtggaacacctcgccgagcatgccgcggtcggccaccgggatataaggtttgctcagcgcggttttcaggtcggcttcgctgatggagccgttgttcttgtacacctcgcccaactcttccagggccttggtgacggcggcggatttttccttgccttccaggccttcgttgaggaatttctccagggtttcctgggagcgtcgcggcaggtcgagcaaagtgcccttcaacacgcctttgagcaggccgaacaggtctttggtggcaagcgttttgttctcgtcggagatcttgctcgggtccgacaaaatcgtattgaggtcggtggtcaagccgtcggcctggatattctgtgctgctttgctagccgcttcggggtcgaacagcgacagcgaggtgagggtgtcgctgaggtctttttgcgcctcggaggtcttgccctggtcttgcaggtctttgaggtacagcacgtaatccgggttggacgtcaggtcgagcagcttttgcttgatctcgtccttgttcggcagtttgttgatcgcatcgtccatcttcgacttgtagtcggcctgcaccgttgggtcgttgaacagctcgccgatctgcttttgcacggccttgccgtcgatgatgtcgtgcatgtcggccgaggtcagctcggtctgcttgctgtcggattcacgccaggtggtgttgaacgggcggcgagcctcctcatagccggtgatgccgtgcccgttctggtaggcggcttgcgcttccagcgcgcgcaccagcttggcccgtgggtcgtccttggcaatcgagccgtccttgacgccggcgcggtaggtgtcgatcaactgggtggtggccagttcgctgacgctgagggtcggcgatttgtcgtccttttcatcggcgtgcacgccggtgtccatgttcagtacatcgaggtcaccggccttgggcaggttgtgcttggcgcgggtatcgtcgaccgcgccggcactgaaggcgtcccacttggccttgacgtcatcgtagagctgcgggctgagttccttggagacgatgaccttgccttcgctggtttcatagcggatcaggccatcgcccagttcgtcaggtgagccgaaggtgatgtcggtgtttttcaggaagtcattcggcccggcgagtttgtaaccttcgctttcacttgtgtggatcttgtcccaggtgtcgtgtgcggtggcaacgcttttgaacaactcggggctgacgtcggatgacaccaccaccttggtgccatcgtgcagttcgtaggtgaggatgctgtctttctggtcgttgttccaactgaaagtcttgtagtcgttcaggcccggcaccggcgtattggcgtcggccagcgctgcaccgttattcagctcgccttccaccacggccttcttgcccgggtcggtatagaccgcgtgcaggcccgccaggtagtcgaacagcttggggttgtcatcacgcgccacgaccatcttctggccgttgctttcaaagcgaatcaggcccgggccgacttcatcttcagggccgaccgtggtgccggcgtagggcggccacacttcgttgtcgctggcgcgcttgtagccagcgtcttcactgctggaaaggccgctgaaactcgcatagtcgtccttggctttctggaaggcctcggggttatcgcgctggctgatgacgaccttggtgccgtcctgggtttcatagcggatcacgccagggccggtctcatccggcgggccgagggatttgtagtcggcgagtttttccggggccttgccatcggcgccgaggctttggtagccggcgttctggctggcaaccacgccggtcagcgatttgaagtcggcgctcacctgcttgaacagctccgggctgtcctgttcgctgacgatgactttcttgccgtcctgggtctcgtagcggatcaaccccgggccgacttcatcgggcgggccaatggccttgtagtcggacagggccggcggtggcgtagcgtccttggcggcgagttcgtagccgtctttcttgctgctatcgaggcccgaggttggcttgtcctgggcttcgacttttttgttggcgctgttcttgagcagcacgtgaaaagcggcgctcgatttggacggcgtgctgggaagggctttaaggtcggacgcgcgatcgagaggctgggtggccatgccatggaactcctgctgttgccggtgggacggataggcaaaaacagtaacagccgaggctgggccctcgttgcgaaacgttgtgaaatagggcgagtcacggccggggattgattaagaataagtcgttacgttaatcaagattttaccgccagtattaacatttagtgtccgaactaaaacaccttgtaaaaccctcacgaagcgttggcggataagtctgatcgttttgctgtttttctacttgtacgtttgcggggtgggattctataagccagggaggtcaaactagtaagttcatatttcggaaataatcatgaacctgtcttctccgataacaaccttgttttttcctcccgctgtaactgctcgcgacactttatcagcgtcttcggtacaacccgatacttctgagcatcatcgcacccgccgggatacatcgactgcaacggcatctcggcaggttattccggatgaggaagtgcctgcggtttttcaagcaaaagtcacacaggccaagtacggcgctgacgctgacgtttacttgaaaggctataaggcacccacgtctgtaaaactgcccgactattctgcatcaatgagccaattggcgcttatgaggcttgcactggataacaaactcgacccggaccaaatgggggccttgcagtactggagtgaacatcgcgtcatgcgtgcggcgggtaacaacgtagcggcctacacttcgatcatgaccaaggtaggcgtgaccaccacaggcaatccccaaagttactacctggcgattgttaaccaattagccggtggcgaatgcgcagggttctcacatttgcattcgttggcggtggcagagggtaaagagcacatcttcctcgggaatatcttccaggcaactgtggatccagacacacccgagtcccaagcgttcttccaaacgcttgccaaggttcaaggcaagctgaaaaaccgtgggattgcgcatgatcctgccacggtgaaagtggcgccgtttaccagcatcgctccactccttaaagattcacctacgaccaaaacactactgatcagcagcgaaggccatcgtttgaccgcgggcgtgatcgtgggcccagggaatacgcgaacgtattactataccgatccgaatatcggtcctaccaagtttgcgtctgccgaactttttgaagaggggctgcgaaaagtctttaccgacagaagactgcagcatctgactcagccgttgcagggctactctgacggccctaagtacttgatcagcgtgtttaaccgcaatcacatacctgaagtgtccggcgacaccaataacatcaagtttatgtacggcgcgcccttgtacgggctcgataaggtcaaggtaatcaatgcctcacggctgccgaccgcggaagatatacgccagcaggccccggcccccgatagtgctgcctcgaaacagtataatcaggtgttgcaaggcctggacgacgtgcaggcgggtaaaggcatggctcaatatcacaaggcattggccgtgttggattcggtcaagtactttatggctgaccatccaaactccatgcttatgtcagtcatgaagacgcttgcgcaaaagttggtcaatgtgatcaatgaggctgaggcgcctgtcgactttccgtttatctttgagcggatggaggcagaccgtgccaagttggcagagcaggcaatcggttcacctacgcaattcaggaccgagcgtattcagggcaagtctgttgatataaaaaacaatagcagcgcccaccccagcaggactaaagcggtgaccgatgcggtcgacgccgcactgaagaaactcttgcagcgtgatcccgccgccgcagaggcggtgggcgagaagatcagagtggtcattgccaaccccggcgatcaagcggaaacacagttgcgcttgggcgaaccgccggttctggtcataggtgacgatttctttgccgctcccaccacggccgacagcaccgttgccgaccgtattggccgtgaggcccaagcggatggcggtgacccgtccacgcaaaaacaagcggcgctgatcgccggcaagctgggcatggtgagttattacaaaaaccactccaaagcgttcctcgagatgctcaacaaccccgaaccgtttcgtggcgtcggtagccacctcagcccgcgcgcctccagaagttcagcagacttcatgacgcaagcgtttaccgcccgtctctacgatggcgcactgaacaaccagatcgaaacgtcaatccgcaagattcttccgttacccgacgttccccaggtgcccgtgaccgtcacgccaccggccgccagtggggtgaccatcgacccggatcaagtgaagcgcctgaaattacttgatgatacccagcctgccttgcgaatcggcgaggtggaagtcagtcgtgtcgagctttacaaaatgggtgccacgctcaatggcaagcccattgaaagcgcgctggccaatgacccgcaggggcgcacgctcgccaacaccctgcagatcgactacgtgcactttgcggcctatcgcagagctgcgtcggaggatgtgactgggcgtataaccgatgttgttgaggcgttggccgctaatcgcagctctgcagtggcgcccttgatcagccgtgccgacggcggcctggtgcctgagacgttacaaaaacctatccgtgagattactcaacacgctgatgagctgcgcgcgttggagagcagcggcaagccgctacctgaggatttcttcgcctcagaagcacctggcaaggtcggcgcgacgaccgccgcaggcctggggatgcgcgccttctcgacttatcatcaattgcgcagtggcattcagaacctggagggtggagacaccacggcaggggttattaatttggggtccgtcgtggcggatttcgccggtgacggcgccgaatatgccatgaaccgcgcggcgcaaaagatcatcagcagccaagcacccagcattgccggcttcaagaccggcagcctcggcaaaatgatcggcaaggccggtggtggagtcggctcgctgttgagcgtgccttttgatatctacaccgccatcgattcattcaccaaagtcacaaaaaccacgggcaaagaggctcaggatcactatgtgaacggtacgatggccgtcgcgggtgcggtcacttcgattgccttgagcgcctcgtttatgacccgcggcggcgcttcatcccgagtgggcatggcggtggcggcgacgttaatgtcggcgcaagcgatctatacggcggtgcggggcgtagaggacattgatggcgtaacgccgctgaccggcccgcagaaattcagcagtggcctgaagttcttcctgggaattgaaccaggcttcgatgtcatgaaaccctacctggaagccaactattcaaaggcgaatgacgcaagtaaccggacccgctacgagaattttctcaaggggccaggcaaagaattctttgagcgggtggtgatcggctctaccgacgtagaggtcaagcgcgtaccgggaagcgttacgctgacaccgtcactttggtattcgcccatcacgtggctgctgaaccttatcccggcgccgggcctggtgccgcaggtgagcgcaaaaggtggcaaggatcatatttccagcgacctcacgtcctggaaccaaaagccggtcaacacggtagaaggcgagcaagggcaaaacaaagccacctactgggacttgggcgatggcaatgactgggtggagggtatcaagcaaaaacccaactacttcgtgatgggcggcggcaaaaaagggatcaagggcggcgaggcggacgataagttcgtcttcaatgccgatgcacgccaggcacgggagcaagccagcgaggtggagcaagcgcccaacctggacagcaatgcccacgcgagcgtactcgatggcgggcgcggtcgtaatgcgttgatcttttcggggcctttaaccaccacgttcaaagagaatggccaggacacgaccaccaaataccttgggcatcacatcaacttgcaaaccaatacagtctcaatcagaaccccaacccggttgaaagaccgagactataaagtcgataccgacggcttgaaaaaaatcgcccatatccaggcattctccgatgtgacgacggtggcgcaggcgcaaagcgttatccagggtgatgatcagaacaatctgttcacactcaatggcaaaatcgacagggttttcaccggcaaaggcgcgaactttgtggtgatcaatggcggcgctgaagtcgtcggtgagggtggggccaatacctacctgcttaacaaggccagtcaggccaatagcagcgtgatcattgaagaccctgccgacagtatcgtcaggctcgactatagcgccgcacaagtctcggactggaccctgttaccctcgggggatctgatcgtgaccctgacgggcgatacccctgatcaatcacggattctggtgatcaagaaggcgcttcccaacgactcgccagacgataaggcgcggccgacattcatcaccaatgacggcgtgatgatgacgatcagtgcaccgcgacaggccgattcatccacccgcgttgtgcaggtccatagcatgaaggttgaggtgacacctaaagcctaaagcataagctgtgacgaaagctgatgggcaccgccaaggcgcccgtcagtgtcaacggttttgcaggctgcgttccatgcgttgcaaaccttcttccagcatcgcccgtgggcaaccaaagttcaggcgtacacactgctggctgtcatcaccgaattcgattcccgcgctcaaaccgaccttggcctgttccaggaaaaactgctgtgggtcatccagccccagcgcgctgcaatccagccacgccaggaaggtgccctgtggggcatgcatcactacgccgggcaaacgggtttttaccgcgttgagcaggtagtcacggttggcttgcaggtactgcaccagcgcgtcgagccattcgctgcactggctgtaggcggcgcgggtggcttccaggcccagcgggctgacgctgtcgaccatgccgcagcgcgcagcattgaagcgctcgcgcacgtcggcgttctgcaccacggcaaagcaggtcttcaaaccggcgacgttgtaggccttgctcgccgacatcaaggtgatggtgcgctgggcgatctccgggctgaggctggcggtggggatgtggcggcggccgtcgaagcacagctcggcgtggatttcgtcgctgatgatcagcgtgccgtttgcaaggcaggcgttggtgacggcgagcagctcttcgcgtgggaagaccttgccgatggggttatgtggattgctcagcagcagcgcgccggcgccggcgagcgcctgcagcatggcaggcattggcgtcacgtattcgccgtggctcaactcgaacggcacttcgatgcgcggcaggttccagtggcccggcgccaggcgaatcggccggtagttgggggtttgcagcaccaccggctggcccggctgcacgaaggcgtgcaaggccatgttgaagccaggctcgacgccgggcagaaacagcagctcgtcaggctgcacgcgccaggcgtatttggcccacaggtcggcgacgatggcgtcgcgtacatccgggccggcgacgctgtagccgaggatctgctggtcgaggcgcgcgtgcaaggcttgcagtatggcgggtggcgcggcgatatccatgtcggcgatccacatcggcaagacgtcttgcgggtaacggctccacttggtgctgccggtgccgaggcgggggtggatcgtgtcgaaatcaacgctcatggggggctcgtatcaggtaggcaggcgcaagaatggcgctgattctagcgccattatttttataggccagcgctgattgccgcggctaactgccggtgcgcccgctccacggatcgagcgaccgcttcttcaccccgcaccatggcaccgaggtagacgaaatccaccgtatggatgccgaccgttgcgaggatggcggtcacatacggcgtgagaaagtccggttcatggcccttgcgcgcattgcctgaactgaccagcacaaaggtgcggcggtcattgagcaggccgaccttctcaaactgcgcattcacggtgaagctgcgttgaatgcgcaccacatggtcgatccagcctttgagcgcggcaggcacagtgaaattgtgcactggggtgcagaggaccagcaggtcgcaggcctccagctcaacgatcaactgttccgacaaggccgttgcgctgccgctcagcccgcctggggtagtaagggcattcgcatattcgcgggtcaacggcggcagcgcctggctgccgtagtcgcgttcggtgatagcggcgttgggcacgagattactgagcaaggcgcgcgccagcttgaaggtctgcgcggccttgccgtgggggctgaaactgagcaacagcgcgcgggtcattggcttaagtcctgggaaaagtgcatgcccagtggcagcaagccttggcggaaatagaagcgttgggccagggccatgtgcatgccggtgtccaataccaggaagcggtagccgcgtgcgcgggtttcctcacgcacccggtcgagcaactgttcgcccaggcgccgacgctgcagcgtggcatccaccaccaagtcatcgacgtagataaacggcccgtacagggtgttttccgtgagccggtaacctgccaggccgatcactttgccgtgctcgcgcgcggccagcagacggtagccgttctgctgttggcgccggatttgcgcggcgaacgctggcgcgtcagtcaggtgcgggcgcagttgctgcatcaccgcgaagcattcgaggtaatcggcctcggtttccatctgcacgaattcgacggggtcattcatcgttgaggttctccaggtgggccttgatcgcggccggcactttgcgaaagctgatggcgacgcggttcaaggcgttcatcagcgcaatggccagggtcaggtcagcgatttccttgtcgctgaacagcgccgctgcctcggcgtagtcggcgtccggcacctgggtgtgtgcgacctgcgtgaccacctcggcccacgccagggctgcgctttcacgcggcgtgaacagcggcaacgactcgcgccaggcggccagcagcatgattttttccaggctcacgcctctcttgagcaggtcgcgggaatgggcgtccaggcagtacgcgcagccgttgagttgcgaaacgcgcaaatacaccaggtcgatcaattctttctccaggccgcagccgtggatgtagctgtgcaccgagcccagggctttgtagccgacgggagcggcctgggcgtaatcaagacggtggttcatgggcgttccttttggggtaagggatgcgccattttcggtggcaggctggtcagccaacaggggcatgattggacaagtgggttgggacatgatcagacttggctgtgtgtttctgccgagcttgtctgcgatgtcatcactgcccaaataccaggaaatctatcggcgctttcgcctggccattgaccagggccaactcggcccgggtgatcgggtgccgtcggtgcgcagcctggccctggaactcaaggtggcgcggggcacggttgaggcggcttatcagttgttggtcagtgagggttttttcgaggcgcgtgggcaggcgggcactgtgattgccggggctttgtccgccaccccgctgaagccgcagcccgccgtggcgccgcctgcatccggccctcggccgctgcaaatgggcctgccggcactggatgcattcccgcgcaaactgtgggcgcggttggttacccggcaggtacgtcgcaccgatgcggacagcctggcgatgggcgacgtgcgtggcgctcatgccctgcgcgcggcgattgccagttacctggcgttgtaccggggcgtggagtgttcgccgcagcaggtgtttgtgtgcgcagggtatgcggggtgtttgacgctgttgtgcgatgcgctgcagatggcggggcagcgttgctggtttgaagacccagggtatttgcatgcacggcagttgttgctgcatcagggggcggaattggtgccggtgccggtggacgctgaggggctggacgttgagcgcggcaggcagcgcgatcggcaggcgcggttggcgattgtgacgccggcgcatcagagccccttgggtgtggcattaagcccggcgcggcgacgggcgttgttggcgtgggcgcgggagcaggggagttgggtggtcgaggatgactacgacagtgagtttcgctatcagggccagccgttggcggcgctcaagagccaggacgtgggggatcgggtgatctatggcgggagcttcagcaagatgctgtttccggggttgcgcttggggtatctggtggtgcccgcttcgttggtcgaggcgtttggtcgcagtgccgaggtgttgcagcagcgcagtgcacagctgttgcagctgacggcggcggattttctggagcaggggcatttcacgcggcacctgaagaagatgcggcttttgtatgcgcaacgcaggcggttgctggtgacggcgcttgggctgcactgcgcggagtttttgcgggtggatgagcaggcagggggaattaacttgctggcgcggttgctggtttcggtgccggattgtgttgtggttgaggccgcaaacaacgcgggcttggctgttcagtcgttatcggggtggatgctggagcctggcagtgagccgggggtgttgatggggtttacgaatgtactgacggcagagcaggcagcggagctggctctggttttacgccgggttattgtcgagtccctatccactccttgggtaacggctaaatctatctgatggaatgagatcaaaatgtgggagcgggcttgctcgcgaatgcggtggttcagtcagctcatgtgtta

SEQ ID NO: 82 - DNA, 22830 bp, Pseudomonas poae FL10F
gaactcagcagtgaaacgatgcatcgccgatggtagtgtggggtttccccatgtgagagtaggtcatcgtcaagattgaattccgaaacccctgtctgcttacgcagacaggggttttgtcgttttagggcgagtgactatgaatacctaatgctgaacccgtagcatcagactcaccctggaactggcaaaaaaaagccagcgcctgaagtcaaacgctggcctctcaacactatcagcagatcagaactgatagcttaccgttgcactgacattacgctcttctcccaggtagcagaaattcaggctggcacaggaggctacataagtctcattggtcaggttgttggcattcaaccgcacatccacgcccttcaaccctactttgcccaggtcatacccgactgatgcatcaaacaaggtataggccggcactttcattgtgttctcagcatctgcccagctgtaccctacatagcgaaccccgcccccaagccgcaagccatccaaggctccgctagcaaatttgtagtccgcccacatcgacgccatatgacgaggcgcctgagtcggaaaattacccttgttctcgatcaaattgtcggcggagctcaacgtgctcaccatcgacttggaatacttgatgtcggtaaaggtatagctgcccaagagcttcaagttatccgtcagttgcatatgtgcttccagctccaggccttgcgagcggacagcacctacagcccgatagaagttctcctgtggcagcttggtcgccaggttttcctggtcgatacgaaaccaggatgctgtaaacaagttgtcggtccccggcggctgatacttcaagcctgcctcccactgtgtcccattggtcggtgccagtggattgcccgcgctgtctgaataggagttcgggttgaaggactctgaatagctgacgtaaggtgccaagccgttatcaaacagatacagcgcacccgctcgacccgtcagcttggtacgtttgtcagagatctccgtgcccagtggacgacccgcctctgcgatacggttttcatcggacgtctcgacccaatcctggcgcagccccagagagaacctccacttgtccatttcaatcaggtcttgaagatacacacccgtctgttcaaggcgacgcaggtagctggttgggttgtaatagctgatcgctgaattgccgtaaacagggttgaacgcgttgatcggttgcagcgacccgctggaccaatccaccaccgttttacgccgctgataatcggcccccgtcagaacagtgtgcttggtcgccccagtaaaaaactccgcctgcagcatgttgtcgatgatgaacgcgtgcagcttctcatcgccgcccgaatagtagcgatttagctcattactggtcggtgtggtccagccataggcatacacctgatccaacttcaccttggagtcgaggtaacggaagttctgccgcgcagtaaacacatcgttgaagcgatgctcgaactgataaccaaacgactgctgatcacgtttgtaaccatcgacgccgggctcgccttcgaaaaagtggctggagattcgctgaccattgcgctgatgcaatgcgccgtccgccggcatgccaccgtgataaccaccgtcaggatcgtgctgtagatacgcctggagcgtcagcgaggtgtcctcggtaaagtcgatgctgagcgtcggtgccagtgcgaagcgcttttcctttgcgtggtcgaactgcgtgtcggacttgtccgccaagccagtgaggcgataggcgatgcgtttgtcgtcgtccaccgggccgctgaagtcgaaacccatgccctgttgcccgcgactgcccactgtcgcttgaacctgatgataaggctcgaacaacggcttcttgctggtcagtgcaaccaggccgccgggtgagctgcgcccatacagcacagaggagggccctttcaggatgtccacgcgttcaagaaagtaggggtccacctgcatcgtgctgtaagtgccgctgtcgcccatggacttcaacccatcaaggtagatgttatccacagaaccatcattgaaaccgcgcatggctacgtagtcataacgatgggtcgcgccatacgggttggtcagcacgccaggtgtgtagcgcatggcctgcgcaacagtttgggagccctggtcgtccatctgttcacgggtcaccacagagacggtttgcgaagtttccagcagggcggtgctggtcttggttgcgatctggctatgggtggcgttgtagccttccatgctgcccaaggcattccccaacgcgaagcctttgatatcggtggtgggcaatgtcagcgtgctgctttgcggctgagcctgtagaacaaaactgacgccgtcctgcgaatctgcctgcaacccggagccggcgagcacatggttcaacccttgttcggctgaatactcgccgtgcagcccaggcgattgtcggccctgagtctgcgcaggcgtgctggaaagggttatgcccgcctgccgggcgaactgattgaggacctcgctcagcgagccggctggaatgtcataacgcggattcacctgcgcgctggccgcctgcgccgccatggccacagtcgaaacagcacccatgcccatcgccgtcgacaacaacgcggcacgtatggctttggctaaaagagggtaggaagagtctggtgagttactgagaaaacgcgcagtcatgatcaaggtccgttgaggccggtaaggcagatggaaacgcttactgtctaagccggactcacggaaaaaacccgccaaactacttcataaaaagtcaggccgagcgctccaggctcacccaccaacgtgtgcgataacgcacgcgaacaggtagcgtctgcggcaggatcgccagcaacttgtcggtgtcctccagccgaaaaactcccgacagccgcaagccggcaacatccgccgaacaacccaggtagccatggcggtaacgccccacctccgacaggaagtcggccaggcgcataccacgcgtcacgatcagcccatcggtccacgccccaacatccatatccaaaggcggggccggcgtggcatgcgtctggtttacgagatagttttcccccgcgtgggcttgagtcgagaacccatccgccgaatgcggtgaatgaatggccacattgccgctgaccacgctcaagcgtgtgcaatcgctgtcttggcgcacgctgaagcgcccgtcaatgccttcgagcaatccatgccgagtttggaccagcaagggcgctgacaaagtcgtgccgcaagtcaccaggatctccccacgcaccagcgtgatgaggcgttgctgcgcactgaagtccaggtccactgcactgtcggtattgagttgcaggcgagtaccatccggcagttgcacactgcgccgctcgccagtggctgtcgcgaggtcggatgtccagcgctgccagccggtcaggtcccgactgacccacgctgcagagcccaccagcactacaccggacaacatcttcagtgcctgccgccgacccaggccgtgtgcaacattttccagggccacatgggcccccggaatcgcagacaattggctgttcaattcctgctgaagcgcctgtacccgctgccaggccagctcatggtcaacatgcgcctcgcgccaatgctcgcattgcgcatgcaggcgctcattggcgcggttattacgcaggcgcagggcccagctgatggcttgcttgaccacttgggcatcgggtccggaacgcgcggcgttatccacaggcatcaagtctcataacgcagcacgtaacagtgatacagcgcctcagcgatgtagcgttccacagagcgaaccgacacgcccatctgctgcgcgatctgcttgtacgtcagcccatcgcactgagccagtagaaacgccttacgcaccttcggcttcaatccgtctaaaaggcgggcgattgcctccagcagttccagcaccaacgcacgtgcttcggtgctgggtgccaacgcttccggcaggtgggcgatggactccaggtaagcgcgttggatttcttcacggcgccaatgatcaatcaccaaaccccgggcgatggtgcgcaagaaagcccgtggcgccttgagttcaaaccgttcggtcttttgcagcaaacgcacaaaggtgtcttgcgctaaatccgctgcatcggcggcattgcccagccggctgcgcagccacgtgttgagccaattgtgatgggtgcagtaaagcgtctgcaccacactttcacacgcaatgtactcagtagatggcattcacacaggcccggccagacgccacaaatgataattagtcgcattgtctgaaagcctgaaagattttgcaatctctcctcgcagcgcctgcaccgttggtcggtttcctacgcaaaatgatgatgattctcacaaatcactaagatttctcttggtgtggccgaaagcctgacgagccatgcgtgcaccgaaatagagcggtccaagagagtccgcctatcccgttacatggaatgttccactcggcacgctcatccccctttggcaaaagaagtcgatgaaatgaatctcaagttcagtcataaaattctgttggccgcgtcaggcgtcgtggttctcgcattcgcgttattcacgctttacaacgactacctgcagcgcagcaccatcaagcaaaacctggaatcgtccatccagcaatcgggtgaactcacggccagcagtgtgcagaactggctcagtggtcgcatcctggtcctcgaaagcctggcgcaaaacgtcgcgcatcagggcagtggtgccgaccttccgggcctggttgatcaacctgcgttcacctcgaacttccagttcacctacgtcggtcaaaccaacggtgtgttcacccagcgccctgacgccaaaatgcccgacggttatgacccacgtcagcgtccttggtacaagcaagccgtggccgccgacaaaaccatgctcaccccgccttacatggctgccgtgggcggtcagatcgtcaccatcgctctgccagtcaaaaagaacggtgagctactgggcgtagtcggcggtgacctgagcctgcagaccttggtgaagatcatcaactcggtggacttcggcggcatcggccatgcctttctggtcagcgccgatggccaggtcatcgtcagtcctgaccaggaccaggtgatgaaaaaccttaaggacatctacccaggaacaaacctgcgtatcgagaaggtcagccaggacgttgtcctcaatggtcaggaccgtatcctctcgttcacgccaatcaccggcttgccaggtgccgattggtatatcggtctgtcgatcgacaaagataaagcctacgcaccgctgggcaaattccgtacttcggcattgatcgccatgttgatcgcggtcgtcgccattgctgtgctcttgagcctgttgattcaagtactgctgcgcccgctgaccaccatgggcattgccatgcaggacattgcccagggcgagggtgatttgactcggcgcctggacgtgaccagcaaagacgaatttggcgaagttggcagtgcctttaaccagttcgtggagcgtatccacgcgtccatctccgaggtgtcttcggcgacgcgtcaggtgcacgacctgtcccagcgcgtgatggcgtcgtccaatgcctcgatcatcggctcggacgaacaaagtgcgcgcaccaacagcgtggctgcggcaatcaacgaattgggcgccgccacccaggaaatcgcgcgtaacgcggccgatgcttcgcagcacgccagtggtgccagcgaacaggcagacgacgggcgcaaggtcgtcgagcaaaccatcctggcgatgtcggagctgtcgcaaaaaatcagcctgtcctgcacccagatcgaaacgctgaacgccagcaccgacaacatcggccacatccttgatgtgatcaaaggcatctcccagcaaaccaacttgttggcacttaacgccgcaattgaagcggctcgtgccggggaagccgggcgtggtttcgccgtggttgccgatgaagtgcgtaacctggcgcaccgtacccaggagtctgccgaagagatccataagatgatcacttcgctgcaagtgggttcgcgtgaagcggtgaccaccatgaacgccagccagacctccagcgaagaaagcgttgaagtggctaaccaggccggtgagcgcctggtcagcgtgacgcaacgcatcgtcgagatcgatggcatgaaccaatcggtcgctgccgccaccgaggagcagaccgccgtggtggaaaccctcaacgttgacatcaaccagatcaacctgctgaaccagcagggcgtggccaacctcaacgaaacgctcaaggactgcgatgcactgtcccagcaggccagccgattgaagcagttggtcgacagcttcaaaatctgaccctgtttgtgcaggagcgaggcctctcgctcctgctgatcagctgagcatctggcgcacattctccagtgcgctgtcggcgaatgcctgcacaaactcttcaaacgctgccggcggcatttccagcggctcgccaataagcgtccaggtcgccctggagcattcctccccaagcccttcaacacgcattgcggcccacaactgcgcgacgcccaacgtgttgtagatcgtggtccacgtcatatacatggcctcgtcgtcatggctgttgagttgctcgacaacgcaatgaccatcgtggaaaaacttcgtgcgtaacgcacctacacccgcccccgtcatttggatgtgcgacagcgcgggaataaaggcatcaaagcctgcaaagttgcccaccacaccccacaggcgagcggcctcgcacgggacttgcacagacgccaccaacggtgcgccgccagggttgcggatcaatgtatcgggttgcagcggtttcataagcatgtcctgacggggttagataaagccaatggccttgaggtggtcacagcccttgcgcagcagcgccgggtccttttttgggtagtgctcgcccatcgcgtccacaccctggcgtgcgttgtcgtgacaaatcatcgacacgtcgctgatgtcttctgccaggtcattcaggtaaaaacccagcacgccaaacagcgcgttttcgcggcccacggtgcgtagcgcactttgccagcgcgcaatgctcacccgttcgaagcggtggcccgcttggctgaacgcatcaaggtaatgttcccaactcaacggttgtgggttgtgcaggttgaagacgtttcgcccggcagcccactggccgcagtggaacgcaacgaagcgcgcaaagaagtccaccggcatcaggtcgaagttcacctccagacgcggcgccaggcccaactgcaacgaccctttgagcatcatcatcaggcggttgttgtgcggctggcagacgccgttacggctgttgaacgcgatgtttcccgggcgatagatgttcacccaggcaccttgctcggcagcacgccccagcagtcgttcggcgacccatttggaaaggttgtagccattcttgagatacagcggcaacgacgccaccgcgtgcgtttcgaggatgtaaccctgggcgtcaatatgactgcaggccgagagtgtcgagacgaagttaaagacttttttgcaatgggtttcacacaggcgcaggcactccagcaccggttcgacgttgtccctggcaagtgaggcgtagtccatcacatggttgacccgcgcagcgttgtgcaccaacacgccatgtgtgcgggcgaggtgctcatacacatcgcaggccaggcccagtcgtggctggctgatatcggcggcgtagacttgcacgcggctcaggtccatatgctccaggcgatactcgcgtaatgcctcggcaaaccgtgccgcagcgcaatgccccggttgctcccgtaccaggcaggccacttcctgcgcgccgcctgccagcaacgcttcaaccagatgcacgccgacaaaactgttggcgccggtgacgatgactttgcgtgggtcgccagcgcggtccgcgtgcagtggttctactgtcaacggttgtgacgcatccagctccacctggcccgagagtgcattgggaagagctccgtcttccaacagcacggcgagcgtacgaatcgtcggggcttcaaagaatcggctcaaggacaggctgcgaccaaacatttcgcgcacacgtagcaacagggtcgacagcaggatggagtggccgccgaggttgaaaaaactctcgtcaatgcaaacgtcatcgccaggcacatccagcaactcgctccacagcgccaccaggcgtgtttgcagaggcgtttgcgcgcgactgccggcagtgtgtgcagccgtgtgcatcggtgtcgccagcaatgcctggcggtcgatcttgccgtgacgggtgtgcggcatagtgggtaactcagtccacacctcggggtgcatataggtcggtaaccactgctgcgcatgttgtttcaagcctgccagcgtggcgcccggttcgggctgggcaacgaagctgaaaatcctgcgatcagcatcgatcaccacggccacttggcgaaacaatcggctactgcgcaggcactgttcgatttccagtggggccacccgaaaaccgcggatcttcacctggtcatcgcgtcggccacccaactcgataccgtctggcgtccatttcgccaggtcaccgctgcggtaagcctgcagcgtctggccagtgggcagtctcagttcaacgaacgggttgtccacctgctgcggcgcgttcacataccccaggcttacgccggggccgacgatgtacagttcgcccgtcacctgttcatccaccggttgcaggtgctcgtcgaggatcagcacctggctgttggcaatagggcgcccgaggttgcgattgctgtctcccggttgaaacgtccggtgggtcaccagcaccgtggcttcagtagggccgtacagattgtgaaagtggcactggctcgccaatcgtccgatcacgcacggctcgcaggcatcgccacccgtcagcagatgggtcaagcccagtggctgatccagcggcaggatgctcagcagcgccggtggcagaaaagcgtggctgatgcgtcgctggcgaatcaggtcgaccaactgctgggggtcgtgccgttgttcctggcttggcacgatcaactcggcaccggctaccaaggccgggaagatatcgatcagcgatgagtcgaaactcagtggcgaaaattgcagcacacggctgtgttcatccagtgccatacggtcaccaagccaggcggtaaaatgtgcaaggttgccgtggctgagcagcacgcctttgggttggccggtggtacccgaagtgaaaagcgcgatgcagggcgcctcggcgtcggggcgatggtgcgtaaggggctgcggggtatcggcgtgcgccgggtcgaggttactgacatccaggctgacgaactggtcgcgcagcgggtgccgcccatcatccagcaacacgctggccttggcgctttccagcatcgcctgctggcgctgcgtcggatgatccggtgccaatggcaggtacaccgcgccgcaactcagcaccgcgagaatgctggcgtacaactcgatggacttgtccatgcaaacgccgatcaccactggtgcttcaatggcctccagcagtgggcgcagatgctgctggatcgacagggcccgagcctgtaattgccggtacgtcaccacactgcccgagatattcagcgccgggcgttcggcgaagctgtgcaggctggcgtgtaaccgttcgatgacgggcacctgggctgccagcaatagcgccggctgcgcagtgcgattgaaacgatgcatgaatgccaatgcgtccagcccttgcagaccttgctctggccaactgttcgcgagggcggtgacggtgaaaaggcccgcatccctggagaacccgctgaccagcgaggcagcccattccaccagtgcgtctgttgcgcgtcggcgcaatggctggccgttgccactgggctcctcgtccacgtcctgtgccgccagaacgcgcctgtcctggtcatagcagcgtagctgcagcctgggcagcccatattcggacaccgggccgatccccaaacgcaggcttagccattgggtatcgccggtcggtgtgagcggcggttggctaccgtcttcaatcacgacgtcaaatgagtctgttgtgctgacgtgtccgtactgctccagcgtttgcctgagcgcttgcagtgcagtgctggtgccattccatccaatcttcaagcgcctcatgccggcctccccgattcgggcaggtagtggctcagggcctgggcaacgctcggcgtttgcagcaggctgctgtggtgcaggaaccccaggatgttgccaagcaacgggtgatgacggctgataggaaagtccagcgcggccacttcaccacgcagtgcgtggcggacgtcgacgctgacgtccaagtgttcgatcagctgtagatcgaagcctttctgcagttcgttggtcaggtaatgcgtcaaaaaggtcggcagggtctcagcgatgcagtcgcggtccgccgggcttgccgcttgccagtagaggcgtaccagttgggtccagaactgtgcatggcgcccttcatcaaacaagtgatcagccatcaagccacgaacagaaggcttgatgctgtcgtccttggaaaacgcggcgacgtcatgggtgaccgtgttttcggcgatggccacaccaatcaacgccacggcatcgcgcaagcgcggcggtgccagggcctgcgctgccggcagggcatggctcagttcgatttgcccaggcaggtcgatggggtgtatgccggtcatgtccacggcctgttgcaggaaatccatcgcgaccagcgcgtggtaatcctcatccaccacgacggccatcgcgtccacgcggcaggcaaacgggaagggcagcgagaagcgattcctggcaatgctgcgggcggtcttgccgacgatctcggtttcgaagatcaccacgtcgttgatgaatttgtagaaactttgcaccagcacgaagtcgcgccactgcgggcaatgttcgagaaaagccgcactcagcgccagaggctggcggcacaagggatagatcaatctgtcgtcgtgttccagtaaccgccgaggccgcgtgcggaccgttgcgcggcgttcccagtcctcggcaaaggagcgatagttggcggcgctcatggctgcacctcgttcagcgagacacgcacggtgtcccagaaactgaggcggctatgtacggcgaccagtgccatttcgtcggcctggcgttggcgggcagggtctgtgccgatcaggcgttggagtaactgttgcgctgccggctcatgatcctgtgaatccaattcaatgtgacggctgaggtagtgagacagggttggcgcctggcgctcaatgcatgcgttgccgtgcagaatgcgttcgaacatcggcgcaaccacactctcgcgaccatgcaggaaggccgccgccacgcagtgtgtgggcgcattcagtgcgacctgcaacgtgctgtcgacaaagcaggttacgctcggcggcacctcaatcatctgcagggctgcacttgccggcacgctctggcgctgcagttcgatgaagcgctggacggcggtcgtgtcggcgcccacctctgccatcgcctccagatacagttcgaagtggctgcaatggccacctttcggatgttcgtcggactcttcgccgagcacgatttcattgatgaggcgtgcggcttgcgggtcagtgggtggcagccagggtaattgcgtgcaggtcaggtcttgttgcaagcgtttggtcagggtcatgaaatcccagacggcaaatacgtggtgctccataaaaagttgtaacttgttaagtgaagttatttctacaaataatggatggctgcacaactgcagttttttttgttcaagtaagtgttggtgcatggttgacgcctatagttgttgcgactgcgctgtaagcagtaaggggtttgtaacttgattattaaaaataatggcgtttagccgcgtcatgcgcactgtgctaacggggcgtagggttatgctgccgtatgaagtgttttttgtggcgagagataataatcgtattaaacgttttgatgagcttgtgaatatgttagatgttttttcgagaaatattttgttgtgagcaagttgcccagttaactgttagaagtttccttgcaatgagcagtcccttataacgacgcgtcgtggagctcttccctatagcaaaggagccccacatcgtagagagatcaaagaaacgtgcggtaagccttactgggcctctttctttgcggccgcttcaaggccgttgaggtaggtggtgatcacctccatgccccgcatcaggtgattgcgcagcgtcaggatgctttcctcgactttcttctgcgctaccaggctcagtaactcgcggtgatcttcctgggacgtttcgcccaaacccatcgcctcaaggttgaagcgtagaaaacgctcctcctcattcaagccgtgttcaaccagcttgagcagccgctggttaggcgccttgccatagagcaccatgtggaacaggcggttgaggcggccgatttcggaatagtctttctcctgctccaatgcattgatataggcatcagcctcagcgatgtcggcatcggtgagcaacggtgtcgacaagcgcaacgcttcggattccaacagcatgcgcagggcataggtctctgccgaattgtcctctatcaacggtgcaaccacggcgcccttgtgtgtcaccacatgcagcaaggattgcgcttccagttggcgcaacgcttcgcgcacgggcatgcggctgacaccgaacaggctggccagctcctgctggcgcattgcagtgccacagggcaatcggccatcgagaatcgcattgcgcaacgtttcttcaataacggcgcgcgcaagatgggcgggaataggcccgctgattttgatgctgcttaaagggttcggcttctgcgtcacggttacgctatcctcctttcttgaatggggtgtgtttaattggatccaatgcacactagagatgggctgcgtgcttgtcaaacagccaaagtttccgattgtaagggcttacaggccttactttgtgcatcccacagaagacggttataaactcggcccatttatgaatgatcgcactgtgccattgttttttacggttcgaagcatcaccatcctttgaaattccgtctctcttcatggactgaacgccttggcggtaagttttattccatctcgaattttcagctggctgttttcagcgattttgttggccggcctgatgctcggcgggctgcatgccgattgggatttctctcagatcagccgcaaggccaccgccttgtatgggccgctgggggaaggccagcggcgtatcgatgactggcagcgcttgctggcaacccaaaagcaggtcagcgagcaagagcagctcaaggtcgtaaacctgtttttcaacaagcaaatgacctacgtggaagacatcgatctctggcacgtggtcgactattgggagacgcccatagaagcactctggaaaggtgccggcgactgcgaggactacgcgatcgccaagtatttcagtttgcgtcacctgggggtctccagcgacaaattgcgcattacctacgtcaaggccttgcgtcagaatcgcgcgcacatggtcctgacttattatgcgaccccggacgccatcccgttggtgctcgacagcctgatggacgaaatcctgccggcgacgcggcgtaccgacctgatcccggtgtactcattcaatgccgaaggcttgtacttgcccggtgccaagggcaacaagaaagtcggtgacaccaaacgcttgtcgcgctggcaggatgtgttgagaaaaatgcgtgcggaaggcttcccagccgagcctgccaactaggagtaactgatcggatgtctctgttcaaacaactattgatcgcaatctgtctgttcctggtgatcgccttcagcggcagcttcatggtcagcctggaaagctcgcgcacgcaatacgtcaaccagctgcgctcgcatgcacaggacgcggcgacagcgctggcgttgtcgctgacaccgaacatcgacgacccggccatggtggaattgctggtcagctcgatcttcgacagcggctattacgccagcatccgcgtggtagacctggcgactgacaaaaccatcgttgagcgcagcggcatccccgataacaacggtgtgcccaactggttcgtgaagatgatcggcctggagccggccggtggcgatgcgctggtcaaccgtggctgggagcaggcggcgcgtgtggaagtggtcagccacccgatgttcgccctggccaagctttggcaaagcgccctgggcagcctcggctggctgttgctgtgcggtgcggtcagtgccgtgcttggcgcgctgctgctgcgtcggcaattgaaaccgttggactacatggtcaagcagtcccacgccatcgcccgtcgtgagtttctcagtgtgcccgacctgccacgcacgccggaactgcgccgcgtggtgcaggccatgaaccagatggtggaaaagctcaaggcgctgttccaggagcaggccgagcgcagtgaaaaactgcgcaccgagtcctaccaggacaacctcaccggcctcgccaaccgtcgttatttcgagatgcagctcaacgcccgcgtcagtaacccggaagacaccaactccggctacctgctgctgttgcgggtcaaggacctggccggtctcaaccagcggctgggtggccagcgtaccgaccagttactcaaagcagtcggcgagcaactgctgcgccaatgcgagccctacccggaaacccataatctcgtcacccgcatccgcgggggtgaattcgcggtgctggcgccggggcttgtgcgcgaagaagcgctgcaattggcgcagaaccttgaaagcaccttgctcagcctgcaagccaccggcgccagtgacgtcacaccggtcgcctatatcggcctggcgcccttcagccatggcgattcccctcaggcgctgttgaccttggcggaccaggccctggcccaggccgaagggcagggcgacaccagctgggtgtgcctcgaccacagtgccgccgccagtgtcggcgacgatcaccatgcctggcacaccttgctggaccaggccctgacccaacagcgcttccagctgtacttccagccggtcgtcgccagccaggacccgcagttggtcttgcactacaaagtgctgtcgcgcttgcaggatgacgacggccacacaatcccggccgggcgtttcctgccgtggcttgagcgctttggttggacgtcacgcctggaccgcctgatgctggagcaagtgctcaagcaaatgaccagccacagccatagcctggcgctgaacctctcggctgccacgttgcaggacgcccaggcgttgaaccggattttcgacttgctgcgccagcacagcaaccttggcccgcgcctgaccctggaaatcggcgaagaacaattgcctgagcaagccttgctggaacagttgacccagcgtctgcgcgagctgggcttctccctgagtctgcagcgttttggtgggcgcttcagcatgatcggcaacctggcgcgcctgggcctggcgtacctgaagatcgacggcagttacatccgtgccatcgatcaggaaaccgacaagcgcctgtttatcgaggcgatccagcgcgcggcgcacagcatcgatttgccgttgattgccgagcgcgtggaaaccgaaggagagctgaaggtgattcgcgagatggggctatttggtgtgcaagggcagctattcggcgagcccgcgccctggaagtaatccaactccaacggggcactcgcttgtgtgggagctggcttgcctgcgatgcacgcacctcggtgtatcaggcagaccgaggtgatgctatcgcaggcaagccagctcccacacaagccagctcccacacaagccagctcccacacaagccagctcccacacaagccagctcccacacaagccagctcccacacaagtcagctcccacacaagcctgcccagattcagattcggtttgcctacctgaatcagatcaacccagtctcttcatcattgatcaggtgactcaacccgcccaacgcttcccgcgcatgggtacggtccatcagcttggcttgggcggccggcggcaggtccgttacgctgatcacgcccttgcgggtcagcacctggatcaagtcatccagcacccggatcatttccaggtcactttgcttgagctgcgccaggctggtttccaccacttcgttggcataccaggcctggatctcatggtgatcggccggcagggtttcggttgattcggcaaaggcggcggcctccacgcgactcaatacaccctgtgcatcacgttgcacgtaaaacataagaaaccctcgaaaatgaaccacacgccttcaccagcataggtcaatggtgtgtttatggccgcgagtatgcgatgcaaccgcccgccagggccagtcacgcatcagccaaaaaaaatcggccgcccgagtgggcggccgatccagcgcgtcttaggcagtgtgatcgatcttgatggtcgggtcggcaccgctgatcagcgagttgatgctggtgtgggaccaatcgttgccttccagcttgatcgtcacatcggcattggccaggccgccggcggtgttgagcttgccttcactgctgatttgcagggtcgacacgccgtctaccgtggtgatcttgaggtagttgtcgatggtgctgtccgtctcacccttcaacagatccttaagatcaatccggtcaccttccgaggccttgaagtccttgatcacatcgttgcccaagtcaccggccttccacacgaaggtgtcggcacccgaaccaccgatcaggatgtcgttgcccggcccgccgatcaacgtgtcgttaccggtgccgcccagcaggatgtcattgcctttgccgccgtccaggtagtcgttgccgccctggccgaacaggatgtcatcacccgcgccgcccaacagcgtgtcgttgccgtctttggcgccggacacatcgaagtcggcatagtgctcggtgacgtactggtgcacgttggaggtggtcaccgccgagacggccacaccggttttctgtgccacaaaggcctgcagtgcgttgtaaccctcaccggtgatgccgctgaagctcaccaggtcaccgaagatgatgtcgttgccgtcgccaccgctgatggtgtcggaacctggcagcgtcgcttcggtgtggccgaggatggcgttggccaggtcattcgggtcgatgttgctttgcggcttgccatcgctgtcgtacggcttgaggtcattgaggctgacgtcaccgttgataccgatggcctccacttgcgacaacccgcccagcagcgcaaaggcgcttttcgcgttgctcagcgtcgccgcgtcggtgctgtagcccgtaccgttcaggttggacagctcgtaggtgccgtcaccttgggcgtgaagggtgcccaggttgttgacgacccagcgcgagccattccaggtttgcaattgagccgcacccgaggagtcgatgctgaagtagtggaagctatccaggtacttgctgaacgtattgcccagcgtgtagttggacgtggtcaccaaatcgtcgagcttaacgttgtaaatcgtcgggttggtctgctcgccactctggtagtaggtcggctggccgtcggtgatgaagtaggtcaagttggtggcaccggtgttgccggtggccaggccgctctggaagaagttggccgtggtcttgaacacgtcttcatagttggtgccgccgcccgacaccatcgagtccagcacggccttgagcaaggtcagggcgtttggatcgttgaggttgatcgccaccgacttgttcacctgggtatcgaagtccgccaggaagatattcacggtgcccgatgtgttcgcgcccaggctgtctttgagcgagttgaacaccgaggtcagcgaagccttggccgcgttgatcgacgcggtgctcatgctgccggaactgtccaccatgaacgcgatgttgtagttcttgccctgcaccacgttcaggccgccgatatcggctacgacgatgtcgttgccatcggtgccggtgatggcgtcgctgccggagctgcccgtgattgcgctgtaggtggccgggtacaccgtgaccggcaattgcgcggtggtgatggccgaaccgccgaggctttcggtagaggtcgaggtcaccgtcaggttgaactggccgctgtagtaggtcggcggcttgatggtcagggtgctcaaatcccaaccggtgacgttgacttcgcccacggctttagtcgcggtaaaggtgtgcccggacgcgtcggtgagcaccgagcctgccggtacgccactgatcttcacgctcagggtttccgaaccgtcggtgtcggtcagcgcggtggtcaccttggacagcttcacggtgccgttttcctggccctcgttgagcttgtagcccacgtagtaaccatcaccgttgctgccatgcaggtcggacacggtcacgccggcgttagtcaggtcggtgatgccggtgtacagcggcacgccgctggtgctcaggtctgtggccggggcgccgttgaccgacaggttgacgtcataactgccagggccggactggttggcgtggtagatctcgatgctgtaatagccgctcaccgtcggggtgatcgagccgctgaacttaccgctgttggtgccccactgcgcgctggccacgtctttaccgccgacgttgatcaccaggctgtcatcgccggtgccgctgaaggtgtaggacttgccggcttccatgtagatcaggccggagatcttcgaaccactgcctgccgcgacgttggcggtggactcgacattggtcacgatgccgctgctgttcggcgtgccggcgttatcaatggcatttttcaggtcagccggggcagcgccgttgccgttggtgccgatgccggcaaccgtgttccagctttgcttgagcaagccgatcgagttgacgctgttgtcggccacattcagggtcggtgcgtcggctatcggcgtgatatcgactttcaccgtggcgctggtgcccaggtccttgccatcggttggctggaacttgaactgcgcgtaatccgcctgctggttgccgatgccagtgccgccataaccattggtgccggattcgttggcgttaggcatgaagcgcaactggccgccgtcgatctgggctttggtaaaggtttggccagcggtcacgttggtccaggtggtgccatccgctgcgaggtattgcagcttgccggccaccggcaggtcggtgattttcacgcccaggctgctttgcggcgagtccacatcggtcacgccgaagttagcccaggtcagggccagcggcgtgtcttcggtgccggtcacggcgctgccggttgccactggcgcatcgttgaccgccaccacattgaccgtggtggtagcgacgttggagtaattgccgccgtcggtcacggtcacggtaatagtgcgcggcgtggtgcttgggtcatggctgttgttggtgaacgtgatgttctggatgcgctgcatgtaatcagccagcgtcgcgctgcccgacaacgtcaaggtgatggtgcccgtctggttgttggtgctgacgatgatgccattcacgctgttgcccaggttcagggcatcaccggcctgcgcgttggtcagggtgatcgtcgcgccggtcagcatcgtgctgtccgggtcagtgatcttgatatccgtgtcggcaatcgacacgcccgggccgctggtgccttcggtgaacgtcaccttgtagtcggcaccggtggcgccgctggaattgttggcatccaggtcgatgaccggcggcgcatcgttgtcgatgatattggtggtaacgctgcctttaccgatcgccaggttctcgaagttgccaccggtggtcttgtcgatcgtgatgacaatgctttccgtcgactcggtgatcttgtcgtcaatcgtgcggatatcaaacgccgcgctgctggcgccagccgggatcttcacggtgtacacaccggtgaaatccgaaccgtcggtggcggtgccactgtacttgagcgtcacggtcacatcggtttgcgccgggttgctcaaggtcagggtgtaatgcgccgtgccgccttccgtcaccgacgcatcgccggtgatattgacggtggtggtgtcgatcgagtcggtgatcgtggtgacggctgcttttggatcggtgaccaggttctcgaagttaccacccgcagtcttggcgatggtggtgctgacggtggaactgttgttgtagacgtcgttggccggggtgtggaacaccgtcgagcctgcggagtcgccggctttgatggtgatggtttggccgttgctcagcgttacggtgacgtcggtttgagctttgttggtcagggttgcggtgtaggtgatatcgccaccttccactaccgatgctttatcagctgtcagagaaacggtggtgttgtcgatcgagtcggtgatcgtggtgaccgctgcttttggatcggtgaccaggttttcgaagttaccacctgcagttttggcgatggtggtgctgacggtcgaactgttgttgtagacgtcgttggccggggtgtggaaaaccgtcgagcctgcggattcaccggctttgatggtgatggtttggccattcgaaagcgtaacggtaacgtcggtttgcgccttgttggtcaaggttgcggtgtaagtgatgtcaccgccttcaaccacagatgctttatcagcagtcagggaaaccgtggtgttgtcgatcgagtcggtgatcgtggtgaccgccgctttcggatcggtgaccaggttttcgaagttaccacctgcagttttggcgatggtggtgctgacggtagagccgttgttgtagacgtcgttcgctggggtgtggaaaaccgtcgagcctgcggagtcgccggctttgatggtgatggtttggccgttgctcagcgttacggtgacgtcagtttgagctttgttggtcagggttgcggtgtaggtgatgtcgccaccttcaacgaccgatgctttgtcggcagtcagggaaaccgtggtgttgtcgatcgagtcggtgatcgtggtgaccgccgctttcggatcggtgaccaggttttcgaagttaccacctgcagttttggcgatggtggtgctgacggtagagccgttgttgtagacgtcgttcgctggggtgtggaaaaccgtcgagcctgcggagtcgccggctttgatggtgatggtttggccgttgctcagcgttacggtgacgtcggtttgagctttgttggtcagggttgcggtgtaggtgatgtcaccgccttcaacgaccgaagccttgtcagcagtcaacgaaaccgtggtgttgtcgatcgagtcggtgatcgtggtcaccgctgccttcggatcggtaaccaggttctcgaagttaccacctgcggtcttggcgatggtggtgctgacagtcgaaccgttgttgtagacgtcgttggctggggtgtggaaaaccgtggaacccacagattcaccggctttgatggtgatcgtctgaccattgctcaacgtaacggtgacgtcggtttgcgccttgttggtcaaggttgcggtgtaagtgatatcgccgccttcaatgaccgaagccttgtcagcagtcaacgaaaccgtggtgttatcgatcgagtcggtgatcgtggtgaccgctgctttcggatcggtaaccaggttctcgaagttaccgccgacagttttggcgatcgtggtgctgacggtcgaactgttgttgtagacgtcgttcgctggggtgtggaaaaccgtggagccaacggtttcaccggctttgatggtgatcgtctgaccattcgaaagcgtaacggtgacgtcggtttgcgccttgttggtcaaggtcgcggtgtaagtgatgtcaccgccttcaacgaccgaagccttgtcagcagtcaacgaaaccgtggtgttatcgatcgagtcggtgatcgtggtgaccgccgctttcggatcggtaaccaagttctcgaaattaccgccgacagttttggcgatcgtggtgctgacggtcgaaccgttgttgtagacgtcgttggccggggtgtggaaaaccgtcgagcctgcggagtcgccagctttgatggtgatggtttggccattcgaaagcgtgacggtgacgtcggtttgcgccttgttggtcaaggttgcggtgtaagtgatatccccaccttccactaccgatgctttatcggctgtcagagaaacggtggtgttatcgatcgagtcggtgatcgtggtgaccgctgctttcggatcggtaaccaggttctcgaagttaccgccgacagttttggcgatggtggtgctgacagtggatccgttgttgtaaacgtcgttggctggggtatggaaaaccgtcgagcctgcggagtcgccagctttgatggtaatagtctgaccgttgctcagcgtgac

SEQ ID NO: 83 - DNA, 19566 bp, Pseudomonas poae FL10F
aacgtcgaccagttcgaaatcatcacccgcgccaccacgatcaacgcgcagatccaggcgaaaaaactcaccatcgttgccggtcgcaatgacgtcgacgcgcgaaccttgaatgccacagcgcgtgcggcagacggcagccaggcgccggatttggcgattgactcctcggcgctgggcggcatgtatgtgggcacggtgaagctggtgggcaccgaagccggtgtgggtgtgcggctgtcgggtgacatggtcgccggtggtgatatccaaatcgatgccgctggcaatgtagtcatgggccagacctcggccggtacggcggttaacgtcaaggcgcagagcgtcgaggccaaaggcgcggtctacgccggtacggatttggcgatcaaaacccaaggcgccttgaccaatcaacaaaccctcgccgccaaggacagcatcgcgctggacgccggtggccggttgaccaacaacggcattatcgaagcgggcgtgaaccccgataacacccgcaacacccaaggcgacgtgcgcctgaccgcccaggctctcgacaacaccggcaagaccgtcatcgccagccgcgacctcagcgtcaccaccggcgaactcgccaaccagggcggtacgctgagcgcccaacgcgatgcgcaactgtccgccacgcagatcgacaaccaaaaccaaggccgcatcctcagcgccagcagcctcggcatcaatgccgaccaactgctcaacagccaaggcggcctcgtcaccagcaccggcaacctgaccgcaggtatcggccaactgatcaaccgcaacggcgagctgtcgagccaggcgcaggtcacgctgcaactggcggcgttggataacgtcgcggggctggtgtcggcggggcagtcgttgagcctgaatgccacgggttacgtcaataaccaaggcggccggattgccgcgcgtcaggcgctgcaggtggtttccgacagcctggataatcgcagtggcgagcttgtggctaccgatatcggcttggcaaccggcacgctggataatggcggcggcaggctgcaaggcgaccgtacgctggcgatctccagcggcgcactgagcaacaggggcggtacgttggctgcgggcatccggttggacgccaccaccgccagtttggataacaccgacggcaagctgaccagcgacggcgccttgaccgccgttatcgccgggcagttgctcaaccagaccggcctgtttgccgccaaaggcgatgcacgcctcaccctcggcagcctggataaccgccagggcaatcttgccgccaacaccctcaacctgcaggtgaatggcccgctcaataacagccacggcaccctgcgcggtgaagcccggctggatttgacggccggccaggtcgacaacagctcgggcgggcgcatcagcgccggcacaacgctgaatgccaacgtcgcaagccttgatcagcacaatgacggacgcctgttcggccaaggcgatgtcagcctcgacctcaatcgcgggcacctgaataacaacggcggcgtgatcaatgcgccagggcgcttgctgctgagcaacctcaacagcgtcgacaacagaggcggtgagatttccagcagccaagcctttaccctggccgccgacaccctgaacaacggcaacgccaagctgttgagtgagcaggcattgaccgtgcgcatcgccaaggcgctcgacaatacccaaggcctggtctcggccaaagccctggatatgcatgccggcagcctgaacaacaatggcggcacactcagcgccggtgacggcctgctcgcgcaaatcgacgcggcgctggataaccgcaacggcaaagtgttggcccgcaccgcttcggtcaacagcgcatccttggacaatcgccaaggcctgctgcaaggcgacgccacgctcaccctcaatagcctgggcctgatcgacaaccgccagggcacgctgttcgccggccaaacgtttgacctcaacgccggcagcctggacaacagcggcggcaagctgaccagcgacggccgcctgaccgcgctgatcagcgcgcaactgttgaaccaaaccggcctgttaagtgcggtgggccagctgcaaatcagcgccgccagcctcgacaacagcgccaagggcaacctctacagccaggcgggcgtgagcctcgacctgaaccacggccacctgaataacagcggcggcttgatccacgcgccgggtgcgttgctgctgagcaacctcaacagtgtggataacagcggtggggaaatctccagtgcccaggcgctggatttcagcgctgcaagcctcgacaaccgcggcggcaaattgctcagtgagcaagggttattggtgcgtgttgatcaggtgttggaaaacaccaagggcttgatcgcagccaccggcctcgacctgcgggccaacagcctggtcaacgccgaaggcgagcttaaagttcgcgatgacgccaaggtgttggtcaccaccgcgctggataatcgccaaggcaaaattgctggcgcgacgaccagcgtgaacagtgtgaccctggacaacagccaaggcctgctccagggcgacagcctgctgaccgtcaccaatgccggcatcgcgatcaaccggggtggtcgctttatcagcggccagcggctgaatgtgaacgtcggccagttcgacaatcagggcggtgaagtgtccagcgtcagcgacttgaccttcatcgccagccagctcgataacagcaacggcggtcgattgctggccaatggcgcggtgcaactgaccctcgataacctgaacaacaaacaaggcaccgtgcgcggcgatggcaacctcacgctgcaggccgccacgctgaccaacgacggtggccgcatcagcagtggcgcggcgcagctgttggccctcacgggggccgtcagcaaccgcaacggcgaattgctcagcgcgatggcgctgaccttcaatagcgccagcctcgacaaccgtggcggcaaactgatgggcgacggcgccgtgcgcgtcaccaccggcaccttgaacaaccagtacagcgggcgcctcaccagtgctgagcgcctcgagctgacagcggggcaggtggacaacggttttgacggccatatcgccagcaaccaggcgctgaccgcgaatgtcaccgggcttgatcagcgcaatggcggcgagctttacagcctcagcgacctgacgttggacatgcaccagggccagctcaataacgctggcggcctgattcatgcgcccggtcagctgctgctcaaggacctcgccgacgttgccaaccagaacggcgaaatctccagcgaaaacgccttcacgctggctgcaaccagcctggataacagcaatgggcaggtgctcagcgatcaggcattgaccctcaagctcgaccaggcgctgaccaacgtcaaaggcctgattactgccgccgcgctcaacgttcaggcggctcggttgaataacctcaatggccaggtcatgggcgacaacagccttgatctgagcacttcaggcgcagtgttcaacagcggcggcaccttgggcagcggtcagcgtgtgacggtgacggcggccagcctcgacaacagccaatccggcagcctggtgagcgatggcagcctcgcggtcaaggtcgacggcttactggataaccaagccaacggcagcctgttgtccaaaggcgttatggatatccaggccggtagcgtggacaaccgcgcaggccgcctgtccgggcaaaacctgctgaccctgcgcagtgccagcctggataaccgtggcggcgccgtgcgtgccaatcagaacctcgacctgcaagtcggccagttggataaccgagccggcgtgctcaacagcaagcaggcgctggggctcaccgggcaatccctgaacaaccagaacggcggcttggtcagtgccgtcggcccggtgcgcctgaacgttgagaatgttgaaaacgccaagggccgcattgccagtcaggatgatctggaggccaccgtcggcatcctcaaccagcaaggcggccaactggtcgcccagggcaacctgacgctcaacgccgacagcgtggataaccgcgacggcggcgtcctcggcgcgacaaaagcgctgaaactcgcgatcaaccgtgtcgataaccgcgcaggtgaaatctccagccagcagaacatcgacctccacggccagcgcctggacaacagtggcggcaagctgttggccgggacggcgctggaactggcgatggatgaagtgatcaaccaggccaaaggcttggtcttcgcccaggatgtgcgtttgagcggcgcccgtttggataacacggacggcaccgtcggcgccaagcgttcgctggcactgcagttgtcggcggggctggacaacatgggcggcaaactcagcagcgaagggtcgctggacctggctgcccagcgcatcgataacactggcggcagcctctccagcgccggcccgctgacaatcgccagcgcgacagagttgtttaaccaaaacggcaccgtggagagcgcgcaaaacctcacgctgaccagcgccagcctggaaaacaccggcggccggatcaaaagccagggcgccgcaaccctcaccaccggcgcgtttacaaacggtgtcgagggctatgtcaccagtgccgacagcctcgacctgacggccgcccaagtcaccaacagcgggcatatccgcagcgtgggccgcttgaacgccagcctcaccggcctcactcaactcggcggtgccgagctgttgagcaccacccaactgaacctcgacctgcacaatggcgagctggtcaacgcgggcgtgatcaacgcaccgatcctggtgctgaacaacctcgccagcctcaacaaccagcacggcgaaatctccagccagaacgccttcaccctggcggctaaaaacctcgacaacagcaatggcaagctgatcagcaaccaggcgctgaccttgcgcgttgaacaggtgctggccaacgtcaaagggcaggtcagcgccgccagcctcaatgcgcgcagcgctcaactgaacaacgccgatggcttgctcagcggtcgcggtggtgtggacatcggcgcgactgaatcgatggataaccagcgcggcagtttgattgccgacggcgccttgctgttgaccagcgcggcactgaataaccgtggcggtgagattgccggcaaggcccacgtcaccgttaacgtagcaagcgtggataaccagagcggcaagctgatcagcaccgacggcctgcagctgagtgctgccacgctggacaaccgcaacggtctggtaggcgcgacaaaagcgctgaaactcgacgtgggtagcatcgacaaccgcgccggcgagctgaccggcaacgccgacgtgagcatcaccggccagctgttgaacaacagcgacaaaggcagcgtgtttgccggcggcgccttgagcctggcggttgatcaactcatcaaccgcaccctcggtgaattgaacggccagcgcctgaccctcaccggcacctcactggataacagcggcggcacgttgctcagccaacaaccgctggtgctggaactggcgggcgatctggacaacagccagggcgtgctcagcagcgaagacacgctgagcgtcaaagcgcgcagccttaacaacagcaagggcagcgtttccagcgcccaaggcttgagcgtcgtcgtcaccgacagcgtgaacaaccacgacggcacgttgctcaccgacggcaatctgcaagtgcgcagtgcgagcgtcgacaaccagcagggcacgctcagcggtaaaggtgcggtctcggtgaccacgggcgcactgaataacctgggcgggcgccttaacagcggcgacaccctggcgttgaccaccgggcagttgaacaacggcggcagcatcggcggcgagaagggcgtgaccgccagcgtcactggcctggaccagcgaggtggcaagctgttcagcaacgccggcttgagcctggacctgaacaacggcggcttgaacaacgcgggtggcttgatcaacgccaaaggcccgttgctgctcaataacctcacaaccgtcaacaaccagaacggtgaaatctccagcggccaagccttcaccctggccgcgcaaaccctggataacagcaacggcaaactgctcagcaaccaagggctgacgctgcgcatcaaccaggccctgaccaatctcaaaggcctgatcggcgctgccagcctggaggctcgcgcggcgagcgtggacaaccgtggcggcatcttgaccagccgcagcggcctgcaactgaccagcgacggcctgctgaacaacgctgaccaaggcttgatcagcgcaacccaagcgttgacggtgcacagcgctgacctgaataaccagaaaggcagcgtgctcggcggcgccgtcacgctcaacgcgatggccctggacaacagcgccggcggcctgatcaatagccagagcagcttgaacctgaccgccgccagccttaataccggcagcgcgggcgaagtctcggccaaaggtgcgttgagcattggcgttaacggcctggcagtcgcgggcgggcgtattgtcggtgagcagggcgtggccctcgacctcaacaacagcgatctggataaccgtaatggcctgattctcgccaacggcccactgaccctgaacaacctgcgcgacctcaacaatcagggcggcgaaatctccagccagcaaagcttttcgctggcggcgcgcagcctggacaacagcgccggcaagctgatcagcagccaggcgttgaccctcaacgccgcgagcctggttaacagcgcaaacggcctgatgtccggctggcaaggcttgaacgtcaacgggggcaacctcgacaaccgcgaccacggtacgctgtccagccgcaatggcgcgattgatgtgcgcctgaccggcgcgctgcaaaacaacaccgacggcgcgctcgtcagccaggggcggctggatatccgtgcggccagcctggataaccgtggcaagggcgtgatttccagcggtggcgcgcagaacctgacagtcagcggggcgctggttaacggcgatggcggcttgatcgacagcggtgccacgctggacctgcaagcggcgaccctggctaaccagtccagcatcaccgcgcaacaggcactgaccttcaccggtaccgacctgagcaacaacggcggcaccctggcgagtaacggtcgcttgaccctggacctgctcggcaacctcaacaacagcggcggcaaactcgccagcgccgggccgttgctgctgcaacgcgccaaccaggtctacaacgacgcggatggccagatcgtcagccaaggcctgttgaccctgttcactggcggcctgaataacagcgggcgcggcaccatcgccggcaaggaacgcgtggcaatcaccagcaccggcgcggtgcaaaaccaaaccgacggcttgatctacagccaggacgcggacgtgcaactgagcgcggccagcctcaataacgccaacggctcggtgcaaggccagaccggcctgggcttgagtgttaacggcgacatcgacaacagcggcggcaaactcgtcgcgcaaaccggtgacctcaacgtcaaggccggcaacctggacaaccgtggcggcacgctcgccagcctcaaggggctgctggacgcgcaactgaccggcgctttgaataacctgggtggcaccacccaaggccagcgcctgaacctgctcgccagcagcctcaataaccaaagcggccgcgtggctgcgcagacgggcgacctatggatcaacgccaataatttcaccaacaccaacggcgccgtgtacgccaagggcgtgttgaaagtaggcgctcaaagccttgataacacggccgggcagatggccggtggcgcgattgacctgagtagcaacgctgcgctgaccaatcgcaatggcgtgatcgagagcgacagcacgctgagcatcacggccagcagcctcgataacggcggcggcaaactgcgtgcactgggccgtgacgccaagacacagttccagatcggcagtgtgttcgataaccgcagcggcgtggtggaaaccgccaataccgacctgaccctggccgccaacagcttccagaacagcgacggtcgcttgctgcacctgggcgacggcaacttcgatatttccctgccaaatgtcaccggcgccggtggcagcatcgtcacccgtggcggcttgaccctcaacgccgacacctggaacaacagcagcgtgatccaggcgggccggctgaacgttaacgtcaataattttacccagtcagagaccgggcaactgctggcgtcgacgcgcctggaaggcaagggcggcaattggaccaacaacgggctgatcgccagcgacggcagtatggccctgcaattgaccggcacgtatcagggcaacggcaaggtcagcagcgtgggcgccctggacatgtcggcggcgcaattgagcctcactgaagcggcgagcatcgctgccggtggtatcaccaacgtcaccgttggtgggcagttgaccaaccgtggacggttaacctccaacagcgcgttgaacatcaacgcgggtggcgtcagcaacttcggcactttggccagcgggcaaaacctgctgatcaatgcgcaaaccctgactaatgatcgcgtgcgcgtgggtgcaggttcagcgctgatcagcggcggcgacatgaagctgcaggtgggtacgctgaccaatagctacagcgacatttacagcctcggcggggtcgaggtgggtgggtacaacggcgctgagcgcgcggcgcgggtggataacctgtcggggcggattgagtcgacgggggatatgtcgctgaaggcggcggttgtgaacaacaagatggagagttttagtgttaaggcgaccaatgtggtgtcttcatcaattggtgtcagatgctatgactgcagctatgttgggcagaaagcggcgattacttcgcacttggtttggcagcaacaatttaatgtcgaggcgacgggtgagcaagtagcagccaacatcgtgtcggggaaaaaattgaatgtttcaggggataagtttgaaaactttaactcctctgtttctgcggcaagtgatatcaatatatcggttggggatttcactaacaccgccagtgcgctgggtggctataccagcctgaaatacatctccatgcgcgtgcctattgacttgtggggttcgatactcacctataattcgataaatgatccaacctataacaaaaatattcacttctggaatgctgccgaacaggagtcaattgttggacttaaacccggtacggatcgcggccaatcattcgcgacattcagctacaacgcaggtccgaaaggcggcgcaaccattattaacctgcctaaatccaggtatgttgcgggcgtcaccagccaagcgcctgccgccatcgccaatacaacgcccttccttgagaagataaccacgtcgccagggtcgacttttatcccttcaatcatccaggcgggtggaaatgtaagtatcaacgccgcgaacaaaatcaccaacggcgtcgagcgctccttcaccacaaccgctgccggcgcatcgcgcaataccaatacccaggtagcaggaacgggcaataccactgtcatcaacctcaaccgtcaactgcctccggacctggctcagcagcaggtcaatcccgtgacgttacgcggcttcagcttgcccagcggccaaaacggactgtttcgtctgagtcaggatggcgccagtgcccagcctgcgggccaagggcattccggcgcgcaaagttggacgatgggcggggcggatatcgagttggcccaacgtgaaaaaccactgccggaaagccagggccgaacccttcagttgggcggcgcggctcaggttgcggcagacactcaccaagtcgtggtcgccgcccgtgaagccaacggcatcaacttccaggcccgcaccgtcgatgcatccggtgtcggtaatgcagacaccggcatcgtcttgccgggccgcaccgatagcgtccgggttgatggcattaatgctggaaactcaacgggggcgcccgccgtcatcggtggcggcctgaaccccgcggacagggacccgcgaaacctggtaacaacgccagggagtgtgccaggcctgaacgtgccaggcgtgtccagcgctgaccgcgatacccgcgtgggcgccaatcaggccggtggtttgaacctgcctggcctgaccccgctggcctccaccacgccggtttcttcaggcgcaaacggccaaaccctcaaccgggtgcaaggcttgccgggcagcaaggcggtgtcgcagccgcacaaatacctgatcgaaaccaacccggtactcactgacctcaagcaattcatgagttcggactacctgctcgcaggcctgggctacaacccggatgagagcgccaagcgcttgggcgatggcctctacgaacaacggctgatccagcaagcgattgtcgagcgcaccgggcaacgctttatcgacggccagacctcggacgaggcgatgttccgttacttgatggataacgccatccgcagcaagcagaccctcgacttgtcggtgggtgtggcgctgacggggcagcaagtcgctgcgctgacccacgacatcgtctggctggaagagcatgaggtcaatggtgaaaaagtcctggtgccggtggtgtacctggcccaggccgacaaccgcctggcaccgaatggcgcgctgatcgcgggccaggatgtgagcttgatcgccggtaaaaacctggaaaacgccggcacattgcgcgccagcaacaacctgtcggcggtggcgggcaacgacttggtcaacagtggtttgatcgaagcgggcaaacgcgtggacctgctggcgggcaataacatcgtcaacaaagccggcggcattattgccgggcgcgatgtgtcgatgacggcggtcaatggcgacgtgatcaacgaacgcagcattaccagcgcgggttacaacgttgactactcgaaaaaaaccagcttctcgaagaacaccgactacatcgacagcgccgcccgtatcgaggcggccaacgacctcagcatccgcgccggtcgcgacgtcaccagcgccggcggtgtgcttcaaagcggcaatgacaccaccatcgttgcagggcgcgatgtaaacctggtttccgcgcagcagcacgacaccctgaacggcggcaagcgtaatcgtgccgaggacgtgacccagaacggttccagtgtcgaggccgggcgtgacctgaaagtcagcgcagggcgagacttcaccgcaatcgccagcgaaatcgacgccaagcgcgacatcgcgatgagcgcaggcggcgatatgtactttgcctcaggcgctgacgagcagcactcctactccaagacctcgagcaccaagcgccaggaggatcacgtcagccaggtcgccaccaccgtggcagccgggcgtgatgtgaccttgagtgcgggcaaagacctggcgttgatcgccagccgtatcagcgcaggggatgaagcctatctggtcgcaggcaataaccttgggctgctttctgccgaaaacagcgactattcgctgtacgacatgaagcgcggaggcggcttcggttcaggcaaaacccagcgcgatgaagtgactaaagtcaaaaacatcggcagcgaaatcaagaccggtggtgatctcaccattcagagcctgggtgaccagaagtaccaggttgccaagttggacagtggcgaagacctgacgattgtcagtggtggggcggtgactttcgaggggatgaaggaccttcatcaggagagtcatgagaagagcaaaagcagttttgcctggaccagcgccaagggccggggcaataccgatgagaccctcaggcaaacccagatggctgccaagggcgacatcattatcaaggcggttgacggtctgcatatcgacctcaagcaggtcaatcagcagaccgtcagccaggctatcgacgcgatggtggcggctgatcctcagctggcgtggctgaaggaagctgagaagcgcggggatgtcgattggaagctgattaaagaaacgcacgactcatttaagtacagcaactccagcattgggcagggcgcgatgctggcgattgttattgtggtgtcggtactttcggccggggccgcgagtggtgctatcggcaccatggctggggctggagcccaggcgggcagcggggcggcactggcggcgagcggcagtagtgcggcggtggctgccggtactgcggcatctgcgggttgggccaatgctgccttgtcggttggcctggggtctttggctggcactggtacggccagcctcatcaacaataagggtaatttgggcgcagccttgagtgaaaccttcagcgcagacagccttaaaaacgccattaccagcggcttgacggcaggtgcactgcgttatgccgacaccacgttcctcaagcctgccacaggcgctgtcgatggcggagcgcgcatagccggcggagcggcgcaaaacccgggctacacgcagcagatgctgtcttggccgaacgcgtcggataccttgctcagaagcggcgctcatgctgtgatcagtagcggtatttctacggctgttaacggcggcaatttcggcaaaaatctgggcaatgctttgttgggtgagggcatggatatcgcggctgctatcggcaaccgaggggttggagatttgggccaatatctgcagctggacccagggtctgctgaaaaaatgctgatgcacgcgatgctgggcggagcactggcaaccgcaaaaggtggcgattttaaaacgggtgcgcttgcaggggccgcttctgaggggctttcatcagttgcgactgaagcattgggtaagtatctggatgagcgatttgctacggatcttcaattcagggtagctgctgcgcaggccgtcggggtgatggcaggcgttctggccaagggtgacccgcaaaccgctgcttgggtagcaggtaacacccagcggtacaactttgattttcatttcccagcggtaaccgaagcagtgacccgcgctgaacaaatgaccagagagggcaagactgccgatcaaataaccgaccagctcgcatctgacaggcgcggcgatgggtatagcgcatatatgccggcgaccgggtttgtgatgatgtcctccggttttgtcgccgtaccgttattgcttgctgaagcgcctgctgtaggtgttggatctctggttgtcggtggcatgattgggggtggagcaaatttcgcctatcaactggacacgggcaaaccccttaattacgtcgatctatcgattgcaacgactgttggtgcggcgacccaaggcaagagtttttttgtgacgcaggcgacgggtgtgaccgggtcgtatttgggcagccttatcaaaggtgaggatccaacttacggaatgttggggacggcagtgggcggcgttgcaggaccatttataggcgggaaaataataggtggccaattgaggccttacttcggaaacggggctgatgtaataggtgtcacgagcggggcatatggctcagaactcatcaacggttggatttccagtgccggagaaaagaagtgattaagcctaggtcgagtctgcaagcgtttatcttgctgctgatatatttgactattgtgtttttgggggtggggtttgtcgcaaattttatgggggctgtaatcatctattttaaggccggcgtctgggagtttggctgggcgggcatcacccggcagttcccgggtgttttcgcttatgtcatcccggttggggtcggtatgtgggtgttggagcgattaaaagaacgaaaagcgcgtaaagcccagcaagacaaagagagggagagtcgaaatatttgaggttcgggcggtggcttgcgcaactgggcttacttcagttcttcagggtctgaaagggcaacccccaacccgtaaagcaacccaccggcgatgataaacagccccaacatgtagaaaatgcagtgagccggctgcgtcgccagcacgattccacacagcaccggccctaatgcagcgccgacattgctcaagttctgcgccgcgtaatacatccctctcagatgactgggtgcaatgttgtcgatgaacatgtattcggccgggaagacgatgatttcgcccagggtaaaaatcgccatggacaccatccagaccatcaacgtggtcgacagggcgaagccgccgagcccgacgataaacaggctgagcccaccggccagccacaggttcaggtgtcgacgggaaatgcgtttgccaatgctgtattgcaggctgatcaccatcagggcattggtcgccaccacgctgctgataatccgataggccgcgtggggcgtggtggtcaccatcaagtactgcgagaggtaagcggtgaactggccgaataccactgcactcaagaccccgccgagggtgaaacataccaagcgataatcgtgcagcagcagtctaccgacggccaggaatggcgcaggtttagcctgtgcgtcgccagccgccaggcctcggtcgccccacacgaagtagacaaaaaagaacccggcacccagccccgccgagagtaaaaacggcaggctgatgtcgagggcggctacgcctgcgccgagaaacgggccgacggcatagccgatattggtcagcgtgtatttgatcgaaaacacttcgctgcgctggtccacaggcagcaggctgccaaacccggccttcacggtgatatcgatgaccgcatacgccaggttgatcgacaccaggcacaggtagaacagccacagcgtggaggcgccatacgcgccgagaaaccccagcgagaacacgccgcagcaagtaaggatcagccggtaactggagattctatcgaccagaaagccgccatacaggctcaacagcgagccgatgatcagcgtgctgccgatcaccaggccgatatcggcaatgctcaagccaaagttgccggacaagtaaatcaccaaatagggcagggtgattgcgcgcgcgagggttaataccagtgacgcagacagcagcaggttaaggggggcggggtaggttttcagcgtggcgagcattcgggcctcatcgtccattcataaggtgcaagtcacacagcttactggtgaggtgaattctgatttaggatgctttctatcgaatgaaaggaactgaattcatgaataaggaacgtcaatgtttgcctccgaacgcttgaagggtatcgatgtgtttgtctgcgtcgcggagagcggcagcttcgcggcggcggcagaaaaaatgcacctgacggcctctgccatcagtaaaagcatcgccaggctggaaaaacgcctcggcgcccgactgtttcaacgtaccacgcgcagattggcgctgaccgacgcgggcacggcgttcctgcgtacctgcagcggggtgttggccgaccttgaagaggccgagttgtcactgcatagcgaaagcactgagccgcgtgggcgagtgcgcattgatttaccgggcgcattcggacgcgcgcaggtactgccaatcctgctgccatggatgaaggactatccgttggtgataccgcatatcacgttctctgacggcctcatcgagccgtttcaggctggcgttgacatcgtggtgcgtatcggccgtgcggatgcctggccggagacggttgggcacaggctactcacgcgcgagcggcatgtgttttgcgcatcgccagcgtacctggcgcgccatggcacgccgttgtcggagggcgaccttgaacagcatcagtgcattgcgtatggctgggttgatgggcgcatcagcccttggcgctacaccggtgagcagggcgagacgctgcgcaggccagtcgcgccgcagctggtggtgggcaatggcgacgggctggtgatggccgcgctggcagactgcggaatcgtccaattgccctcgtggctgatcgagcagcagctgcaacaagggacattggtggaagtgctgccgcatctggcgactgaagggtttgagatcaccttggcctgggttaaaagtcgccaaacgttgcccaagctacgcgtggtgcttgaggcgttggagggactcggtgcgtttgaatgattcgggggatgtgctatcgcctggctagcgtcggaacaaccgggccaatggagaattgcggcgcgcaaaaagataaggacctgcatgaggttaatcatgcaagcccttgatatctatggtgcccgaagccggaatcgaaccggcacgcccttacgagcgggggattttaagtcccatgcgtctaccagtttcgccattcgggcggcagcgcggtgcagcagggttgggaatatatagacccgtgcgcttggatgcaaggtgaaagcatgagtttgtcgcattcaataaaatccgaaaaatcttgcaggatcagtgatctacatggggaacgtgccgctgtggcgaggtttttgatacgcggtgaaacgctcctgccaggaactgacgcgggtgtgaaatagagtgcggtttcactctcaagccaggccccgtcatgaaatttgcctctgtccgtctcgtcacccagcagtttgagcaactcgtacagttctatcaaaacctctcggacatcccgccccggcatctggcggaaggcttcgccgaggtgcacttcgagggtgtcgttctggcgatcagcgatgagcgtttgatccgcctgcataaccacgggctggccgtcgcggcgagcaatcggtcggcgatcctggagtttcaagtggtggatgtggcggctgttgcgagccgggtcagcagcacgaacgtggtgatgcccgcgacgaagatgccgtggggcaatacgtccgcgctgcttcaggatcccgatgagaacctggtgaatatcttttcaaaagccgaatagctcagacaaacgcctgcccgctgaacccgcgtggcaaacgctgcaacccaggcaggtcggtgaggcgttgtatccacgcactgcgccagtcgatggcggtgtgggtcttggttttgcgcgcggagcggcgagcggcattgcgctgggtgcggcgcgcttctttataggcttcggtattgcggcaggtacggcatttgactcggttcagctcggtgctggaggtgaggttggtgccgtggtggccgcaggccaaatggccggcgaccttgaagtgagtgaccatgtaagcgtctccttcttatgggggtacgcgcctccaacagcagcggtggcgcgcgagcagggcggggcaattaaccccggcgcctaatggatacgaccccaggtgcggcgcagcgttcggttttgcccccacgcgggttcacgctaccctgtgcgactacaagcataaaaaaggaatcaatgatgagcctcgaaaccctgccgctggaaggcagttgccgctgtaaccgggtgcgtttcagtgtcagcctgccgccggtgatcaccatggcgtgccattgcaacggctgccagaaaatgacctccagtgcgttctccctcagcgccctgattcccgccagtggcttcaccgtcacccagggctgcccggtgattggcggtttgcacggcgtggaccgtcattattgctgcccgcactgcatgagctggctgtttacgcgcccccatggcatcgacgagttcgtcaatgtgcgcgcaaccttgctggataacgcccacgactacgtgccgttcatggaaacctggaccagcgaaaagctgccgtgggcggctacgcctgccgtcgaaagctttgcgcaattgcccgagccgcaagactttccgcgtttgatgcaggcgtacgccgcgttcaacgcgcgctgaactcagtcgatcagcgccagcaggtcggtatcgcccacatccacgcccgcctgggtcagcaacgtggttgcctggccccggtggtgggtctggtggttgaagaaatgcaccagcaggccaaagaacggcttgttgttcgcaacaccgcgcatgttctggtagctgagatgatgatccaggtccggctcgcgcaggctctgggcccagtcgatgatgagttgatccagccaggcgcgatgggccgacagcgcgcgaatgtcggcaaacgccagttgcttgaggtcgacgggtgtggcgatagtgcttaagggtgccagcgccgaaaagcctgccgggtgctgggcaaagcgcttgagccagacggtatcaccgagcgccaggtgattgagggtgccgagaatcgaaccgaaaaacgcctggcggtccgccgccagttcggggtctgtcagcgtgccggcggcggcgtagaccttgcggttcatccactggttgtagttggccatcaacgcgatgtgttcaatgcggttcacgtgtgctctctcttaatggcgcgatgtcgccatgataaagcgtgcccgcccggcggtcatggtgttcccacggcagcgggctatggttgttgaacgccattattgcgccctgggagggtgaaaccatgaataccagcgatctactcgaacagctgttgcgcgccgggcagcaaggcggcgcggcctcaggcggtggcttgggcgggctgctcggcggtttattgaaaggcaccggcagcggcaatgcctcggcgggcggcggtttgggtgggttactcggcggcctcggcggtttgttgggcggcgcacccagcggtggtacgacgcaggcgcgctccggtgggatgaactacgcggcgctggcctcgttggggatggcggcgtttcaggcgtatcaggcctggcaacgccagcaggcaaccgcgccgcagcagcccatccagacggtggatcagttggacggcgccgaagcgcaagcccatagccatgcgttgttgcgtgcgctgatcgcagcggccaaggcggatggcaacatcgatgcgcaggagcaacagatgatttccgccgagctcggccgccacaccgatgacccgcagttgcagcagtggttagacgccgaagtcgccaagcccctgaatgcggcggattttgccgagtatgcaagcgatccggcggtggcttcggaggtctacctggccagcgtgatgctggtgaacgaccaacaggatgcggagcgcaattacctggatgaactggcagggcagttgcagattgagccgcagttgcaactgcagctggagcagcaggctaaagcctagagtggcaaagcaccacaacagcgacctgatgtaatgagatccaaatgtgggagcgggcttgctcgcgaatgcagtgggacagtaacaaatgagctgactgacccaacgcattcgcgagcaagcccgcttgtatgctaggacttgaagggaggaggagggacaaagcccgattctgactgttacagcagtacaga

SEQ ID NO: 84 - DNA, 17395 bp, Pseudomonas poae FL10F
atggctttccgacgaagttggctcgccgcaaagtgtccaccatgtccccgcacacccgtcaaccatgtgtccggtccgtacaggcttttccaaagtgagccgccgtaagggcggaaccctacgaagccgttaccgcagcaacggatatgtacccagcgcccctccaaccgcgacagccacagcactcaactatacccataggatcgatcgccactccgtgtgtgctatatagtcaaccaagcaagtgcttggttggctatcatcggatcacaaaggagcgcgtcccatgcctgtcgcttttcgtttgccgttgcaggtcttctacgaacgtgaagcgcggcatccgcgcaaaccctttctggtacagccggttggcggcggcgaggtgcagacgctcacctggggtgacgtcggccaccaggcccgctgcgccgcgcattggctgcgtgcccgtgagttgccccaaggctcgcacattgccctgatctctaaaaactgcgcgcactggatcatcgtcgacctggcgatctggatggccgggcatgtctcggtgccgctgtaccccaacctcaccgccgactctgtcgcccatgtgctgacccattccgaagcggcgctggtgctgatcggcaagctggacgactggtcggcgatggcgccgggtattccgtccggtttgccgaccatcagcctgccgctgtgcccggcgggcgacttcgattaccgctgggccgacctgcaaagctgtgcgccgatccaggacaaccccgaacctgccgcgtcgagcctggccaccattgtctacacctccggcaccaccggcttgcccaaaggcgtgatgcaaaccttcggcgccttgggtttcgccgccacccgtggcactgagttgttcggcctgggggagggcgaccggctgctgtcctacttgccgctgtgccatgtagcggagcgcatgtttgtggagctggcctcgatctacaccgggcaaaccgtatttttcgccgagagcctcgacacgtttcttgaggacttgcgccgcgcccggccgaccgcgctgtttggcgtgccgaggatctggaccaagttccagatgggcgtctacagcaagatcccgcaaaagcgcctcgaccgcctgttgcgcctgccttttatcggcaggcgcgtcggccataaagtccttgcggggttgggcctggatgcgctgcgcattgcattgtccggtgccgcgccggtgcccgaagccttgttgcattggtataagcgcctgggcctggatgtgctggaggtgtacggcatgaccgaaagctgtggctattcccatgtgtgtcgccccggccagcagacgctcggctggatcggcctgccgtgccctggcgttgaagtgcgcatcgacgcgtcgggcgaagtgcaggtgcgcagtggcgcgaccatgctcggctatttcaaggacccgcagaaaaccgccgagaccctgaccgacgacggcttcctgcgcaccggcgacaaaggcgaacaggacgccgacggccgcttgcgcctgaccggccggctcaaggaaatcttcaagaccagcaagggtaaatacgtagccccggcgccgattgaaaaccgcctggccgaacatgcacgcatcgaacaggtgtgcgtggtcggtgatggccttacggcgccgatgggtttgtgtgtgttgtcggcgggtaatcaggaccgacaggcgctgagcaccagcctcgaacgctggctggcgcaggtcaatgccgccttggataaacatgagcgcttgcgccagctggtggtggtgaaagacagttgggcggtggaaaacggctttctgacgccgaccttgaagatcaaacgcaacgtcatcgagtcgacctacggcaatcatttccaggcgtggagcgcgcgcagcgaatccattctgtggcaggattagggtcgtaataaaaccaataaggataacttcatgagcttgtggcgcacccaaccgaatatcgagcaactcaacgccatccagaaaaacaccattggtgagttgctggatatccgctttgaaagtttcgacgacgaatccctgaccgccagcatggtggtcgaccatcgcacgcatcaaccgtacggcctgctgcacggcggtgcgtcggtggtgctggccgaaagcgtcggctccatggcggcctacctgtgtatcgacgccagcaagttttattgcgtgggcctggaggtcaacgccaaccacctgcgcggtgtgcgcagcgggcgggtgacggcggtggcgcgggcgatccatattggtcgcacgacccaagtgtgggacatccgcctgaccagcgataacggcaaggccagctgtgtgtcgcgcctgaccatggccgtggtgccgctgggcgagaacccgccggcgcgataggcgtggcgtgagtgtcatcattcctggcagttacagtcattgctgtacgtcccaggcgtggtgacaatccacttctgtttttgtagatgagtccggtatgtcgcagcacgtgttttttgcccacgccaatggcttcccttcggccacctacggcaagttgtttgccgccctggccccggaatacgcagtggctcatctgccgcagcacggccacgaccccaggttcccggtggatgacaactggcagaacctggtggacgaactgatccaccatttggagcagcagccagaaccggtgtggggcgtgggccattccctgggcggcgtgttgcatttgcacgcggccatgcgctgcccgcagttgtaccgtggcgtggtgatgctggattcgccggtgctgacccgcgccgaccgctgggtgattcgcgccgccaaacgcttcggttttatcgaccgcctgaccccagccgggcgcaccttgggccgccgtgaagaattcactgacctggacgccgcgcgcagttacttcgccggcaagaccctgtttcgcgggttcgacccggaatgctttgacgcgtacctgcaacacggcctgcaacaggtgggcgaccgtttgcgtctgcgcttcgacccggcgaccgaaatcagcatctaccgcggcgtgccgcacaccagccccggccaggtgcgccagttgaaagtgccgctggcggtggtgcgtgggcgccagagccgggtggtgatgcgccaccatgccagcggcgtcggccgcctgcccatgggcgaaatgctcaccatgcccggcggtcatatgttcccgcttgaacgcccgcaggatacggcaaccttgatcaaaaacctgttcgcccgctggcaagcccgcgagcgcagttgcgcatgagcacgccggtcgaagaagtgcgcctgagcctgccgcacatcgagttggcggcacacctgtttggtcccgaagacggcctgccgctgatcgccctgcatggctggctggacaacgccaacagctttgcgcggctggcgccgaagctgcacggtttgcgcatcgtcgcgttggacatggccggccatgggcattcggcgcatcggcctgcgggcgccgggtatgccttgtgggattacgtgtttgatgtgctgcaagtcgccgagcaactgggctggaaacgttttgcattacttggccattccctcggcgcgatcgtttcattggtgctggccggcgccatgccggaacgcgtgacgcacctgggtttgatcgacggtgtgatcccgccgaccgccgctggagagaacgccgccgagcggctgggcatggcgttgcaggcgcaactgaacctgcaagacaagcgcaagccggtctacagcaccctggaccgggcggttgaagcgcgcatgaaaggcgtggtcgcggtcagccgcgaagccgctgaactgctggcccagcgcgggttgatgccggtgccgggcggttacacctggcgtacggacagccgcctgacgctcgcctcgccgatgcgcctgaccgatgaacaggcgatggctttcgtgcggcgtgtgagttgccctacacagttggtcgtcgcggctgacggcatgttggcgaaacattccgaattgctttctcagctaccttttacggtgaatacgctgccgggcggccatcatttacaccttaatgatgagcccggcgcggtccttgttgcagactgtttcaatcggttcttccacgcgccttgacttggcgcgggcaactgccgaggctgggcggattgaaagggagtcaaccatgtacgatctcaacaccgctgcgacctccgatggccagggctcttcgatccgatgagcctgcgtaaaggatgtatccgtgcccttgggctgtgctgcttcagccccttggtgttcgccgccgacgtgccgggcagccaggatttacctgccgtgtcccgccaggtcgatgcgcaaatcgtcgattaccgccccgctgaagaaaaggaacgcatctaccccatgggcgcgatccgcaagatcagcggccaactgcgttacgaaggccaagccaccgcgcgtggccaaaccaccgcgattacctatgaattacccgccgaacacacctccagcgccgcgtttaccgcgacgcgtgaagcgttgcaggccaacggcgcgcagctgttgttctggtgccaggcccgcgattgcggtgaaagcagcctgtgggccaatgaagtgttcggcaacgccaagctggtcggcgccgatggccagcaggaatacctgttgttgcgcctggcagcaccgcaagacaactccctggtggcgctgtacggcatcactcgcggcaaccgtcgcgcctatttgcatgtggaacaactcgacgccagcgcgccgctgggcgacttgttgcctacgtctgccactttgctgcgcgagttgaaaagcaccggcgagctggattttccggcactcggcgccgaacccgacgccacctggctgaccttgatttcccgtggcctgaacctcgacgccaccttgcgcgtcagcttgaccgggccgagcgccgaagcctggcgccagggcctgatcgacagcggtgtacgcgccgcacgcctggaaaccggcaccggcgacgctaagggtttgcacctgcatctgatacgctgaccgttacaaggcgaacggacccgcgccgttcgcctaagctctcttcctacagccttcttttcgagatacccgatgctcaataacgatcgcctactggtgcaaatcctgctgctggtgctgtttggtgccagcttctgggtcatggcgccattctggtcggcgctgttctggggcgcagtgctggcgtttgccagctggccgctgatgcgcttgctgacccgctggctgggtggccgcgaatccctggcggcgggcatcctgaccttgggctggatgttgctggtggcggtgccgctggtgtggctggggttcaacctggccgaccatgtgcgggacgccgtgggcctgatcaaggatatccaggtcgacggcctgccggctgcgccgacctggctgggctcgattccgctggtgggcgagcgcttggtggcgacgtgggacagcatcgaccaacagggcgccgcgctgatgatcagcatcaagccgtacctgggtcaggtcggcaactggctgctggcgcgcagtgcgcagatcggcggcggtatcctggaactgaccctgagcctggtgttcgtgttcttcttctaccgcgacggcccgcgtctggcgacctttgtgcaccgcctgttggagcgcttgatcggcgaccgcgccggttactacatcgaactggtggccggcaccgtgcaacgggtggttaacggtgtgattggtacggcggcggcccaggcgctgctggcgctgatcggtttccttatcgccggcgtgccgggcgcgctggtgctgggcattgtcaccttcctgctcagcctgatcccgatgggcccgccgctggtgtggatcccggccacggcctggctggcctggaagggcgattacacctacgcggtgttccttggtgtgtggggcacattcatcatcagcggcgtcgacaacgtgctcaagccgtacctgatcagtcggggcggcaacttgccgctggtgattgtgctgttgggcgtgtttggcggcttgatcgcctttggtttcatcggcctgtttatcggcccgaccctgctggcggtggcttacagcctgttgacggattggagtgcaacccaggctcaggttcggcgcgaagacaaacccctttaagccctcggcaaccacatcacggcggtcaagccgccgcctggggtttcttccaggctcaggtggccgccgagacgctccacggcctccttggaaatcgtcatgccgaggccgacgccgccggagttgcggttacgcgagccttccaggcgaaagaacggttcgaacaccgcctcacgcttatccggcgcaatgccggggccatggtcgatcacccgaataaccagtgccccacggctgtcagccagctcaatacgcgcggtgccggcatagcgcagggcgttgtcgatcaggttgttcaggcaggaacgcagtgccatcggctgcacttgcaacggcgcgcaggtgccggcgaactgcacatcagagccctggtcctgggcgttttcactcagggattcgaccagcgcctgcacgtcgagccaatgccgcgtttcgctggtgcgctgttcatgcaggtagctgagggtggcgtcgagcatgccgatcatgtcgtccaggtcctggcgcatctggccttgcagcttggtgtcttcgatctgttccaggcgcagcttgaggcgcgacagcggggtgcgcaggtcatgggacactgcgccaagcatgcgcgcacgctggctgacttgttcgcggatgcgcttttgcatcaggttgaacgttgacgctgcctggcgcgcctctcgtggcccggactcattcaggggcgggctgtcgaggtcgaggctcaggcgttcggcggccgcgctcaggcgctggatcggccggctcagcagcttggcgccgtaccaggcggcgatgatcagcgaaataaactgaaacgtcagcggcaccaccgggccaccaaaccaggaacgatggtgccggggcaggggcttcatcgtgccatccggctgctcgacaaaggtgtcctgcggtggcggaggcggtgggccgtaatggtgaaaccagaagaacgccagtacatgggccagcacaatagccaccagcaatacgccgaacagcctgccgaacagcgtattgaaggcgttgcgcatcagccgatatcccgggcgtcgaacaggtagccttcgccgcgcacggttttgatcagctgcggtgctttcgggtcatcgcccagcttctggcgcaggcgcgacaccagcaaatcgatgctgcgatcaaacgcttcgatggagcggccacgggcggcatccagcaattgctcgcggctcagcacgcggcgcgggcgttcgataaacacccacagcaaccgaaactcggcattcgacagcggcaccaccaggccatcgtccgcgaccagttggcgcagcacgctgttgaggcgccagttgtcgaaacggatgttggcgcgctgctcggtacggtcatcgcgcacgcggcgcaggatggtctggatacgtgccaccagctcgcgcggttcgaagggtttggacatgtagtcatcggcgcccagctccaggccgatgatgcggtcggtgggttcgcagcgcgcggtgagcatcaggatcgggatgtccgactcggtgcgcagccagcggcacagcgacaggccgtcttcgcccggcagcatcaggtcgagcaccaccacatcaaaggtttcggcttgcatggccgtgcgcatggccgtgccgtcagtgacgccgatggcgagaatattgaagcgggccaggtagtcgatcagcagttcacggatcggcaggtcgtcatcgacgatcagcgcgcgggtgttccagcgcttgtcttcggcgatcaccgcgcctttttgctcttcgtttacagagacggtaggggtatgcatagtgcgatcatctgcctggttgttgctgtcagcataggcgcccagctccatggctggaagtgctggacgggcggtcatgtgcgcgaggctagacgcggggcgtgttgagggcatgtcgggaatgtatcagccctgacacaattgcgcgaaatgccgggtttggcggcgcttaatcagtatttaccgatcatcggatcccgcaacggcgccgcttgcgctacaatccgcgccgatttcgacttgcctgagagcccattccaatgtccgtttgccagacgcctatcatcgtcgccctggattaccccactcgtgacgccgcactgaagctggctgaccagttggaccccgcgctttgccgggtcaaagtcggcaaggaactgttcaccagttgcgccgccgaaatcgtcggcaccttgcgtgacaaaggcttcgaagtatttctcgacctgaaattccacgacatccccaacaccactgccatggcggttaaagccgctgcggaaatgggcgtgtggatggtcaacgtgcattgctccggtggcctgcgcatgatgagtgcctgccgcgaagtgctggagcagcgcaacggtcccaaaccgctgctgattggggtgaccgtgctgaccagcatggagcgcgaagacctggccggcatcggcctggatatcgagcctcaggagcaggttttgcgtttggccgcgttggcgcagaaggctggcctggatggcctggtgtgttcggcactggaagcccaggcgctgaagactgcgcacccgtcgctgcagttggtgactccggggatccgcccggcgggcagcgcgcaggatgaccagcgccgcattttgaccccgcgtcaggccttggacgcaggttcggattacctggtgatcggtcgcccgatcagccaggcggccgatccggcgaaagcgttggcagctgtcgtcgccgaaatcgcctgacgatcgttcccacgctccgcgtgggaaagcctcttgtgacgctccgcgtcacgctttgggacgcagagcgtcccgggcagcattcccacgcagagcgtgggaacgatctcatcaactgggtatccctgagacaccgagttgcccgcatcgcaggcaagccagctcccacattcgatcattcccacgcagagcgtgggaacgatctcatctgtcagctgacttttagaatcagcttcccaaagttctcaccgttgaacagcttcatcagcgtctccgggaacgtctccagcccttcgacaatatcttccttgctcttgagcttgccctgcgccatccagccggccatctcttgcccggccgcggcaaaattcgccgcatggtccatcaccacaaagccttccatgcgcgcgcgattgaccagcaacgacaagtagttggccgggcctttcaccgcttctttgttgttgtactggctaatggcaccgcagatcaccacccgcgccttcaacgccaggcggctgagcacggcgtcgaggatgtcgccgccgacgttgtcgaaatacacatccacgcctttggggcattcacgcttgagggcggcgggcacgtcttcgcttttgtagtcgatggctgcgtcaaagcccaattcgtccaccaggaacttgcacttgtcggcgccgccggcaatgcccaccacgcggcaacccttgagcttggcgatctgcccggcaatgctgccgaccgcaccggcagcgccggagatcaccacggtttcgcccgccttgggtgcgccggtgtcgagcagcgcgaagtaggcggtcatgccggtcatgccgagggccgacaggtagcgcggcaagggcgcgagcttggggtcgaccttatagaagccacgcggctcgccgaggaaataatcctgcacgcccagcgcaccgttcacgtagtcgccgaccgcgaatttcggggtgttggaggcaatcaccttgcctacacccagcgcgcgcatcacttcaccaatgccgacgggcggaatgtaggatttgccttcgttcatccagccgcgcatcgccgggtccagcgacaggtattcattgtgcaccagcacttgcccgtcccccggcgtgcccaccggcacttcctggtaggtgaaggtgtcccgcgtggccgcgccgaccgggcgtttggcgagcaggaactggcgattggtctgggcagtcatggcaaggactctttagaaatgaaccatgagtgatagaccctcaaggcgcccggggcaaggtcgaccgagcagcgcgaatgcccgccgataggcagggctaatagttgcaccctgcgccttatcactgcgattcatacagcgccaacggggcttctgatagtgctgacgcgcccgtcatggcgttggctagactcgtgccacagctatttcttgcataggacatcctccatgagcatgacgttttccggccaggtcgccctggtaactggcgccgccgcgggtatcggtcgcgccaccgcgctggcgttcgccgcagaaggcttgaaagtagtggttgccgacctggatgtggcgggcggcgagggcacggttgcgctgattcagcaggccggtggcgaggcgatttttgtgcgctgcaacgtcacgctggaggctgatgtgcagcaattgatggcacagaccgtcgccgcctatgggcgcctcgactatgccttcaacaacgccggcatcgagattgaaaagggcaagctggccgacggcagcctggatgagttcgacgcgatcatgggcgttaacgtcaaaggcgtgtggctgtgcatgaagtaccagttgccgctgctgctggcccagggcggcggggcgatcgtcaatacggcgtcggtggcagggttgggggcggcgccgaagatgagcatttatgcggcgtccaaacacgcggtcatcggcctgaccaagtcggcagccattgagtacgcgaagaaaaaaattcgcgtgaatgcggtatgccctgccgtgatcgacaccgacatgttccgccgagcctatgaagccgacccgcgcaaagccgaatttgctgcggccatgcacccggtcgggcgcattggcaaggtggaggaaatcgccagtgccgtgctgtacctgtgcagcgacggtgcagcgttcaccacggggcaggcgctggcggtggacggtggtgcgacggctatctaggactccatgtcgctgcctattcgaaaaggccaggcgcgctgtggggcgtttccatggctggcacaaggcctcgtcagattgtgtatcagtaggtaaataattcaataaaatcaatgatttaataattttttgcgaccagttgaaccgggcttctgtgcttaactgtttagggttgattaacagacagttgaagtgagtggctcatggatttaggcatcgatcgacaagcccttgtaccggtggtgcagcaaatcgtcagtgcggtggcgcaatggattcgcaagagcggcgcgagccccggcacgcgcttgccgtccatccggcaattggcccttgataacctgctcagtcaatccagcgtgctcgaagccttcgaacgaatggtggcccaggggttactggaggcaaaacagggcgcgggatttgttgtggctcaaccgccggtttccctggagagccaatggtatgaaggtgcggagctgggctggggcgcctatgtcgagggaccgttgggcgaattgaagctcggctgcggctggttgccggacgcttggcgagaaagcgatgacatctgttacgccatccgcgagatcagccgcaccgacaccgtcgccctgtttaactacagcacgccgctggggttgccggtgttacgcgaacaattgctcaagcggctgacccagatgaaggtggtcacccacctcgattgcatcctcaccacccacggcgccagtcatgcacaggacctgttgatacgcacattgctcaaggccggcgatacggtggtagtcgagacgcccggttatgccaacctctacaggcagttggaacgccacggcgtcaagctgctggaggtgccgcgcgtcgtgggtggcccggacatcccggtgctggagacgctgctgcaaagccatcgccccaagtgcctgttcatcaactgcctgtatcacaaccccaccggcaccagcctgtgccgcggggtggcggagcgtctgttgcaactggcgcacagcgaagatttcctgatcgtcgaagaagacgtctacggcgacttgcagcacgccagctgcacacggctgtcggcgctgccccatgaagggcgggtgatctatatctcgagtttttccaaaaccctcagcagtgcattgcgggtggggtatctgagcgccagtgcggcgcttgtcacgcagatggccacgctcaagacgttaacgggcatcggcacctcgcggtttgccgaggccgtggtggctacgctattggccaatggcacttaccgcaaatgggtgcagcgcctgcgcaagcgtttgaacacgcaaatggcggcgacgttgcaggtgctggaggacgaagagtgggaggtgtttgccgtgcccgccgggggcatgtttgtgtgggcgcggcctggcgtcggcgaccgttcgcggttgcaggcgtgcgcccggcgcttgtgtgtcttgctgtcgccgggggcgctgttcagtcccaaaggcgaacacagtgactggctgcgcatcaatgtggcctatgctgctgatcagcgggcgctggcgctgttccgtgcgatggggcctgccagatcgaccttgaccattctgaaaacgacgagcgtgtagctttttgccattattgtggcgccaacgtcttgtgccggtagcgcgtcgttgcgaatctcgcagcatggaaaccaggcttgatggcatctgccattgcaagaggatcaagtgcaatgatttcggccgtgcaacgacgtttcgccaacctcggtatggcgaaaaaactgggcgtgggcttcaccctggtgctgctgctgacggcgctggtggcggccattggtgtgtggtccctgcaaaccgtgggtcaacgttttgaaggcctcaaggcaatgtcctcgctcaacagcggcctgctcaaggtgcgcctgatcgagcaggattacgcgttgcacgccgaccccaaggccgtcgacgccctgcacgaaagcgtcgacgccttggccgcccaagccgccagcctcaaggcccagtccgccgcgaatgtgccggtgatgagcgaggttgaacaggcgctggccgcgtatcgcaaggcgtttgacgagtttgtcgagttgacccagaccaaggacctggccctggaaatggccagttggtcggtctccagtgtggccaataacctcgacgtgttgcaggcaggcctggccgacgatggcgcctatggtctcaaggaaagccagggcaaggacggcgccgagtttattgagcaggccgggcaggtcagccaggtgtcgcggttgatgttgcaagccatgaacgaagcgcgactgcgcctggatcagagccgcaaggtcgatgcggacaacgccgagcaaggcaagatcgagcaggccgaccaagccctggcgcaggtcgagcagctgaaaacctcggtcaaggacgcgggttaccagactgtgctcaacgaagtgtccgggcatatcgccgcgttcagcgagaaactcggcgagtacaccgggctgctggcccaggaaaaagtcgtctacaagcaattgcatgaccgcgccgatcaagtggtcagccgcgtcaaccaggcgtatgacgctgaagatcaatccatgcaggcgcagctgaaaaaaagcgcgctgctgatcgtcgtttcgtcagcgctggcactgctggtgggcttgattgccgcgtgggtgattacccggttgatcgtggcgccgttgcgccgtgtgatcgccgtggcccagcagattgctgcgggtgatttgactgggcggatggaggtcagccggcgtgatgaaatcggccagttgatgcaggcgatgcaacagatgggcagcggcttgagccagatggtcagtgggctgcaggccggcattgagcaattggccagttcggcgcaatcactgtccagtgtcaccgaacagaccaatgtcgaggtcagcagccagaaagaagaaaccgagcaggttgccacggcgatgaaccagatgaccgccacggtgcatgacgtggcgcgcaacgccgaagaggccgcgcaagccgcgcagaccgccgacgacaaagtcgacagcggccagcaggtagtgcgtcaaagcctgcaacgtattgaattgctcgccacctccagcaccagtgccagcgcgagtatcgaaagcctgagcgcggaaatccagaatatcggcaccgtgctgagcgtgatcaaaagcgtggccgaacaaaccaatttgctcgccctcaacgccgccatcgaagcggcccgcgccggcgagcaaggccgaggtttcgcggtggtggccgatgaagtgcgggcgctggccaagcgcacacagcaatcgaccgaggaaatcgagcgcctggtcagtacgttgcgcagcgcggcgcaatcgtcggtgcagcagatccagcaaagtggcgagttggtgaagctggcggtcagcgacgcgctggaaaccgagagtgcgctgggcagcatcgcggcagcggtttcgctgattcagcagatgaaccaacagattgccgcggcggccgaggaacaaagttcggtggccgaggagatcaatcgcagcgtcaccagcattcgtgccagtgccgatcagtcggcgttgagcatgcaaggcaatgccgcgtcgagcatccaactggcgcagttgggggcggagctcaagggcatggtcgggcacttccggctttgatcgcagcagttgcactgcgatcaaagggcagggcggcgatcaggcgtggttggcgaggaaggtcagcagcgcttcattgacgaagtccgggttttctcgggaagagatatgccccgcttctggaatcagcgtcaggctgcacccgatcagatcggccatttccttggattcggcgggcggccgaggcttgtcctgttcgccacacatgaccagcgtggtgtcggtgtccaggtgcggcagttggtcgaggatgtcggcgcggctgaagatcaggcggcccagcggcacgatgctttgctgcaggcgttccttgggaaacgcctgcaatgcgctgcgaaaatcctgatacagcgctgattcacgatcaatcgtcgggcggaagaagatcggtgcaaccacatccagcaacggctcggggatggcgccggcgtcttcgatcatcttgaacagcgagaagtagtattggcgggtggcctcgggctcggcgccgaggtaggtgtccatcagcaccaggctgttgatgcgctcaggtgccagcagtgcaaggcgcgcgccccacatgccgccaaccgacaggccgaccagattgatgtgggcgatatccagctgatccagcagcgccagggtttggcgtgcgaggtcgtccagggagtgggtgtgcgccggcagcgggccggattcaccgtggccccacagttcggggacgatcacacggtactgttgcgacaaagcttcaatttgcggcgcccacatctcgcggccccacaagtaactcgaacccagcaggacgaccgggccggtgccctggtcgacgtagtgcagcggttgtccatcaatcacggcaacaggcatagcaggcctctaacttcacggagtgaggggcacttttttacgctagtcggaggcggggggataggtgcaaagtgatggcatgttgtagcgaggcgtttgtcggtggtgagcagcattgttgtggcaggcaggcttgtggtggggagcaggctggtagtggcaggcaggcttgtagtggggagcaggctggtagtggcaggcaggcttgtagtggggagcagactggtagtggcaggcaggcttgtagtggggagcaggctggtagtggcgagcgggcttgccccgcgttgggctgcgaagcagccccaaaacctgacgatgcggtttatcaggtacaccgcggcggttgaagtgggagcgcttcgcactccaacgcggggcaagcccgctcgccacaacaagtccgttcgccacaacgagcccattcgccacgacagccccgtttgccatgggctgcgtggatcagtcgtagatgactttctttttccattcggcgtcggcgtcgacgactttcagcccttcagtcagttcgttgacttcatcttcggcaggcttgctgttggtcaggacggtggagttggcgcgcgccagttgcgactccagcaactgcagttgcgcgctgtagagcaccggctccggctgtttgcgcaagtactgtacgccgcgctcgaacgccaggcgtgcctgaccaggctggccttgttgcagggcatgctggccgaggttgttgaagaactcgatgtgcagcaacaccaggatatggcgaatttccttgatccagtgcttggcttcgttggtcggcaggaaaccgtcctgggccgcacgggtgacttggccgtgcagggcttcgagcaggaagcgcacgtccttggccttggcttcggtctggatcggtgccggcgggttggtcaccggaatcgattcgccctggccgatcagtgcattcaactcagcgatgcgggccttgagcggcgcgctggacttgttgaggttcaacaggcgctggttgacgttgagctccaggcgggtcaacaacagtttcagcttcggggtcatcaactggccggggaacgtctcggtgatttcaccgcagcgacgcaggcgatcgttaagctcgatctcggtgcgcttcttttccagtttgttgttttccaccacgtggttcatgtagccaatggcgatcagtattacgatcccggctattaccagcagggtgatcatgagtggtgtcaccggtgtgacctctttatagggtttgctgtggagtgtagtgactgggccatccgacggataggattgttcgaccagttgcccaggtagtttcttctatataggtacgcgttccctgcatagatgcacattgccatcatttgctggggcgaactatagcgccttgtcggacgccagaatataggcgccaaagcctggacgggcacaatgcccgcaaagccctggaaagcagggggaagtcattgatttaaataaatttatccttgggggttgacgacctttcaatccatccatagaatgcgcgccacttacagcgtaaagcacacagcgaaacgcggtagggagtgaatgttgtacgtgtgtccccttcgtctagtggcctaggacaccgccctttcacggcggtaacaggggttcgagtcccctaggggacgcc

SEQ ID NO: 85 - DNA, 16678 bp, Pseudomonas poae FL10F
acgagttttgcttgctctgtgtacttacccatgacgcccccaaaggttgtgtccagcctttgggggtcagttcactccgcgtgggaacgcctccggtgacgctccgcgtcacatggaacgcttacatcggcgccggctgaataatttcaacccagtacgcatccgggtccttgataaaggccaggcttttcatgcggccatcgctcaagcgcttctggaagtcacagcccagcgcttcgaaacgctcacacgcagcgacgatatccggcaccgagatgcagatgtggccaaagccacgcgggtcggtgttgccgttgtgataggcaaagtcggcatcgttttcagtgccgtggttgtgggtcagttccaggatgcctgggatcgacttcatccactgggtgcgctcagcggcgtcggccgggatttgggccttatcgaccagggccaggaagtacaggctgaattcagcttccgggaagtcgcgcttttcgaccagggaaaaacccaggacgcgggtgtagaaatccagcgacttggtaatgtccttgacccgcagcatggtgtggttgaacacaaagttcgtggtggcggtgtcaggttgggcggtgacgcccgggaaagtgttcagatcgtgcaggctcatgggccctccagaaaaaaatggggcaaacgcgacttgaaagaataggcgcggtccgttggcttgcggcaagcatccctgcagcgcagccatgatacgcaagggctggctactgcgccaaatgaaaaaggtcacgcaacgcttgcgaccggcgggtgccgaggctcaaactttgtcgcttgaaccttgggtgtttttcgtaatgattgaattccgtaaatcgctgttgagctccatgtgtttcctgttggtcagcccattcgtgcaggccgccgacccggaaattcactggcccagcggctggcaagtcgaggaagttgtaccggatggcgacgcgccgggtaaaccccaggccgtgtctcggcaacgcgcgatcaaaaacgatgaaaatggcaacaccttgatggtcatggagttgaccggcacacccatagaggcggggcataaagttaatcttcaaggtgttttgctggaaatgcgtaaatccatccagaaagattttgcccagggtggttatcaaagcgtgtgcagcaagatgcaccccagcacattgagccgtcttgacgcactggaaactacttgcgtgattaccgagaacggccgacacgtgttgtcgcaaacattggtgggcgcggtcgataccgataaagcctatgttttttcatacgccggccaagcggaggcttatgaagccagcaaggcagaagtcggttcggtgcgcgacagtctgaaactttgaatgcactaggttgatcgattttgaacccaatgaactattagttaagttcgtttccgaacccttaaacagaaagccccgcttatgcggggctttttgttaatgcgttgcgatcagccgcgaagccaggaatcaacagtggcggcgccatactgttctttccaggctttcaggccgcggtggttgccgcctttggtctcgatcagctcaccggtgtgcgggttgctatacaccttgaccacgcgtgcgcggcgctgttttggtgcggcgaccgtggcgccggccttgccagggtttggatcaaggatcgagatgatgtcgcgcaggcctttgccatactgcttcatcaagccttgcagcttttcttcgaattcgatttctttcttcaggccggcgtcgttcttcaaggattcgagctgggcaagctgctcttgaagggctttttctgctgcgcgaaattcggcgagtctggacaaaatctgtactccaataatggtgtttgctgacatcaactgcagataaagctgtaggccaagagctttaagataactcaaagaaagaggcctttctgcgagttcagcacaggcaggaaaaattgtagtagttaatgcgccgggagtaaatcacgtctgttgactaaataagataatttcatcaagcgcagtgtatggctattcaatggctggtcagcgacttaatgaactcttcacagggtaatggccggccaaacaggtaaccctgcaggaaatccacaccgtgtgcagcaagatagtcacgctgctcggctgtttccacgccttcggcaacgatgcccaaatccagcttgccggacagttcaatgatactgtcgagaatatgccgcgagagggcgtccgcaccaatcatggccacgaagctttgatcgattttcaagtagtcgacattgaagttgcgcaagtaacccaagctggaatggccggtgccaaagtcatcaatcgcaatcatcacgcccagttgatgcagggcctcgaacaggcgacgggtgatatcggttggcttgatcagttcgcgttcggtcaactccagtaccagcgtgacctgaccaggcgtgaaggcggcaagaaatgcccggcagtcctccaccaggtccagatccaggcagtggcgtgcggtgatattcacgccaatatgaaagcccggactgaaacgcccggcatgcggggcaagttgttcagccgtctggcgcagcaatgcgcgggtcatcggcacgatcaagccggaatgctccgccagcgggataaacaagtcagggcgcaccaagccttccttcgggtgttgccagcgcatcagcacttcgcaacccgcccattcatgcgtatcaccgcgcactacgggctggaaatacgcgatgaactcgttggcgcccaatgcgcgctgcaactcatgggtgggtgcagaggagcgtttttgcagccagtgcgcaagcacgccggccagcaccccaaagaacaccagcaggctgaacagcgccgggtagcgtgcttccatataacgccacacttcgccggacggcatgcccgcctcgacgctgtagtgatagcgctctgaagccaaatgctggtgggccacggcgaaggccggcactgcggtgttgtgcaccttgccgtcggcgtccagccagttgggccccacttgcagcaccaggtctgtgtagcggctgatcaggcgcagtgcgttggtcaggtggaagccatcaaccgaggcaaaggccgccttgtcaccgtcaaccaagcggtacaccagcagcgcggtgtccggcgtcaccgggttgccgttcattaaccacagtttgccatcgacataatcgtccgggttgaccggcgactggtaattaccgccgaacagggagctgcaatagatgttcttctgccaggacaacgtagtggcccgcacaaagggccgccgcgtgacttgttcgcgtagcgccagttgcgcaccgttgtcgcagggttggccagccagcggcagcaacgcctgggcggcgagctcggtgttgctgagcatcaagtcaaactggcgcaccgcttcgcgggcggtatgtgcggtgctttgttgcagcgtacgttcggcttgccagtagaggatgacaacacccaaggcgatcggcagcaggccgctgagtgctgtaatcaaataccgggtggcgcgttttcgcgggccgttgacggtcaggggcatgaagggaacggcctgtcacaggatgggaaagcagcagaggcgctgatcagattaaccccatgatagatggcgcaggccaaataagctcgccgtacctggccgttcagccaggggcagcgctagaaatccaggctttgcgccacgtgaataaacgcgagcgtcgccggcgtcgactggcgttggtccagcaccgccaggccgatgtcacgactgacgcgtggcgtcagcggccgcacgtggtaacgcgcgtccggcgtctcgggcaatgacgcctgcgccaccacactcacgccgtcgccgcggctgactgcctccagggtactgagcagttgcgagcatcggtaacgcacattcggcgtgagccgcgcagccgtgaacaaccgcgagaccagctcctgcgaacccgcgtcggtgagaatgaacgggtcgtcgcacagcgccttcaattccacgcaaggctgcgcggccagcggatgcgctgcgggcagcagggcgaccatctggtcctggaacagcgcaaacgtatcgaaacgctcctgttccagcaccacaaatccgacgtcgatacggcgctcatccaaccactggatcacttggcggtccgggccttcatccacatgcacttcaatgcccggatgctcacgcctgaaccgctcaagaatgcgcggcaacaggcgattggatgaagtggggccaaacgagccgatgcgcagcgtgccgcgcttcatgccccgggcatccgaggcttcctgttgcagggtgtcggccacgccgagcagcgtgcgggcgcgcatcagcagttgccggccgatgtcactgagttcgacgtgagactgatggcgtcgaaacaattcgacacccagttcctgttcaagggctttgatcgcatgggaaacggccgactggccgatacccagtcggtgcgcggcgagggtgaaactgtgcagctcggccacccgcgagaagatttccagttgcgtgagcgtcatgagtatttactcattttacgatgatcagtcattagtcgcagcataccccaaccctgacactcaaagagcaccacgatgacgttttcgcctgaccgcctgacttacctcaaacttgccgctgtcaccatgatctggggcgcgacctttgtggctggccgctacttggcggctgacgtcgacccattgctggctgcaaccttgcgctttgtgctggcaagcgcagcgctgctggggttcatggcccttgtgcgcgtgcgcctggcgcggcccagcggcacgcagctcatgcagttggcgatgctgggattcttcgggatttacttctacaacctgtgtttcttttacggcctgcaatacatcagcgcgtcgcgagcgtcgttgatcgtcgcgctcaacccggcggtgatcggcctggcggcgtggcttttgcacaaggagcgcctgggcgcggccaaatgcctgggcatcgccttttgcctgggcggagcgggtgtggtgattgtcagccgcaacccgcacctgttgcagggcgccgacaatgcctggcgcggcgacctgctgattttcggctgcgtggtggggtggggcgtgtactcgttgttttcccgtggcctcaacaaaagtctggggccactgcaaaccgtgacctggtcgatcctgctgggcacggcgatgttggcgctcaccgcgttggtcggcggcaagctgacattgtcagccctgagcgccatccatctgccgcaactgctcagcctgctctacctcggcatactcggctccgcgctggcctacatcgcctggtatgacggaatccgccagatcggcgcgacccgcgccggtgtgttcattgcgcttaacccgctgacagccgtcatctgcggcgccgtgctgttgggtgagcaattaaccgcgccgatgctgctgggtggggccgtcatcctgctgggcatctatctgtgcaacaaaccccttgcaccggcccggccattggggatttgataagagtgcggacaaaccctgttacgctgtgtagaatcgatttacgcatacaagaatatggacttgcgctcacgcaagcctcggccgtcagagactgatgtaaccatgaagctactcggctcccccctcatctttggtgacttcctcgcccgcagcgtgcgaggcctctcctgcgcgccacccgccgacctcatccttgctcgcaaataactatgtgttaactacaagaatgatgaggtgcctccatggcagaccaatacgaaaacccaatgggcctgatgggctttgaattcatcgaattcgcatcgccaaccccgggcacccttgagccgatcttcgagatcatgggcttcaccaaagtcgcgacccaccgctccaaggacgtgcacctgtatcgccagggcgagatcaacctgatcctcaacaatgagcctgacagcctcgcctcgtactttgcggccgaacatggcccgtcggtgtgcggcatggcgttccgcgtcaaagactcgcaacaggcttacaaccgcgctttggaactcggcgcccagccgatccatatccaaaccggcccgatggaactcaacctgccggcaatcaagggcattggcggcgcgccgctgtacctgatcgaccgtttcggcgaaggcagttcgatctacgacatcgacttcgtgtacctcgaaggcgtggaccgcaacccggtgggtgccggcctcaaggtcatcgaccacctgactcacaacgtgtatcgcgggcgcatggtctactgggccaacttctacgagaagttgttcaacttccgtgaagcgcgctacttcgacatcaagggcgaatacaccggcctgacctccaaggccatgagcgccccggacggcatgatccgcatcccactgaacgaagaatcgtccaagggcgccggccagatcgaagagttcctgatgcagttcaacggcgagggcatccagcacgtggcattcctcaccgacgacctggtcaagacctgggacgcgctgaagaagatcggcatgcgcttcatgaccgcgccgccagacacctactacgaaatgctcgaaggccgcttgccgaaccacggcgagccggtggaccaactgcaagcacgcggcattctgctcgacggctcgtcgattgccggcgacaagcgcctgctgctgcagatcttctcggaaaccctgatgggcccggtgttcttcgaattcatccagcgcaaaggcgatgatggcttcggcgaaggcaacttcaaggcgctgttcgagtcgatcgaacgtgaccaggtgcgtcgtggtgttttgaccgccgagtaagcataaaaaagcccggccgagttaacctcggccgggctttttaacgcctgccaatcacgctttgcgttggcgcaccaagtgcttgaagccttcgtacaccagcaccatcaccgccagccagatcgggatataggtcagccactggccgcccttgatgccttcacccaatatcaacgccaccgccagcagcagcaccggttccacatagctgagcagcccgaagaggctgaagggcagcaaacggctggcaacgatatagctcaccagtgccgaggcactgatgacgcccagaatcggaatcaacgcatacagcttcgggtgaatatccatcaccgcaaagccttgttcgccgtgctgcacaaaccaccaggccactggcaacatcagcgccatgtccagccacaggccgcccaagtggtcggtggtcaggtatttgcgcaccacgaagtagatcgggtagccgatgatcaccaccagcgtcgcccaggaaaaaccaccggcctgatacagctcgttcagcacgcccagggctgcaaaaaacaccgcgatctgctgcaggcgcgacaagcgttcgccgtacaccaggcgcccggtcagcaccatggtcagcggcaacagaaaatagcccaccgacacatccaggctgcgcccattgagcggtgcccacataaacagccagagctgcacaccgagcaaggccgacgacagcagcacgccgccgatcagtcgcggtttactcgccagcatgcgaagcagctcccagacccgccgccattcgccgctgacgatcatgaacacggtcatgcacggcacggtcagcaacatgcgccaaccgaaaatttccaggccactcaatggcgtgagcagcgacgtgaagtaatacatcacggcaaacaacaccgaggccaataccgataacacaacacctttagacacactgtcctcgcgaaagccgttgactcataagaaggggaagttaggcggggaatatagggttcgcgacattctttgtcacgttgaatcagccggtttagtggaacaatttcccacgtcgattccacataagtacgactgcgctcgactagcatggccgagcttggtttcgcacggaaagttttgcacggctgatcagtgccctgcgagaggttcaactaatggaaaaaaacattaatagcgactttgatggtcatcatcaccgtttgatgataaccgctgctctgacgaggaactgttcagggggttgcatacaaacacattagataatgaggttactcatgcaaagcatcccatccaatgtaactctttcctcttccgccgcccacaccccgctgaacgtgttaaatagtccgagcgagagtcctgcggcgcctcaggaaaatctgcccgcctggaaaaaaacaaatagttatcaaacattcacagatttgttggccagagacaccgaccgtggcgtgctgacggcagatggaaaagagctgcttgatgcattgctgaatcctggcccgtctcaaccgaccaaagtgcacgtactgagctttgggatacacggcgtgcgtgccaacgatatgtttttggtccggcgtaatccgccggtgccgggcaaaaccaatgttatgttgtacatgccggaaaaagatacgccttcattccatgagtttgcaaacagcaaggatgttcataaattcttcaaagagatccccacgaacccgggcgccttcgcaacattgcttgatcattttggcagggattcacgccttgagtctgtcgaaaccgtccggcaagcgatgcaggagttcgcgtccgcgccggagaatagtaagcccgcctgggggcttggtggactaggttacatcaactcgaatgtcttcgagcgcttggaggaatggactatacaatcagccaatactccgattgtgaatggtctaaccgatatacagatcaaagagaccagcgctcaggggattgtcacttacatcggaacgcgccccaatggtgagtcagtcagctttcgatatgacatgcttggcaacctgacgggggcgggggaagaaggtaatatttattatttaaaaaatgctaaaaccagtaagagccctcttgttcgcatcacgcctcagcagttaggtacgactgtcattgaggatgcgctaaaggtcatccgtgaggagggcgctgaaggggtaattaaagcactcggcgattttttacaaaccccatttgactgggtttcaaaacttctggaggcatttggcgtctctaaatcagtctcgggagacatagagcgattcattgataacccagtcacttttctattgttatatgggaacaagtacaatgacctcggtaagacgtttggcaaaacgaaagccgagatggataagttgctgacacaagtgggtgatggtgttcagggggccgtgcccggttatggtaagggcagggctctggcaacgttgattggaaaggcaataaaaaatgagccactcaccgatcaggaagtaagagacggcgccgacgcgttagggctcaaaccttaagcacagggcgagcaagcccgcccatactggaaagttgggcgggttttttaccgagtcacacggcccgacacaaaatggctcacatcattaaaccctggcgtagacgaatgccctggcgtcaccagtgaatcgataaacgcttcatcttgcgccgtgattgtcacacccaacgccccggtatacgcatcccactgcgcctcggtacgcggcccgacaatcgccgagctcaccgccgcgttgttcagcacccacgcaatcgcaaactcgacaatgcccacgccacgcccttgggtgtactgctgaatctgctgggcgatgcgcagcgattccacccgccattcggtttccagaatgcgtttgtcctggcgcgccgcgcggctgccggcttcaggtgtcacgtcgggtgcgtatttgccgctgagcacaccacgggccagcgggctgtaaggcaccacgcccaaaccgtaggcggctgcggcagtgatctgctcgacctcggcctggcgattgacgatgttgtacagcggctggctgatgatcggccggtccacgcccagacgctcggccacgcgaattacttcggcgatgcgccagccgcggtagttggacagcccccaatagcggattttgccctggcggatcaggtcgccgatggccgacacggttacttccagcggggtgtcgtggtcttcccggtgcaggtagtaaatgtccaggtaatccgtgtccaggcgtgtgaggctggcttccacgccattgaaaatgcgcttgcggctcaagccgctgcggttgggcaaaccgtccgccgggccgatgccgaccttggaggccagcacccaatccgaacggtggcgggcgatggcttcgccgacgatttcctcggagcgcccgccggtgtagacgtcggcggtgtcgataaaattgatgccctggtcccaggccttgtcgatgatgcgcagcgagtcctcggtgttggtctgctcgccaaacatcatggtgcccagggtcagtgcgctgaccttcaacccggactggcccaatgtgcggtaaatcatgcaaagctcctcatggcagggaaacgtgccccatgcaataccagactcgcgggctctggaacaagccctgtgcgcgtttcttcatgcactcagcaaggcctcacagcgtgcctgtaaaaatcggtgcagcactttcacccgctccgacacttgcaggcggtgcgggcacatcaggttgaagggtgtgggttcgccttgccagtcgggcaacagcggcaccaggcgcccggcgcgaatatcactggcaatatccaggttggctttataggcaatgccatgaccggccaaggcccagcgccgcacaatttcaccgtcgtcgctcaggtaatcgccgctcacctcgacctcctgcaacacggcgccctggcgaaaataccaggtgttgttggcttgccctcggcgcatgtagcgcagcgtactgtgctgcgctaaatccgccggcgtgcgcggtgtgccgtgacgcgccaggtagtcggggctggcgcagggaatgcgatggtggccgggcaccaccggcagcgccaccaggcttgaatcccgtggcacaccaaagcgcagggcgatgtcgacggtgtcgcggaacaaatcggcattactgtcgttgagcaataactgcaggcggatgttcgggtgttcgagcttgaattcatccagccagcccagcagtacattgcggccaaaatccgaaggcgccgccaactgcaataaaccgctgaggctctggccctgttgcttgatcgcctgctcgccttccgccaaggcctccagggcgacccgcacgctgtccaggtagcgccgaccttcttcggtcaggcgcatgctgcgcgtggagcgggcaagcaggcggatgcccagccgggtttccaggcgcttgagcgcaatgctcgccgccgccggcgtcaggttgaggctgcgcgccgccgccgacaggctgcccgtatcagcggtgcgcacgaacacttccaggtccagggttgagctcatttgtaaaaatcctttaaagatcttgtcgttttaccgggatttttccgtgattgccaagctgggaagatgaacgctcactttcttagtcaggtagtcaccccatggcatcttctctcagcggtaaaaccatcatcgtgattggcggcagcagcggtatcggcgccgccgtggccaaggccgccgtggcacgtggcgcacaggtggtgctggccgggcgccggttgacctccagtgtcgacaacggtgtgcgcagcgagccggtcgacgtcactgacagcgcgtccttgcagcgcttgttcgaaacggtcgggcgcttcgaccatctggtctacacctcggggccgtcggtgcgcgccaagcccttgatcgaaaccgacctggccgaagcccaggacaatttcaatgtgaagctgtggggctcgctgcgcgcgattcaactggcgctgccctttctcgacgcacacggcagcatcagcctgacctcgggccaactgggccgcaaattggcgccaggccagttcatcaagaccggcatcaacgccgcgaccgaggcactcggcaagcagttggcgaaagaactggcaccgcgccgggtcaatgtgatcagcccaggggtaattgatacgccagcctatgccgggttgggggaagagcagcgcgtggcgatgttcgccaaggccggcggggcgttgccggtggggcgagtagggcaggctgaagaagtagcagcggggtatgtgctggccatggaaaatggctttatgaccggcgccgtcatcgacatcgacggcggcggtcttttgtaaacacagggcaaaaatgtgggagctggcttgcctgctcccacattgtcctcattgctgctgagaaaaggttatgccttcaacgtccgcgtcatgcgcagcgccaacacactacccgccacaatcaccgccgccagcaagtacaacgccacatccgtcgacccggtggcatccttcacaaagccgacgatgtaagggctgaggaagccggccatctggcccatggagttgatcagcgccagcccgcctgccgctgcgcccgcactgagcatggcggtcggcaccggccagaacatcggcaggccggtgagggcgcccatggtggcgatggtcaggccgagaatggcaatcgccggcgtggtggcgaagttcacagcaatcaccaaaccgatagcgcccatcaacatcggcaccaccaaatgccagcgacgctccttgcgcaagtcggcggagcggcccaccagcaacatgaacacagcggccagcaagtacggaatcgcgctgagccagccaatcaccaggttatcgctgaagcccaggctcttgatgatcgacggcagccagaagttgatggcgtagacgccgctctggatgcagaagtagatcaggccgaacgcccagatcgccggattcttgaacacttcgcccaacgaatccgtggtggttttcggcttgttcgccaagtctgtcgcctggtcggcttccagcaccgcgcgttcatggggcgtgagccacttggcgttggcaaaactgtcgctgagcaggaagtaggcgagggcgccgaggattacagtaggaatgccttgcagcaggaacatccactgccagcccgccaggccaccttggccagcggcgaagtggttgagaatccagccggaaaatgggctgccgagcaagccggacaccgggatcgccgacatgaacagcgccatgattcgcccacggcggaaggtcgggaaccactgcgagaggtacagcaccacgcccgggaaaaagccggcttcggcggcgccggtcagcaggcgcaaaccatagaaatgcgtcggtgtcgtcacgaacagcaagcacgttgagagcgtgccccacacgatcatcatcagcgcaatccagcgccgtgggccgaatttggtcaacgccaggttgctcggcacgccacacagcacgtagccgataaagaaaatcccggcacccaggccgtatacggtttcactgaatttcaaggcatcgagcatctgcaacttggcaaagccaacgtttacccggtcaaggtagttgaacaggtagcagatgaaaatgaaggggatcaggcgcagggtaatgcgcttgtagatggcgtttttatcgtcatcggtggccagtgtggcagcggcgctctgtgacatggcagtctctctttattatgatttttcgcgatgcgaaggtaacgttgatcgctcaatgagtctcggccacctggcgggctgctgtctttgtgctcgcgcacagtcaagcaggctttgcgctgtgccaatgaccaagtcgcttttttcaggaaattagccccatgttcgagctggatcatgacctggcgcaggatatcgtcaatcgcaccatggcgatcttgccctataacgtcaatgtcatggacagccagggcctgatactcggcagcggcgagccggagcgaatcaatacccggcatgaaggcgcgcaactggtgctggccaacggccgggtggtggaaatcgacggccagaccgccaagcacctcaagggcgtgcagcccggcatcaacctgcccttgatgcacgaccaacgcttgatcggcgtactcggcatcaccggcgaacctgaattgttgcgtacctatgccgaactggtgcgcatgaccgccgaaatgttggtcagccatcgccaccagcaggctgagcaacaatggcggcgccagcgttgcgacgacttgctggccttgttgctggctgaaactggcgattcaccgcgcctggtcgatgaggcccagcaactggggctcaagccgcagatggcgcgcacgccgtatctgtttgaactgggcgtaggccaatcggcggaggcattaagtgcctggctgaccagccgttacccggacagttggtgcgtcagctctgcgcagttttcgctgttgtggtgccggccggcagcggtgcacgtggacaacccacggctgctggaaaaactccaaagcctgggctggaacgtgctgcgtgttgccgtcggcgggcaagccgagggtttggccggtttacgccgttgctatcgacgggtcggtgatttgctggcctatggtcgggatattttgccccactcacggctgttgaccctcaaccgctatcgcctgccggtgatgctctggcgccatcgcaacgacgatgcgctggatgagttgctcaacccgttgcgcaaagtactggccaaggacaccaacggccaactcctggccactttgcgcagttggtgcgagcacgacggccaaagccaggcctgcgcagacgcgttgggcatccaccgcaacagcctgcgctaccgcatggagcgcattgccgagctcagcggtgtcgacccgctgaccctggatggcatgcttgccctgtaccttggcgtacagctgctgccccaggctttgtcggaatgaacaacaaacctcacccacacttgtgcatcggaccggcgtcattgccgcggccaactggcagcatgggcgttataaaaaccggagaaagcccatgaaaatcatcatcgcccccgactcgttcaaggacagcctgagtgccgaaggcgtcgcccaggcgattgccgacgggttggcccaggtgtggccggacgcgcaattggtccagtgcccgatggcggatggcggtgaagggacggtggatgcggtactcgctgcgtgcaatggcgaactgcgccgccaaaccgtgcaaagccccttgggcggcgccgtcgaggcgcgctgggggtggttggccgacagccacaccgcgctgatcgaaatggccgaggccagtggtttgcaattggtgccgccggggcagcgcgatgcttgctccagcagcacctacggcaccggcgaactgattcgcgccgccctggatgcgggcgctcagcgcatcatcctggccattggcggcagcgccaccaatgatggcggcgcaggtgcgatgcaggcgctcggcgtgcaattgtttgatgcccaagagcacatactcgcacccggcggcctgaccttggcacgcctggcgcgcatcagcctggagcacctggacccgcgcctggcccaggtacgttttgaaatcgccgccgacgtgaataacccgttgtgtggcccgcacggcgcctcggcgatcttcggcccgcaaaaaggcgccaacccgcaacaggtcgaacaactggacgcggcgctcgggcactttgccgatcactgcgccaaggtgctgcccaaagacgtgcgcgatgaacccggcagcggtgcagccggtggcttgggctttgctgccaaggccttcctcggcgcgcagtttcgcgcgggtgtagaggtggtcgctgagctggtggggcttgacgaagcggtgcagggcgctgacttggtgatcactggcgaagggcgtttcgacgctcagacgctgcgcggcaaaaccccatttggcgtggcgcgtattgcccggcagcacggtgttcccgtcatcgtgatcgccggcaccttgggcgacggctacgagcacatgtacgcccacggcgtgaatgcggcctttgccttgccctcggggccgatgagcctggaacaggcctgcaacgaagcgccacggctattgcgcgaacgcgcggcggatattgcgcgggtgtggcgcactgctgttgggcgctgatctgcttttctgtgggatttggcttgtccccgatggcggcctgacagccgaccagggggctggatcagactgagtgcatatccattcctgcggtaacggctacttagggttccgctcttacagcgggtcacttttgtaaagacacaaaagtaaccaaaaagtcttcgccccaccactcggcacctcgcctaggctcggtgtgccctcactccggcttgaatccgtgggccgccgcaatgggccatccctggcccagtgcggctaacccggcgtcctgccgggttacccacggattcaagcctgcgttcggccagcgtggttgacggggcgcctcagatcaaaatcaagatcaagatctacagcacggcggcctagtagccgacctgagtggtagaagcaaaagcacagcaacacatctttgtctgatgcaatgcgatccaaatgtgggagcaactgtcttgatggcttttttccaagctgctgttccagagatgacagtgcccccacagcagtac

SEQ ID NO: 86 - DNA, 16537 bp, Pseudomonas poae FL10F
aagcacgccgatgattcagggggcagtgaagatcaactgtgggagctgtcgagctttagcgaggctgcgaaggcggcggcactgttgggagagtggtcgcctgacccaccgctttcgcagcctcgccaaggctcgacagctcccacaggggactacctgtgttgattaactcgcggttagccgcttgatcattgggaaatacgccgatgattcagggggcagtgaagatcaaccgtgggagctgtgggaatgtggttaatccgacacggcatctttccccgctgccttggaccggtacagcgcttggtcggcacgggccatcagggcggccggggcttcgccaatacgacgctccaccacacccaggctgagggtcactttgaaatcgcccacggcgggtatctcagtgattttcagccgaaccctttcggccatttgcctggctgtgtccaaggtgctttttggcaggatcaccataaactcatcaccgccccagcgtgccagtaaatcaccggggcgcacgcaatcttccaggccttgcaccacctggaccagggtcctgtcgccgatgccatggccatgctggtcattgatcggcttgaagtcatcgatgtccatggccaccagggccaacggcaagcggaaacgctcagcacgctcgcattcttccagcagcactttttccagacggtaacggttggcgatgcgcgtcagggcgtcctgttcggccagcaggcggttttcattgagctgtaattgcagttgctgattgacccgtgacaattcacgggtgcgctcggccaccagcgcttccagggattggttgcgcttttgcagctgttcgatggaattcttgcggttatgaatatcgcggtgcgcgccgaccatgcgcgccaccgatccatccgggttacgggcaatcacgtagccccggtcttcgatccacaagtaggtgccgtctgctttttggcagcgatattcggcttggtaatggggcgcgcgttggctgatgtagttatcaaacacgaccatcacgcgggggtaatcctcggggtgaatcacgttctcccaggtgaacacgctgttctccagggagtggcgtgggtagccgagcatttcgtaccagccggggttgcggtagacaaaaccggtgttggcgttccaatcccagatgccgtcactgaccagctccatgacagcatgcagcatgtcggcgttgagctcggaaaaatcattacgtagcggtttattgccggagtgatcgtccatctttgcgcttccctgcgtgcgctggcttgtacagccagtcttcgttgacgccaatactccgtggctggcgctactgtacatcggggcttgcgcggtttgaatagggcggctgtgcggctttagctgggtggcgatgagccattattgcgggcgaaaaattgcgggtgagcgctggtttactccggcgccaccatccgcgtgcgaggcttcccatctgcgttgtgctggtaaatcgcctccggctggccctgctgattgaaatacacctggccaatgccagctgaattccacagccgttcacccgcctcggcatgctgcggaatatgcggcaccacttgcatgctgcggcggcgagtgaagccgttgagcggggagcgcggcgagtagagccagcgattaaggcggtcgaaccattccagcaagcgcggtggaaattcgttcttgatgccgctgctggtgatctgccagatcctggggccagcgttgcggtggcggatcagcacttcgtagacgaacgagtaatgcacatcgcccgaaaggatcacgtagttacccggcgtgcgcgagtggcggaagatgttgaggatgacctgggcggcgccgcgatgggccatccagttttcggcgtctaccagcagtgggtagccacaccaactgaacaccttctgcacggtctcgatcagcttgacaccaaagatcggcgcgggcgaaacgatgatcgccgaagggtggtcgagcagttcctgttgcagctcgctcaaggcttcccagtccagcaggccggagggttgcttgagcgcgaactcactgcgccagcgccgggtgcgggtgtcgagcaccaccagggcgggcgtggtgggcaatacgtaatgccaacgctggaacttcaacagcgcttccagcaggtcatcgtgcgcacacgcttgcagatggtcgtcttgcacgtgggcggtcagggcctgggtttggctcagcaactcgccaaacacatccggttggttaccccaaccctggcacagcatgtacgccagcagcgcattaccgatgatgcgcttggaaaacggatggccgtaggcggtttcttcccattgggcgctgaggttccagtcatcggtgatgtcgtgatcgtcgaagatcatcagcgtcgaaaggtgagcaaagactcgtgcaacgcctggcaggccgtcacggaatttatcgatgtgcacctgctcgcgggcatagcgctggtgttcctcggcgctcagttgcggcacctgcggtgcgatcagcgtccagggcgtcggcgaccacgccagcatgtacatcgcgattacttcggcaaaggtcaccaagtgattgtcggcggtgctgctggtgaaaatcggctttttcacgccaccaaaaaaccgctcgcgcagcgtctcgttgctgtccagcgcggggagcaggtcggcgcgatggtaatagctggcgcgatgctcgtagaggctggcgctgtcatccaccaccgcgccttcgaggtattcgtcaaacaggcccaatcgggcgatcagcgcatgaatggcgcgcagcatcggcccggcgacatcgtcggcgtagatctggtcgccactcatcatcagcaaggctgggcgttcggttggcgtgtgggcctcggccagcaggcggtcgacgcacagcaggccttcgtcggcgcggtgatggggcttgcggcaggagccgtgcaccaactggcggatgcggctgtgcagcacgaaattgggtggctggttttcggcatacagcaggtgtggcgcccactcggcaatgccgatgttgtcgatcagcaggtcatagccgatcgccacgtccaacggcagggcgtcgtccagttgtacgtcgatcaggtggatgaacgcatggcgcccaacgggcacgacctggcaatgcgttgtgtccagatcaatcgtgcgcgtttcgccctggggaataatcagcttcaaggacaacgccaggacacggctgcccaccagccagatcaccaggcgccggggttccaggcgacgtagcagtgggccggtaatgacagcgggcagtgtgtcgggttgcggcatgaagcaagcagctcacagaggatagaactgaaagcctagcgcagcggatgtcagtgttttgttaacaggccatccgccggcgcttgcggcgttaagtcagccggccttgcccgagggaatccagggacgagttattttttgactgagattgggcgttttgctgcagtgggtcgctgacgtcattcgcaggtttttcctgaggcttggcgggcggctcgacgggctgtatggcatggttgatgttatgggtgtggaatgggctaccgatgatcatgggaaaacctcttgctcaattgaaggagtgttctcgcatcaatattccctttgattacgcatcgtttcagtggcattggccgggtttacgttcccggccataggtatccgcatgtttggattgtaggatcagagcgtgtttcaggcaggctttggcaccgtaaacctgaactcactgcctcggcccacttcactttcagcttctatccgcccgccgtgggcctgcacgatcccttgcgtgatgtacaaacccaacccgctgccagtggggttgttctcggtctgcgtccagtagcggtcaaacacatgcggcaactgttcaggcgcaataccctcgccggaatcgcgcaccgagaacacgatctcttcgccattgctcatggcgctgatgccgatgttgccctggcgcggggtgaacttgatggcattgccgatcaggttcgacaacacctggaacaggcgctccgggtcggcgtgaatctgcaggccgggctcggtgttgaacgacaggtcgatgcctttctccatcgccagtggcgcgagcagggaataggcctcctcgaacatctggctgacgtccagcgctaccggtttgaccacataacgcccggcctcgattttcgaggtgtcgagcaagtcttccagcagcacgttcatgcgcccggcagcttgctgcatggtgtcgatggccgaggaaatccgccgcgaggtgtgtgggccgtccgagctgaaagccttttgcatcatgccgcagagcatcgagataaccgtcatcgggttgcgcaaatcgtgggacaccaccgccaccagctcatcacgcgcacgcacggcttgctgctcgcgcaacacttggcgggccaggtcgttttccagggcggagcggcgcaggtcgttggcggcgaacaaatcgccatggctccacttggtggagataccggccatttccactttccagatttcaaacgaggtgcgcgggcgcaggcgtaaaccggcgtcggaggtttccaggttcaggggtttgttcgggtcgccgctccagttgatgttctctttcacttccgggcgaaaccacagcacaccgttatccacaggcttaggcaggctcatggccaacacgccactggcgacttgctggaactcggcggcgggcgggtacaccgccaccaggttgtggctggaaaacaccggttcgccgctggcttgcagccacttgtgcagcgcccgaatctgctccggttgcgggcagttgccgtaacggtgcagctgtttgtcttcaatgatcgccacgccgcccgacagggtcaggtccatcagcacttgcggctgctgggccaggccgtcgaacacgttttgctcagaggctttcatcgcgcgatcaagcagggccagggcctcgactttttcttcgcgctgacggctgaggtccaacgcttccatggcgctgatctgcaatgacaacacctggccgatggtttggcaggcgacacgcaggtcgttaggcaccagcagcggctcgcggttaccgcaactgatcaggccccagagcttgtcgcccgccatcaacgagatgctcatggacgacaacacgcccatgttctgcatgtactggcagtgaattggcgacacgctgcgcagcgtggcaaagctcaagtccagcggctggccggtgtccgggcgcagtttgggcagcagtggcaccggctcgtaggcggcattcgggatgatgcgcagccagttggtgcggtacagctcgcgagcctgctcggggatgtcggacgcagggaagaacagcccgttgaacagctccatggacggcgccgacgcttcggcgatcacctggccatggccttcgtcttcaaagcgatagatcagcacccggtcgtaaccggtcatggcctggatttcattcacactgatttcgtacagcgcctgcagggttttcgccgactgcaggcgttgcagcattttgcccaggtcactggtgcggccattcagggcgcgcggtttgaaatcctcaaggcgcggctcgaattccagcaccagcacgttttgatggcgatgcaacaggccttcaaactcggcgccgttgaggctgacgtgcagcggcggcgcatcaaaaaacgtgttgtgttccgccatggctcgcacggcttgggcgtgttctgcgccaatcaacgtgtgcagcggctgacccagcagtgcctggggcgcgtggccgaataacgtgtccacgttggcgctgacctggatgatgtgcaggtcaggttccgacagcgtcagcaacacaccgtggggctgaattgcgcccggaaagcgaatgggttcgtcggcacagttggcaagcagctcttcaaaatcgtcgggtttcatagcagtacctcctggctggcgagccatcgctcaaagccattgaatgtcgaacaggccgccgccacggcacgctgtttggcgtgcgcatcgagtggctggcggcccaggtagtcgagaaagtctttccagcgccgaccggtctcggcgccgtaaacattgagaaacgcgccgccgttgctcgcgtcgatgcccagccgttgggccatttcccggcgcagcagttgaccgcccaaggtggcgccttcgagcacgtacagggcgccgaggcaggcggcgggggcgtcaaaaatgggcagttcggtacagcggggcagggcactgatcgcaaggtcattcaggccgagggcgtgcaggtcgcgcagcagcgtgggcgttttcacccgcaatacggcgtcgtatccagcggcgatcaagccgctgtcgtgcagtgccgcttcgatgggcgcataaaagccgtagtacgcctggagcaagcgccgataccaatcggcatccaggtcttgcgcgaaaaacggcaggcgtttttccagcgctacatgcagtagcccggtgccggcgcgtaacgcttccagtaatgagggcgcaccaaggtcaggggcctgtgactgcattcaatgagctcgaactgtgggccttccggccatgaatgacgcgtgtaaatgggcgacgattctacacaactcattgccgtcgactgtacgcacaaggcgaaaaggctgaccgacggatcagaaaagtcgctccttgcgtaattaatgaccacggggcagcgcctcaagttcgctttaagtgatattgcggcgatatcaatgcagcgaaaagccccgctggctcagcgccgtttgcacgcactggaccaaatgttcggcactccacggtttgggcaaaaaccgcaccgaaccgcccagctgtgctgccaacttggtattgccggaagtcagcaccaccggcaccgacggccagcgatgcgccaccaccttgcttaagtcgtagccgttgagcaaacctggcatctggatatcgctgacaatcaaatccacagggtcatcgccgcgttccaggtaaatcatcccttcatccgccgaaggaaacgacgtcacttgcgccccgaaatcctccagcacatccaccattaacgagcgaataatctcgtcgtcttccagcactaaaatcgatggctgagccatgatccttactcctccatcaggggtcagtaaggtggagtggggcgcgccgggataggttcgattgaatgtttctgaggcgatggatggtcattcagagtggctgggtagcgcctctgcagggcatattgcacgatatcgacgctttccattcaaggaccggctctggacacgcagggcatcgaacaaggccgtcaatcatgaacgctcctgccgcgctgctgctcgacccaaacctgggcaaccgcatgattaaagtcgaccacgccggcgagcatggcgcgatctgtatctacagcggccaactgttcatggcgcggttgtttgccccgagcatggtcgccgaactgaaggagttcttgtcccacgaacgccgccatcgtgcggtgttccaggccgagttgcagcgccgtggttatcgccgttgccgcagttattggctctgcgggctgggcgggctggtgctggggttgctcaccgggctttgcgggcgcaaggctattgtcgccaccacggttgcggttgaaagcgtggtactcaagcacctggcccatcaacttcacaccttgcacgacatcgacccgttggcggtggcggcgattgcttccatcgtcgaagaagaacagcaccaccatgaccactcggccgcgcaaattgatgtgcgtgacccttggttcagggcgctcacgccggtggtcacggcgtggaccgaaacggtgatctggatgggcatgcgctcctgacaaacaggcataatcgccgcaacacctgccgtggagcccgccatgaagtacgccttactgaccctcgccctaatcctcaacaccgccccggccttcgcggcgggcgatgccgaggcgggcggcaagctcttcagcaagacctgcggcggttgccacagcatcggcgaaggcgcgcgcggcggcttcggcccacagcttaacggcatcatcggccgccccgccggcaccaccacggattaccagtactccgacgcgatgaaaaactccggcgtggtctggacccgcgacaaactcgccgcctatatagaggcgccgaagaaagtggtcagcggcacgcgcatgatcttctggggcatcagtgatcaggaaaaaattgaaaacatcctggcctacctcgaaaccttccagcccaaatgatcattcgcgcacgtttttaaacagcatcaaccgcgcactctcatgcagcccgcgcgtcagcccctgcaggcgttgaaactcttcggggtactgctcggccacatcgtcgcgcggcgttggcgaggccaggtcatgcagggtcggcgagctgccgtcgtgttgcatctgcagcaggaagtccttggtcacgccgccgataatcgggaacgtgccttcgtgcagcaccagcggcaccacgcgttcaccttccggcgccggctgctggatgtcgcggcccatcgcgccattgcgaaacggtacacccgccatgccagccacggtcggtagcaaatccgccaggcccaccgcttcttcaatcactcgcggttgcaggcccggcgcgtggatcagcatcggcacattattgctttccaggcccagttgctcgaaggccggtgccatgtgcggtatctggctgatccgcgtgttgtggtcgccgaagaacacgaaaagggtgttgtcgtaccagccaccggccttggcgatgtccatcaggcggccgatgttgaagtccagcaggcgcaccgcgttgtattgctcgacactgcgcgaaccggcggcctgggcttgttccagggttacgttgcttaattcaaacccgtcgttgtgcttggggatggtaaacgggcggtggttgccggaagtttgcacgtaggcgaagaacggttggtccttgggcaccgcgcgcagcaattggtcgccttccttgaacaggtccaggtcggagatgccccacacatccacccgtggcgagcgccagtggctttcgtcaaacagctgcacgccgtcgatgctttgacggatcagcgcattgatgttcgcccagccggcattgccgttgatcatgtagaacttctgatagccctcgaaggcattgatcaacgtgtgttgccgggtgatcagcgggttgcgtgtggcggtctcctggcgggtgacatcgggcacgccggtgatgctcgcccacacggttttggcggtgccggtgacaggcacgtaaaactgtttgaagaaccagctttgcgtcgccagtttgtccaggttcggcgtggggttcagcgggttgccataggcgccgacggcgctggtgccgagggattcgagcatcacgaagaccacgttcggcgggcgctcgccttgcaggcgatagggctgcacgccttgctcgcgggtgaagttcagtcgctggggatcgggttggtcaacgcccaaatactcggcaacttgcgagtaatgctcgcgcaccttggcttcatcgaattgcgattggccgaccttgagcgtgtcgtacaaaaacagcaccgggttcaggcccacggcggcgacctggctgttgccggaaaagaacgcatcgctccagcgcagcggcaccggattttccaggttgaggttggccacgcggccgagcagcgccagcagcacggcgacaacgccgaccatggtcacagaagccaccgcccatttgccgatgggtttggcttcgcggtccagggtcaatcgttccaggcacaccaatgcccaaacccacagggccacggctgccagccaacaggcagttatccacagcaccgggtaggtttcccacaccatctgctgagaaatctgcgcgtcttgcaggtagcgcaataccgtcgcgttgatgcgcacaccgaggtaggcgtagtggccgaagtcgatgatgtacaccaggccgaccacggccagtgccaccaccagatagccgcgcgccaaccagcgcagggcgggcgaggtggtgaggttccagcgcgggaaccaggccagcagcgccagcggcagcaggatcaacaccgccaggcgcaaatcgaaacgcaagccgatgcccagggtttccagcagcgccggcgtgttcaaatccagaccggaaaagctgattaaaaacaccagccgcagcgcggccagcaacacaaacaccaacccaatcgcgcccacgccgtagcgcaggcggcgtgattgcaacacacccatcattgacctctactcaatctcacaaacaccaccaagccaatgtgggagcgggcttgcccgcgaaagcgctggttcagtgccagatgtgttgcctgacccaccgcattcgcgagcaagcccgctcccacagtttgagttgcatgcatccagtagccagcggatctccccgccaacattgacctctactcaatctcacaaacaccaccaagccaatgtgggagcgggcttgcccgcgaaagcgctggttcagtgcctgatgtgctgcctgacccaccgcattcgcgggcaagcccgctcccacagtttgagttgcattcatccagtagccagcggatcgccccgccaacattgatctctactcaatctcacaaacaccccaaagccaatgtgggagcgggcttgcccgcgaaagcgctggttcagtgccacatgtgttgcctgacccagcgcattcgcgggcaagctcgctcccacagtttgagttgcgtttatccagtggcgagcgtgtctgatcgcgccatccttgatctctactcaatctcacaagcaccccaaagccaatgtgggagcgggcttgcccgcgaaagcgctggttcagtgccagatgtgttgcctgacccgccgcattcgcgagcaagcccgctcccacaggttgagttgcattaatccagcgatgacgcagtagcccgtcaagagcggatccacgaggtaatcccaatagttttccgaagccttcagccgcagggcgaacgccaaggtgcccagcgccagcatccacactgccagcgcattacgcagccacagcatcaacaaggccgccgcgcccaccagcacaatcatcggccgagggttaaagccccagcggtaggggtcgtaataggtcaggcccatcgtggccgggtacaacaacaggctcagcacgccgaacagcaccagcacttgcacctgctgtggacgaccaagcggctgcaccacccccaatcgacacaggcttacccacgccaacaacaccaacgtgctgatcgccaagtcatcggtaaagctgcgcacatacgccgccagggacagttcattcaccgggataaaactcagcaccaccagcagcggcagcaaccacgggcgccacggcgcggtaaaccgaaaaatgctaaagagcacaaaccccagcagcacaaaactcaaatgggcctgccacacagaaaccatcacagatgctccgccagccaggcttcgttgaagctgacatgtttaataaacgtgttattccacgagtacaccaagtggtacgtgccgtccgggctgcggctgaaatacgggtattcgtactcaaaatcgcagccacgtggtttgcacacgcggtagtccaggttgctcaagaagcgttgttccagcggcaggcgtttggcaccgctggaagcgcggaagccttcgccgatgatttctttgtaggcctcgtgagagaagggctggccgagcgggtcgggcgattggtccagctcgatcaccgtgcgccattggctgaactgcgcgttggtgccgtagaggctgagcttgaagcgcccgtcctgcaggtcgttgagggcgaccaacaaaccgtcgtcctcggtggccactgccgccaacgatgaattggggttggccggctccaacgggtacggctcgctccaggttcgcccggcatcttcggtgcggctggcgagcacgcggtgatgggtttcgccggcgtagcgcaacatcgccacggcgcgctggccgtcctgcggcacgatggtcggttgcagcgaatgcttgccacgactgatgcggaatttgtcgattaccgcgccgtccgcgctcaagtacaggtactcggcaaacttgcccatgaactcgtggtacaccggcagaccgatggagccatcggcatgaaacaccggcgcggcacgcaccaaagtgctgatgttgaagaacggcgaggtgaccaattgccgaggcgccgaccagttcacgccgaggtcatcggagaccatcacgttgatcgcactggtggcccaaccgccgaccgacaccgacacataaaacatccacagacgcttgtccggccccagcgcaatcaccgggttaccgagtttgcgaatgtaacgctgggtgccgtcgcgggtgctttcccgcgtggccagtacgtgttcggcgccccattcaccactgcgtgcatcaaagcgcgcggtgcgcacctgcacgtccgcagcgccttcgcggctgcccgcaaaccacacggccatcaagtcgccgccgggtagcgcggtgacggaagatgagtgcacaaagtcagtcagttgcgaagacacgaagcggctggtgtattgcggtgccgtcgcgaccttcgagggtggcgggctcgcctgggcaaacggcgccagcacatggggcggatggctcagccaggcggcgatgaataccccgagcaggctgcagatcagtagggcggagcgcatagagaacctgtcagagaaaaggattactgcgcacgctcatccggcaggcgcttcctgcgaccggtgagcatggataacggcaggttgtccttgacctggatactttcaaacacggcggccagtacatgcacacagaccagacccagcagcacattggcggcggtttcgtggacttgcagcggccagtcggcgccccataacgcgtcgacttcctgcatcaggaagccgctgatgccgagggtcagcagcgccgacaacatcaacagcatcaccaacgcgccgatgggcgaatggccgaggcgatgcagcgcttgcccgctgaacaccgtacgcacatgcgcgccgagacgcgcaggcgtcggccagaaatccgaccaacgcgcgctgcgcggtccgacaaaaccccacgccgctcgcaccagcagccaggccatggcgtaatagcccagccacacatgccagtcgtcgccggcttcgttgaagaagtagttggcgataaagactccggcgatcgacagatgaaacagcctgaccaacgggtcccacaggcgcagggtttcgcctggcatcagcccttgatctcagtcttcacggctttgccggtcaccgggtcgtggtagatctcgaccttgcgcttgtccttgtcgaagccatagatttcgtagcagttgccgtcggtgaccttgaacttgctgatctcatacccttcggccttgagcttgtcctggaaggctttttcgtcttgccactgcgagcgctcggcggtggtgcactgcgggccggcgagtgccatggggctggcgataatcaaagacagcaggagaattttgcgcatggaaaagctctcagcaggtgtgggagatttcacagtgcaaaaccaaccttagcgcaaccttagttggcaacgcgccgtaacatctttactggaatagcccacactggaacccggcatgatgccgccgtttcctacagagattctgctatgcgcctactcctcgtcgaagatgatcgtgccctcggccagggcattcgcgtggcattgggtgccgaaggctacacgctggattggctgcacgatggcctcagcgccttgcacgccctgcgtactgaaaacttcgatttgctgctgctcgacctcggcctgccacgcctcgacggcctcgacctgctgcagcaactgcgcgccgggcagcacgacctgccggtgctgatcctcactgcccgcgatggcaccgccgagcgcatcgccggcctggatgctggcgccgacgactacctgatcaaacccttcgacgtcgaagaactcaaagcccgcgtgcgcgccttgctgcgccgcagccagggccgcgcgcaaccgatgctggaacacgccggcgtcagcctcgacccggccacccagcaagtgcgctaccaggatgaagacatcatcgtcacgccgatggaataccagctgctgcaccaactgatggtgcgccccggcaaagtcgtgacccgcgagcgcctggcccgcgcgctgtatggctggcaggatcgggtggagagcaacaccttggaagtgttgatccacaacctgcgcaagaagttatccaccgagctgatccgcaccgtgcgcggcgtcggctacgtgctggcgcttaaaccatgagctcggtgcgcgcgcgcatcctcattccggtgctggtgttgattttgctcggcgacgcgctgatcagttggctcgtactgcgtgacagccaccatgagatcgaagaagtctacgatgcccaactcgcccaaagtgcgcgcctgctgcaaggcgtactgcgccagcgcgaccccggcgaagcggattgggaccgcctgtatcaagcgttcgaccacgccatgagccgcgtcggtgaagacggcgtcgcccacccgtatgaaacacgcctgaccttccaagtatggcgcagcgacggcgagttgttggtgcgctccgccgaagcacccgtactgacggcaccgccgaccacccttggcgcccacgacattatcgacaacggcaacgactggtgcgccttcctcctcgccgacccgcaacagggtttgctgatttgggtggccgagcgcgatgacattcgccaggacctgatcgagcgcatcgtgcgccacaccctctggcccaccctgatcggcgtgccgctgctggccgtgctgatctggctgaccatcggctgggggctcaaaccgttacgcgcgatggtgctgtcgattcgcgggcgcaataccgacaccttgcaaccgctgcacctcaagccgctgccgagtgacttggaacccatgcaaactgcgctgaaccggctgttggtacagatggatgacctgctcgagcgcgaacgccgctttatcgcggatgcagcgcatgaattgcgcacgccgctggcgatcctgcgcattcacgcgcaaaacgcccaaagcgccgccactgaagagcaacggcgcgaagccttggattttctggtgagtggcgtggaccgcgcgacgcggattggcagccaattgctgaccatggcgcgcatcgagccgcaactgaacaaccccgtgtgcaagcctgtgcaactgacggaactggtacgcgaagaactcgctgagctgacgccgctggcgatggaaaagggcgtggagctggtgttggaaggccaagagcaatgttgggtgcaaaccgagccggtagccttggcgattgcgttgcagaacctggtgaccaatgcgctcaacttttccccagccggcagtgaagtacgggtggtgattggtgccgattacttgagcgtggaagaccaaggcccgggcattgatgaggcggagcttggccgtttgttcgagcggttttacagccgcgacaacgccaatggcgcggggttggggttggcgattgtggacatgatcgtaggcaagatcggctgccggttgacgctgcacaacctggagcgaggcgggttatgcgcgcgtttggtattcaaccaagcctgaagcgccccggctcaactgtgggagttgtcgagccccagcgaggcgacgatggtatcacttcggtacacctgcccaacccaagcgcccgcatcgctgctccgttacacaacattcgtttaaactccgctccagccatcaaacccaccctcgataaggacatctcccgtgaagcgaatcgcgctgctttctctcgccttggccctgtgcgcctgccaatccaaccagcgcgactcatcgcccaccttgctcaaggacggcatccaactgcgccaaaaaaccgtggccgtggatgcagaccacgccaaagtcgtgatgaaagcctacggcggcaccgcccccgtggaattcgcggtgcgccgcgaaggcgacgccgaccaacgcatggaaaccctcggcaccgtgatggacaccggcgaaggccgggttttcaactggatcgccaaactcaaccagacggtcgccagtgccgggttcaagcgttttccacagttggaaattcaggccgatccaggcaagaagttgaccgtatccagcaccgccagagcctcgcgaccgggtatttactcagtttgcgggccggtgttcagcaacttcgtgccggagcgggcgaaggtgtatctggtggagtttcagttcaaaggggataggtgtgtgcagcaggtatttgatgtgacggatccggcgaatccggtggtggttgagggggcggggagtga

SEQ ID NO: 87 - DNA, 16057 bp, Pseudomonas poae FL10F
ttgatgaaaggacaaaccgaataccaaccgaagattggttgagggttgcccctcaaccatagaatctcccacatttgatctctgtttgtcttctagcgccgtgcgatatccgaaaagtaaaacttatccagcgtatgccgcgactcggtgtattcgaactgccgcccgtcctgcaaaaacgtctggttgctcaccacgatcacatggctctgaccttcgaggtccagatgggtctgatcgtccttgctgcgcggcagtgcctcgatggtgcgttgcgcgtagctgatctgcagctgcaacgtctgttcgataaacgcgtagatcgactgttcggcgatgtcacggtccaggcctgggatcaggtcggcaacgaagtggttgatgtcgagaatcacccgtttgccgccgatgcgccgtacccgttttatccgcgtgatcagggtgccgggttcggcttcgacgtgttgcagcagtgaaccttccagtgggaattggctgaactcgacgacttcggtgcgtacgtcatcgcccaaatcggcgtgggtttcgtggaagctgacgatgccgcccagttggaactcgatggggtttggcgacaacacaaaggtgcccttgccgtggattttttgtgcaaagccacgttcctgcaactgctcaatggcccgacgcacggtgccacggctggcctggtaggcgtccatcagttcggtttcggagggaaggcgcgtgccgcgttgcaggcgttcagtggtgatgctggcaagcagatccgtatagatctggttgtatttgctcatggtttggctctatgcccgacgtaatgaaggtgaacggcgcgttcaaggcaggaaccttagtggcagaggggaggtttgtccattcgaccccagtggaagaaaaggaaatgcctgactcaaaattcagaaatataaacaatttgtgactcgtacagacgagttgttgatttaactcgtacagacgagtacttttggcctcggcgtgctgccaatgactgcccccaaataaaaaaatcaaagtggaaaccaagcatgagccacgactattcgactattgcccgcgagattctcgagaacctcgggggcagcgacaaccttgagcaagctgcccactgcgtgacccgcctgcgcctggcgctcaaggacccgagcctggtcaacagcagtgcgttgaaccaggtcgacctggtcaagggttcgttcttcaccggtggcctgttccaagtggtgatcggccccggcgaagtggaaaaggtctacgccgccttgcgcgaacagaccggccttgccgccgccaccatcgccgacgtgaagaagaagggcgccgacaagaccaacgccatgcagcgtctggtgcgggtgttctccgacgtgttcatgccgatcctgcccgcgttgatcatcgccggcctgctgatgggcataaacaacctgatgggcgccaagggcatgttcatcgagggcaagacgctgctcgaggcctacccgaacctggatggcctgtggagcctgatcaacctgatggccaacacttcgtttgtgttcctgccggcgctggtgggttggtcagcagccaagcggtttggcggcagcgaaatcctcggcatcgtgctcggcctgatgctggtgcacccggacctgctcaacgcctggaactacggcaaggccgtcgccggcctcgacggccagagcctgccgtacttcgatatcttcggctggttcaagatcgagaaagtcggttatcaggggcagatcctgccgatcctgatggcggcgtatgtgatgagcgtcatcgagaaatggctgcgggcacgtgtgcctaacgcgatccagctgctggtggtgccgatcaccaccatcgtcgtcaccggcgtgctggccctggcggtcatcggcccggtcacgcgtcacctcggtatcctgatcaccgaaggcgtggtcaccctgtttgacctggcgccgatggtcggcggggcgatattcggcctgctgtatgcgccgctggtgatcaccggcatgcaccacatgttccttgccgtcgacctgcagctgatttccacccacggcggcacgtttatctggccgatgatcgtcatgtccaacctcgcacagggcagcgccgcactgggcgtgttctacatgacccgtaatgcgcgggacaaaagcatggcgtccacctcggcgatttccgcttacttcggcatcactgaaccggcgatgttcggggtgaacctgcgcttcaagtttccgttttatgccgcgctgctgggttctgcgctgggcagcattttcctgtcgttgaacaaggtgaccgcctcggccatcggcgtcggtggtctgccggcgtttatctcaatcctgccgcagtacatcccggtttttgtgatcgggatggtcatcgcgattgtggtgccgtttgttctgacctgtgcgttgagcatgaagattgttcggcctggataccgggtcgcctgatcaatcgctatcgcaggcaagccagctcccacacttgaaatgcgctcccctgtgggagccgggcttgcccgcgatgaggcccgcacggccagtacacaatttaattgaaggaacccaccatgcaaaactggcaacaatcggtgatctaccagatctaccctaaaagcttccacagccacgcgggtaacgccaccggtgacctgcttggcatcgtggacaagctcgattacctcaaatggctgggcgtggattgcctgtggatcacgccgttcctgcgctcgccgcagcgcgacaacggctacgacatcagcgactactacgccatcgacccgagctacgggaccatggccgattgcgacctgctgatcagcgaagcggccaaacgcggcatcaagttgatgctcgacattgtggtcaaccacacctccatcgaacatgagtggttccagcaggcgcgcagcagcctcgacaacccgtaccgtgacttctacatctggcgcgaccagccgaacaactgggaatccaagttcggcggctccgcctgggaatacgaagcgcaaaccggccagtacttcctgcacctgttcgaccacacccaggccgacctgaattgggacaaccccaaggtgcgcgccgaggtgttcaagctgatgcgcttttggcgcgacaaaggcgtgggcggtttccgcctggacgtgatcaacctgatctccaagcctgccgatttccccgaggacaacactgacggtcgtcgcttctacaccgacggcccgaacgtgcacgaatacctgcagcaaatgcaccgcgaagtcttcgaagggtatgacctgatcaacgtcggcgaaatgtcgtccaccagcctggagcactgcattcgctactcgaatccggcgtcgaaagagctgtcgatgaccttcaactttcatcacctcaaagtcgattacccgaacctgcagaagtgggtgaaagccgacttcgacttcctgcaactcaagcagattttctctgactggcaactgggcatgcaggccggtggcggttggaacgcgctgttctggtgtaaccacgaccagccgcgggtggtctcgcgtttcggtgacgacggcgaacaccgtgtggtctcggccaagatgctcgccaccgcgctgcactttctccagggcacgccgtatgtgtaccagggcgaagaactgggcatgaccaaccctggcttcaacaagatcgagcagtaccgcgatgtcgagactttgaacatcttccggctcaagcgtgatgccggtgagcccgaggcctcgagcatggcagcgatcatgcagaagtcgcgcgacaacggtcgcacgccgatgcagtggagccgcgaagccaatgccggcttcagcagcggcgaaccgtggatcggtattccggccaacgcggcgcagatcaacgtcgagagccaattggatgaccctgattcggtgctgcatcactaccgtgcgctgattgcgttgcgtcgccacgagccgctgatccaggagggcgtttatcgccaactgctgcaagaccatctacaggtttgggcgtacctgcgcgaagggcagggcgagcgcttgctggtgctgaacaacttctatggcacgccctgcgaaatccaactgcccgaaggcgtcatcaacgcggcgagcgagcaacgcctgctgatcagcaactaccccgactgcccattgcgttcgggcgccgtggtactgcgcccttatgaatccttcgtcctgcacctcaaggactgaatcacttcccttgtaggcgtcggcaagccgattcctacaaggggcgcgtcacgtaaaaacaataataaaaatatttggagtgcttcatgaaaacaacaataaagctgggcctcattgcctcatgtcttactgcaccttttggcgctcaggcgctggagtttgccggttacttgcgcagcggcgcgggcacttcaacgggcagtggcaagcagcaatgcttccaactgccgggggcgcaaacgaagtaccgtttgggtaacgaatgcgagcaatacgccgaactggaattgcgccaggacctgctgacactcgacgacggctcggtgctcagcgtcgatgcgatggcatcgctgtataacaagtacgaccgcgccctgaagttccagggcgaagacaacggctcggcacgcatgccgcagatgtatgcgcagtggtccaacctgcccagcctcaatggcggctcgctgtgggcgggtcggcgttactacaaacgtaacgacatccatatttccgacttctactactggaaccagagcgccaccggcggtggtgtcgaggacgtgaaaatcggcgacctcaagtacagctacgccctgtcgcgcaaggacaacctgtaccagaaggaatacgccacccgtcacgacttcaacgttgcgggcttcaagaccaaccccggcggtgagctggagttcggcctgagctatatcgaaaaagccggcggccgcgacgccaacagcgggtgggcgatcacggcgcagcatgtgcaaaaaccgtttctgggcggcaaaaacaaattcgccttgcagtacggcgaaggccccggcactggcctgggctacaccggtaatacagccctggataacagcagcaaaagctaccgcgccgtggagtttttcgactggcaggtgaccccgcgtttcggcgggcaggtcgaggcggtgtaccagaaagacattcgcccaggcagccaggaccagacctggatgtccatcggcgtgcgcccggcctatgccatcagcgagcagttcaagctggtcaccgaacttgggcatgatcaagtcgacgctgctggcggaacacgcaagctgagcaaatttaccttcgccccgacctggtcgcccaacggcccggatttctgggcgcggccggaagtgcgtttgtactacacctacgcaacctggaacgaggcggccaaacgcgcggcgaatgaactggcggcgggctcggcgttgtccgacaccggcgcctacggcaccgcgcggcatgggtcgaatgtgggtgtgcaggtcgaatactggtggaaatagctcggatttaagtgaacgagctttatgtgggagctggcttgcctgcgatagcaacacctcggtcttactgagaaaccgagtcgccggcatcgcaggcaagccagctcccacatttgatcgtcgttcgccctatgatttttacagaacaaaacagcaggtgaagtcatgaccacaactcaacccctggaactgctggcgccgctgtccggtgtgctgctggcgctggatcaggtgcccgacccggtgttcgccagtcgcgtgatcggcgacggcctgtgcatcgatcccacctcgcagacgctttgcgcgccgctggccggggtgatcagcagcatccaggacagtggtcatgcggtcagcgttaccgatgacaacggcgtccaggtgttgatgcatatcggcctagacaccgtaaacctggcaggccaaggcttcacgccgctggtaaaggaaggccagcgcgtggcggtcgggcagccgctgattgaattcgatgccgactacgtggcgctccatgcacgcagtttgctgaccttgatgctggtggtcagcggcgagccgtttacgctgctgacgccggacggtggcgtggtggatgtgggccagccgctgttgcgagtcgcaacaggcgaagcagctgaaacggcgaatgaggaggagggcgaagcgctgttttccaagccgcttaccctgcccaacgccaacggtttgcacgcgcgccctgcggcggtgtttgcccaggcggccaagggtttcaacgcaagcatttacctgcacaagcaaacccagagcgccaacgccaagtcgctggtggcgatcatggcgctgcaaaccgtgcagggcgatacgctgcaagtgagcgcggccggtgatgacgccgacgcggcgatcaacgccttggtggcgttgctggccgaaggctgtggcgagacggtcgcggcagttgctgcggtggcggaaccggtcgcgccgctgtcgtcggccagcttgctgcgcggcgtgtgtgcttcccctggttcggcgtttggccaggtggtgcaagtggccgagccagcgttgaagattaccgaagccggcgctggcgaagcgatcgagcgtgccgcactggagcgtggcctgctggcggcaaccgaggcactgcaagccctgcaagccaaggcgactggcactgcccaggccgagatcttccgtgcccatcaagaactgctcgaagaccccaccttgcttgaacaagcccacgcccaactggccaatggcaaaagcgctgcctttgcctggaaccgcgccacggtggccaccgccaccttgttccagggcatgggcaacgcgctgctcgccgaacgggcggcggacttggccgacgtcggccaacgcgtgctcaagctgatcctcggtatcgaggaccgcgcctgggacttgcccgagcaagccatcctgattgccgagcaactgactccatcgcaaaccgccagcctggacacgcgcaaggtgctggggtttgtcaccgtcggtggcggtgcgaccagccatgtcgcgatcctcgcccgcgcactcggcctgccggcgatttgcggtgtgccggtgcacgtgctgaccctggctaacggcaagcaggtgctgctcgacgccgataagggcgagctgcacctggacccggacctggccgaaatcgagcaactgcaagctgcccgccaacagcaggtgttgcggcgccagcgggaagtggcgcaggctgctttgccggccatcacccgcgacagccaccacctcgaggtcacggccaacgtcgcctcgttgcaggaggtggagcagtccttgagcttgggcggtgaaggcgtcggcctgctgcgttcggagttcctctacctggaccgcaaccgcgcgcccagccctgaagaacaagccggcacctacagcgccatcgctcgcgccctgggcaccgagcgcaatttggtggtgcgcaccttggacgtcggcggcgacaagccgctggcctatgtgccgatggaaagcgagaccaacccgtttctcggcttgcgcggcattcgcctgtgcctggagcgcccggaactgttgcgcgaacagttccgcgcgatcctcgccagcgccggtttcgcgcggctgcatatcatgttgccgatggtcagcctgttgtcggaactgcacctggcccgcacgattcttgaagaggaagcgctggcgctggggctcaaggaactgccgaagttggggatcatgatcgaggtgccgtctgcggccttgatggccgatgtcttcgccccgcacgtggattttttctccatcggcaccaatgacctgacccaatacaccctggccatggaccgcgaccacccacgcctggccagccaggccgacagctttcacccctcggtgttgcgtctgattgccaccaccgtcaaggccgcgcacgcccatggaaaatgggtcggtgtgtgcggcgcgctagcgtccgaagcgctggcggtgccggtgttgatcggtctcggcgtggatgagttgtcagtcagcgtaccgctgatcccgaccatcaaggccaccgtgcgcgagctggacctggcggactgccaaagcatcgctcgccaagtactcggcctggaagaagcagcccaggttcgcgaggccttgcgtctgtatcacgcggccacggttgaaacctcacctgttgtggagcactgagcatgttcgagaaattacagcgcgcgttctggaaagccctgaccccggatttgattgccgagacggtaacggcgccgacgccgagcctgttgtcggccgatgtactgaaggcattgggtggcgcggataatctcaagtcacaacagcgcgtggcgctgacgcgggtgcgggtgcaactgcaggatgcggggcggttggatgcgcaggcgctgaaagcggcgggtgtgccaggggtgatggtgttgacgggcggcgtggtgcacctgctcaccggcctttaagccaatcgcagatcaaaatgtgggagcgggcttgcccgcgatagcggtatgtcaggtaacgaataggttgactggccggccgccatcgcgggcaagcccggctcccacagggttatgtgttgtgggggagattggggttacagctgcgggttatcttccggcggcttggtcttatccacacccggcacatgcaagttgccttcgaccacctgattgccttccaactgcggctgcgtgacccaagtcagaatgtcgtaatagcgccggatgttcgccacaaaatgcaccggctcgccgccgcgtgcataaccgtagcgagtcttgctgtaccactgcttctgcgacaggcgcggcagcattttcttcacgtccagccacttgttggggttcaggccgtccttcttcgccagcgtgcgggcgtcttccaggtggccggtgccgacgttataggccgcgagggcgaaccaggtgcggtccggctcggcgatgctgtcgtccagctcatccttgattttggccaggtatttggcgccgcccatgatgctttgcttggcgtccaggcggttggacacgcccatcgcctgggcggtgttctgggtcagcatcatcaggccacgcacgccggtcttggaggtgacggccggttgccacagcgactcctgataaccgatggcggcgagcaggcgccaatcgactttttcttccttggcgtaggtccggaagtgcttctcgtatttgggcaagcgttgctgcaagtgctgggcaaaggtgtaggcgccgacgtagccgagtacatcgacatgcccgtaatagcggtctttaagacgctgcagggtgccgttcttttcaactttgtccaggtagctgttgatttcgttgagcaggctgttgtcatcacccgccgccacggcccagctctgattgctggcattgccgaggtcgaacgccacgcgcacgttggggaagtacacctggttcatcgcgacttcgttggagtccaccagggtcaggtcgatttgcccctcgtcgaccatgcgcagtaagtcgaccacctcaacggcgtcggattcttcgtattcaatcgcagggttctgctttttaagcgccgccagttgctcggcgtgggtgctgcccttgagcaccatgatctttttgcccaccaggtctgccgccgtggtcgggcgggactggccgttgcggtagatgatctgcggcgtcacttccaggtaaggatgggaaaaacgcacctgttgcgcgcgctgctcgctgctgaccaggcccgcggcggccaataccggaccgttgggtttgcccaactggccgaacaggtcatcgaggttgtcggcggtctctatctccagctttacccccaggtcatcggcaaaacgcttgaccagttcgtactcgaaaccggtttcaccgttgcggtcctggaaataagtcgccgggctgtttcgggtaatcacccgcaatacgccatcctccttgattcgctcgagcgtgctgggcttatcaacacaggcgctgagcatcaggaagagtccggttgcgatgagccatttggcacatcgcgggcgcaaagcagtaggggagaacatctgcgcagtatacgcaaacgacccacggcgccatatatcgacagcgggggacttgtctgctagcacccctgaaactgggctgtagcccgcagaaacgcgggttagcgagggtttgtgacggttaaaataactgcgcgcaacccggtgaaaaacgccccgatactgtgcaaagcgtgccaactgacgttcggcaacggccagccgtgccgtttcgggtgccgttggcggcggtttacgctagaatgcacggcctcaaagcacacccccttcccgaggctgtcccgaagatgttgatcctgcgcggcgctcctgccctttctgcctttcgccacagcaaactccttgagcaactgagccaaaaggttccagcggttacaggcttgtatgctgaatttgctcacttcgccgacgttaccggcgtattgaccgccgacgaacagcaagtgctggcacgccttctgaagtacggcccaagcgttcccgttcaagagcctaatggccgcttgttcctggttctgccacggttcggcaccatctcgccctggtcgagcaaggccagtgatatcgcgcgcaactgtggcctggaaaaaatccagcgcctggagcgcggtatcgctttctacgtcgccggccagttcagcgatgccgatgccgagctgatcgccagcagcctgcacgaccgcatgacccagatcatcgtcagccagctggaacaggctgccggtctgttcagccatgccgagccaaaaccgctgaccgcgattgacgtgctcggcggtggccgtgccgccctcgagaaggccaacaccgaactgggcctggccctggccgaagacgagatcgactacctggtcaacgccttcaacggcttgaagcgcaacccccacgacatcgaactgatgatgtttgcgcaggccaactccgagcactgccgtcacaagatcttcaacgccagttgggacatcgacggcgaaagccaggaaaaaagcctgttcggcatgatcaagaacacctacgtgatgcacagcgaaggcgttctttctgcttataaggacaacgcctcggtgatcgtcggctccgtcgccggccgtttcttcccggaccctgaaacccgccaatacggcgcggtgcaggagccggtgcacatcctgatgaaggttgaaacccacaaccacccgaccgcgattgccccgttccccggcgcagccaccggttccggcggcgaaatccgcgacgaaggcgccaccggccgtggcgccaagccaaaggcgggcctgaccggcttcaccgtgtccaacctgcagattccaggcttcgaacagccgtgggaagtgccgtacggcaagcctgagcgcatcgtgaccgcgctggacatcatgatcgaaggcccactgggcggcgccgcgttcaacaacgaattcggccgtccggcgctgaccggttacttccgtaccttcgagcagtccatcaccaccccgcgtggcgatgaagtgcgcggctaccacaagccaatcatgttggccggcggcatgggcaacatccgcgaagaacacgtcaagaaaggcgagatcctggtcggctccaagctgatcgtcctcggcggcccggcaatgttgatcggcctgggcggcggcgcagcttcttccatggccaccggcaccagctcggcggacctggactttgcgtccgtacagcgcgaaaacccggagatggaacgccgctgccaggaagttatcgaccgttgctggcagctgggtgacaagaacccgatcagcttcatccacgacgtcggcgccggtggtttgtccaacgccttcccggaactggtcaacgatggcgaccgtggtggccgtttcgagctgcgcaacattccaaacgacgagccgggcatggccccgcacgaaatctggagtaacgaatcccaggaacgctacgtactggccgttggccctgaagacttcgcgcgcttccaggctatctgcgaacgtgagcgttgcccgtttgcggtagtcggcgaagccactgccgagccacagctgacggtgaccgacagccacttcggcaacagcccggtcgacatgccactcgaagtgctgctgggcaaagccccgcgcatgcaccgttcggccgtgcgtgaaaccgagttgggcgatgacttcgacccaagcagcctcgacctgaccgacagcatcgaacgcgtgctgcaccacccggccgtggccagcaaaagcttcctgatcaccatcggcgaccgcactatcacggggcttgtggcccgtgaccaaatggttggcccatggcaggttccggtggctgacgttgccgtcaccgccaccagcttcgacgtctacaccggtgaagccatggccatgggcgagcgcacgccgctggccctgctggacgccccggcgtcgggccgcatggccattggtgaaaccctcaccaacatcgctgcatcgcgcatcggcaagctgtccgacatcaaactgtcggccaactggatgtccgctgccggtcaccccggtgaagacgcgcgcctgtacgacaccgtcaaggctgtcggcatggagctgtgcccggagctgggcatcaccattccggtgggcaaggactccatgtccatggccacccgttggaacgaagacggcaccgacaagagcgtcacttcgccactgtcgctgatcgtcaccggctttgcgccggttaccgacatccgccagaccctgaccccgcaactgcgcatggacaaaggcaccaccgatctgatcctgatcgacctgggccgtggccagaaccgcatgggcgcctcgatccttgcgcaaacccacggcaagctcggcaagcacgcgccggacgtggatgacgccgaagacctgaaagccttctttgccgtgatccagggcctgaacgccgacggccacctgctggcttaccacgaccgttccgacggtggtttgctgaccagcgtggtagagatggccttcgccggtcactgcggcctgaacatcgtgctcgacagcgttgccgaggatgcatccgaaatcaacggcatcctgttcaacgaagagttgggcgccgtgatccaggttcgccaggacgccaccccggacgtactcgcacagttcagcgctgctggcctggacgattgcgtggcggtgatcggccagccgatcaacaacggcgagatcaacatctcgttcaacggcgacaccgtgttttccggccagcgccgcttgctgcaacgccagtgggccgagaccagctaccagatccaacgcctgcgtgataacgccgactgcgccgaacaggaattcgacgtgatcctggaagaagacaacccgggcctgagcaccaagctcagcttcgacgtcaaccaggacatcgccgcgccttacatcaaaaaaggcattcgcccacaggttgccgtactgcgtgagcagggcgtcaacggccaggtagaaatggcggccgcgttcgaccgcgccggctttaatgcgatcgacgtgcacatgagcgacatcctcgccggtcgcgttgacctcaacgcgttcaagggccttgtcgcctgcggtggtttctcctacggtgacgtgctgggtgccggtgaaggctgggccaaatcggccctgttcaacagccgtgcccgcgacgcattccaaggcttcttcgagcgcaacgacagcttcactctgggcgtgtgcaacggttgccagatgatgtccaacctcagcgaactgatcccgggcagcgagttctggccgcactttgtgcgtaaccgttccgagcagttcgaagcccgtgtcgctatggtgcaggtgcaagagtccaactcgatcttcctgcaaggcatggccggttcgcgcatgccaatcgccatcgcccacggtgaaggccatgccgagttcgaaagcgaagaagccctgctcgaagccgacctgtccggctgcgtggccatgcgtttcgtcgacaaccacggcaaggtcaccgaaagctacccggccaacccgaacggctcgccgcgcgggattaccggccttaccagccgcgacggtcgtgtgaccatcatgatgccgcacccggagcgtgtgttccgcgccgtgcagaactcgtggcgcccggaagagtggaacgaagacggcgcctggatgcgcatgttccgcaacgcgcgcgtgtgggtgaactaaggcggtgtacaagctcagcttctttgtgcccgcaagccatgtggagacggtgaaaaccgccgtcttcgccgctggcggcgggcgtatcggcaattacgacagctgcgcctggcaagtgctgggccagggccaattccgcgcattggatggcagccagccgtttctcgggcaggttggcctggttgaagtggttgaagagtggaaggttgagttggtggtggcggatgagttgatcgtggcggttgtggctgctttgaaactcagtcatccgtatgaaacaccggcatatgaagtgtggcagttggcggatttttgattcgtcggctgttaaaacaagaaacccgctgggccagtttggtcagcgggttttttgttggctgtgatggcctcttcgcgagcaagcccgctcccacatttgaccgcattgccacgtcgggcaccgatcaaactgtgggagcgggcttgctcgcgaaggcgtcgggacaggcacctcagacctttcccacaggcctttcaggttgtccctcggaactggcctgactaatcttctcgggtcgctgccaatgtggcgaccgggactgcaagcccgccaatagtttgttagtactcaacagcacacctataatcgtgccgctttcataaagcggttattgagtcatggtggctgtgtgcgggagatcctcgggtctgccggggttcctaacaactcggtcttgcaggcccgtacacagctgccacccatcatctgcaagtgatgtcggtagctcccatttttgttaggagttttaccatgctcaaagacagtccaaatcctccatctgactctcagcccgccgaccaaatcttcaccatactccccaacctgaacagcgaaaccctcctcgccaatgcctcccaagacctcgcatccgtgcaggcgttggcgggcaatctggcgtttgacatcgacggcccgcagcgtgatgcggtgctggggattcaccggatgttggaaggtatccagttgatggtggatcgggtattggatcttcacgaagtaccagcacccacctctagctgatcgttatgttggcaacaaggagccacctagatccatcctgatcaatattctgcacgattatctggagactgaagttgacgaagccttttaacgctcccgtcctctcatccgccttggatacgctggtcaaaagccctttgaatcaggctgatgatgctgctcttgtctgtgcagcaaaagcggtttggtactcggacgcgaaccttgtgggcgaggtgagggcttttctgaaggcacattccagtgaagtggagcttcgtcgcgcaggctacttgcttgagcgctttacgcgcttttcatgtgcgacggatactcgggtaatggaagcattgaaggcccttgagttattttcggcttctgccgccaagcaagaagtgaaaccacaaggcgctgttgcgctgcgaagccgtcgtgattaactcgcgctgtcttgggggttgagtgaggggctgggtttgaaggctcaagcgctgatgcctttccagacgcgccattacgaagccgagcagcgtacggcgtctgtctaggcttagatagctgatcgttcccacgctctgaactgaccccacaaagctggacgattacatgcctatgcctgaacggcctgagttctatatgcaacagggctcaggccgtttagcttcagcttgatacgcgagtgattgtaatact

SEQ ID NO: 88 - DNA, 15030 bp, Pseudomonas poae FL10F
cttcgcaggcaagccagctcccacatttgaccgagtacacgcgcctacctgatgtactgagctcaaaatgtgggagcgggcttgcgtcaaggctgccgcctcaacccctgacacgcccagaattttctgtgggagctggcttgcctgcgatagcggcggcacaggcaacagtgatgttgactgacctgtcgctatcgcaggcaagccagctcccacattggatttgcattaatcattggaaatgagagaagtccaagccggcacccgatgcaccgcatcgggcgcgaacgacttactgcggggttgggctgccaggctgcaatgccagtagcaggtcatcgatgatggccttacccatttcacccaggtaatgcgaggcgaatgcaaacttctccgccttgggatccatggcagcttcaagcgagagcatttttgcgtaataaagcacgtgggatgcgtgttcaagggcttctacgagcggaacccgggcgttgacgcggaacactttcaaatggcttttgttctctccgcagtctgcgaaggtggcggcgccgatggtttcggctgatgttgcgttagtcataactgattccttttgcatgaacaaaaagagctgccactaacgtttccaggcgaagggtggcaactgtacgcgggctggaaaccgaggcaaaaggaacccggcagacccgaaggtctcccacgtacagccgccaaaaagcacaaactgcaggcataaaaaaagcgcctgctgattgtttgacgacgctgtagcgtccttaagcatcgggtttccaggcccggtcactgatgagcagcgacggaggcgaggttaactctatgcacgcgccgtcgcaacctgtggccaatagctgtccgcaatctgcgttgtgtggcgaggaagcttggccccgcttgactgcgcagcagtcacccgcttttaggggcgcttcgcaccccagcgcaagcaagcttgctcgccacagggttattaggtgtccgcctcaggttccacccagtggaaccacctttgattgtcctcccgcccacatcgcggttagctggcgatgtgtcgcaaacaagaacgggaacacccgcctgtgaggagaatcaccatgcgcccacaccagcacattctggattggctcagcgacgtcgccagcgacttgcacgctgtgcgtcaagacatccacgcccatcccgaactcggttttgaagaaaaccgcacttcggcgctcgtcgcgcaatccttgagaaattgggggtatgacgtgcacaccggcatcggcaaaaccggtgtggtcggcgtgctgcgcaatggcagcagcccgcgtacgttgggcattcgcgccgacatggacgccttgcccatcatcgaaaacaccggcgctgcctacaccagccagcacgccggttgcatgcacgcctgtgggcatgacggccacaccaccatgctgctcggcgccgcgcgttacctggcggcgacgcggcaattcgacggtacgttgaacctgattttccaacccgccgaagaaggccagggcggcgccgaggcgatgttggcggacgggttgctcgagcgtttcccctgtgacggcttgttcgggatgcacaatatgccgggcttgccggctgggcatttgggtttgcgggtcgggccgatgatggcctcgcaagacttgctcaccgtgacgctggaaggcgtcggcggccacgggtccatgccgcatttgacggtggacccattggttgcggcggcgagtatggtcatggcgttacagacggtggtgtcgcgcaacatcgacacccaggaagccgccgtggtcacagtcggcgcgctgcaagcagggcaggccgccaatgtgattcctcagcaagccctgttgcgcctgagcctgcgcgcactgaaccccaaggtgcgcgagcagatgctggaacgagtcaacgccatcatccagacccaggccgccagcttcggctgcacggtgcacatcgaacaccgcccggcctacccggtgctggtcaaccacgccgaagaaaccgagttcgcccgccaggtcggcgtggccttgctcggcgccgaggcggtggacggcaacacccgcacgctgatgggcagtgaagacttcgcctggatgctgcaacgctgccccggcagttacctgtttatcggcaacggcgtgtcgcggccgatggtgcataaccccgcctatgacttcaacgacgacatcctgctgaccggcgccgcctattggggcgcgctggctgagagctggctcaagcctgcctgacgaccgctttttttctgccgctggacccttgcccttatcggttgaatggagtgttcctcatgcagatttcaaaacccggtgtttcgcgcacccgccaggtggtggcggcggtgatcggcaacgcgctggaatggtatgactttatcgtttacggctttctggccagcatcatcgcccggcagtttttcccctcgcaggacgagtacgcctcgctgttgatggccctggccaccttcggcgtgggctttttcatgcgcccggtgggcggcatcctgctgggtatctactccgaccgcaaaggccgcaaggcggcgatgcagttgattatccggctgatgacggtgtctatcgcgctgatcgcctttgcgcccaattacaccgccatcggcatgggcgcgccgttgctgatcgtggtggcgcgcatgcttcaaggctttgccaccggcggcgaatacgcgagtgccacggcgtttctggtggaaagtgcaccggcccatcgcaagggcttgtatggctcctggcaattggtggggcaatgcctggcggtgtttggtggtgcggcgatggtggcgctggccacgcatttctttgcgccgcacaccctcgacctgtggggctggcgtgtgccctttgtgctgggtttgctgatcggcccggtagggctgtggattcgtcggcacatggaagacccggaagaattcatccaggcgcgcaaacaggccaccggcccggcgccgagtttgatggacgtgctgcgtgagcatcgacgcagcatcctggtgtcgatgggcctggcttgcggcgcgacggtgtcgttctacgtggtgctggtgaacatgccgaccttctcccacaaaagcctcggcctgccgctggaccaggtgctgatggtgcagatgtttgcagtggcgctgatgaccgtggtgattccgctgtccggcctgctctcggatcgcctcgggcggcgcccggtgttgatggctttcaccctggccttcttcgtgatggtctacccgttgtatgtgtgggtggccgctgcgccgtccatcgagcgtttactggtgatgcaagtgctgctctgcacggccatcggcggcttttttggcccggcgccgacggccttggccgagcagtttcctatcgaggtgcgctcgaccggcgtgtcggtggcctataacgtggcagtgatggtgttcggcggctttgcgccgttgatcgtgacctggctgaccaaagtgctgggcacgccagtggcgccatcgttttacgtgctgttcgcttgcgtactgacgctgttgggcacttactgcatgcaggaggcaccgcgggcgaataggtcgctgccgttttcaagtgaggtgaagccttgagcattgttgagtgggacgcgactgagctgtcgcgggcgattcatgcgcggcatgtgtcgtgtgaagacgtgatgcacgcgtacctggcgcagatccagcgctttaacccgcgcgtgaatgcgctggtgtcgttgcgcgacgccgacgacgtgctggccgaggcgcgggcctgtgatcgcgaactggccctgggccaatcgcgcggctggatgcacggcatgccccaggcgatcaaggacctggccgccaccaagagcttgcgcaccaccttgggttcgccgttgtttgccgagcatgtacccagcgaagatgccatcagcgtggcgcgggtgcgggccagcggcgcgatcattatcggcaagaccaacgtgccggagttcggcctcggctcgcagacctacaacaccctgttcggcaccaccggcaatgcctatgacccacgcatggtggcgggcggcagcagtggcggggcggcggtggccctggcgctgcgcatgctgccggtggccgatggcagcgacatgatgggctcgctgcgcaacccggccgcgttcaacaatgtgtttggcctgcgcccgtcgcaagggcgcgtgccgcacgggccgatgccggaagtgttcgtgcagcaactgggcaccgaaggcccgatgggccgcagtgtgaccgatgtggcgcggttgctgagcatccaggccggttacgacccgcgggtgccgttgtcatccaaagacgacccgacggtgttcggcgaacccttgcagcccgacttcaaaggcgcgcgcctgggttggctgggggattacaacggctacctgccgatggacgacggcgtgctgagcctgtgcgaatcggcccttggcgatttcgtcacgctggggtgtgaagtagaaagctgccagccggcgttttccctggcgcggctatggcgcagttggttggtgcaccgccattggctggtgcacggcaatctcggcgcggcctacgccaacccgcaaaaacgtgcgttgctcaaacccgaggcgcaatgggaagtggagggcggcctgggcttgagtgcccagcaggtgtaccaggcgtcggtggatcgcagcgagtggtatcgcgccctggccaagttgttcgaacgttacgatttcctgttgctgcccaccgcccaggtgttccctttcgatgcacaacaggcgtggccgcgcctcgttggcgggcgcgaaatggacacctaccaccgctggatggaggtggtgatcgggccgacactcgccggtctgccgagcatgagcatcccggtggggtttaaccctggcggcttgcccatgggcctgcagatcatcggcccggcccaggccgaccgcgcggtgctgcaattggcgtacgcccatgaacagttgacccaatgggtgcagcgccggccaccggcgtgccttgcatcgggcagttgacgcgcaaccgggcctgtatcttgctgtgaacaatgatcatccaccggcaacaaggagatcgaacatgggcagccacgccgagacaggcaccgtacggtcggttgagcgcgcactggcaattgtcgaattgctcggtgaacaccaggcgttggggttggaggaggtgcattatctgacgcgcctgcccaaggccactgtgtcgcgcatgttgctgaccctgcaagagcagggttgggtctatcgcggcctgagcgatcgccgttatcgcctgcgcgcccagcgcttgtttggcgacacccagcaacgcttcaagcgccaggtggtggaaagcgccgcgccgtggctgcttgaactcagtgagcgcaccgggctggtggtggatttatcctgttttgatggcgagcgcctggaggtcatggaaagcgcgatccccagcgtgctgcgcaagttgtatccgaacaattgccagatcgtcggccagcacgccagcctgtttcactcggcgatgggcaaggcgtgcctgacgcaattgcccgccgaagaggtgcaacgcctggcgggccgcgaccatgtggcggccgatgagcagttgcacacctgcgagcaaacccagcaccaagggtttggccagcgcaccgaaggttattgggaatacacggtgcgcctgccattcctgatacgcgcggtggcgttgccggtgcaggccaatgggcgtctgatcggcagtatggcgttgcactggccgatgcatcaggcgccggtggagcgcgtgttgaacctgcatatggccagccttgaagcgacggtgcgcgatgtgcagcgggcgctggcctgacagtcaccgctgaacaaagaatgtgggagctggcttgcctgcgattgcggtcagtcagtgaatgaacccgctgactgacacaccgctttcgcaggcaagccagctcccaccttgatcggctttgtcagttacattgcgcccggcacccggcacagttaaggttcgtccaggttttttgcctcacgagtctttatgttcaacgtcaaacccctggccttcacgctgctgacggctgctgctctgcctgcccacgccgactggtacttggataacgaatcctcacgcttgtcgttcgtcaccaccaaaaacaccgagatcgccgaagtgcagcgtttcctggtgttgcacggcaaggtcgacagccagggcgcggcgcaactggaggtggagcttgagtcaatcaacagcggcattccgctgcgcgatgagcgcatgcgcaatgacctgttccagatcaagacctttcccgaagcgctgatcagtgcacgcatcaacctgcaacccatcaatgatttggcccccggcgcgcaagtggagttgcgtctgcccctgaacgtcaccctgcacggcaagacccaaacctacagcgccgagttgctggccacgcgcctggatgaccgacgtttccaggtggtaaccctggaaccggtggtgttgcatgccgaggatttcgatttggcgccgggtgtggcggcgttgcgtaaggcggctgggttgaagtcgatcagtttgtcggtgccggtgggtgcggtactgatctttacggcgcgttgagatgagcggcgcggtgttcccgtggcgcagcgccaaccgtttcgagttgctgatcgacgggccaagctttttcccgcagatgctggtggcgattgctcgcgccgagcagcacgtcgatttggagttgtacctggtggaagccggggcctgcgccgacgccatggtgcaagccttggtactggccgccgagcgtggcgtgcgagtgcgctgcctgtttgatgattacggcagcctggcgtttaccttggggctgcgtaaacgcctgaccgacgcgggcgtgcagctgcgtttctacaatcgcctgagctggcggcgctggatgcgcaacctgtaccgcgaccaccgcaagctgttgctggtcgaccagcgtatcgccgtggtcggcggaactggcgtgacagatgagttctggacaccaggccaggacacggccgattggcatgaagtaatggtgcaaatcagcggccccttggtgctggattggcaagcgttgttcgaccgtcagtggcatgcgaatgtggcgcgccgcgagtggaaacctgccacccatttcggtttgccgcgcctgcccaaggtgccggcgaccgggccgggcctggggcgcgtcgcgtatgccgacgcccgccagcaccgcgatattttgcagtcgttgattcgtgccttgaacagcagccagcaacgtatctggctggccacgccgtattttctgccgacctggagcgtgcgccgcgccctgcgccgcgcggccgggcgcggcgtggatgtgcgtttgttgctcaccgggccgcgcaccgatcacccttcggtgcgttacgccgggcaccgttactacccgcgtttgctgcgcgcgggtgtacagatttttgaataccagccgtgctttctgcacctcaaaatggtgttggtggacgattgggtcagcgtgggttcgtgcaatttcgatcactggaatttgcgcttcaacctggaagccaatctggaagccttggaccctgagttaacgctggccgtggccggcagtttcgagcgtgattttgcccagagccaggcggtgagcctggcggcgtggaaagcccggccgttgtggcggcgggtcaagcagcgggtatggggctggattgatcggttggtggtgaacctgttggatcggcgggggtagggcgcccccgcctttgctgactaaaactgcaatgtgtactgcgccgtgacgctctggtcgcgcgtgcgctcaccgcgctgttggctgaagccgaagtccaaactgctgtcgcggctcaggcgtgcggtggcgcccagttccaagcgggtgctgaggcgatccaacggcgcaccgctgacactcatcacgcggccgccgtcccaggctgcctgggtggtcggttgcaggtcgccgctggcatgggtgtaggccaggccgccacgcaggctcagccatgacgggccgatttgcgccttgcccaggtcgaggttgacccgcacgccaccggtggtcaggttgacgttttccttcgagcctttgctcttcagtgcagccatgccgccgcgctctttgaagccttcgctgcgctgttgcacattggccagttgcaggtacggctgccagtcccaggcgtcatggctgaacttatagttggcctcggcaaacgtctgcacggtgcggctggcgtacttggcgctcaggcggttctcgacgccggggaagctgacacggcgttttgtctcgatctcatgttgcgcataggccacgccgccatacaggccgaacgcgtcccatgtgtggccggcgtgcagggccaattggaaggtgtcgacgctggctttgccacgcgaaccggcccgcacatccgtacggccactgccggctaccacgcccacgcgagtgccttgttccagcgtgtgatcgaaccccaacagcaggcccgtgctgttgtggtgagtgcgcgtggtgttgctgtcgcctgcaagttggccggattgacgcggcagttgcacccagacaccttggttcttggcgtcgagtgcggcgacgcggtggtcttgcgccaggcgctgacggtcgagtgcggcctggcgcactaggcggctgttttcgatcagcaccgcttgggtgctggcatgcagttcgccgctcaactggtcgagggctgaaggcgcctgctcggggaacagcgcggtcaggcgttgcagcagcggcgaaggctgggcttgcgcgtccgcagcagtggcgacggcgcgttggttggtcgtctgcgccgctgaagccagtgactgaccacggccaaactccaccagtaagttgttgccttgcttgacctgggaaacgctgaggaaaggcgagaactcgcggcggtcaatcgaggtaaattcgccgttcaacgcgccttgggcctgcaggatgctgtagcgctggcccaggtaatagtgattgggttgcgcgctcaggtacagcgagccaccgttgatggaggcctggttttggacctgcaatttggccgggactgccgggctggccaggcctgtcatcagggttgaaccggcggcttgtgtgtaatcgcccgccacgttcagggaaccgttcagacgcagcacgccgccgtcgacgttgacgtcgcccttgagctcgttggtgccgtccagctccaggatgccttgcttgagcgtggctccggcgaagttgttattgccgctgaggcgcagccagccgatgccggttttttccaggcgaccggggccgccgatatcgttgcgccaatcatcccaggcaccgccttgccagacgattgcgccaccggcagggcggtccatgttcaccgaggtgtcgacgcgcaattggccggggccgtcgatggcttttttcaggttcatcaggccccagccgtaaacgtcgtccacacccggcgcgccgaggtcggtggcggtggtgagtaatacgtcgcggatttgcgggttgtcgaggtaggggaagcgttccatcagcagggccaggccgccggtgacgtggggggcggccatggaggtgccggaacttaacgcataaccaagctcgggtttatcaccggtgacggcgaagccgttgacgccaccgtcttggtcataatggctttcggtttgtattgagccggtgacccaagaggagttgatatccgttccaggtgcggccagacaccagtctttactgaagccgcagcgctgggaatgatcgctcaacgtcagctctttagttaagttgacgacagtcaaccaatacggttccagctctgcaatggcacgtggaaagttcgggtgaagcccggaatttggcgcattttgaggggagtcgtttgctgtggttacgttgcccgctgaccatacttgcagcatcccatacttgatagtgttgtctgctatggccttaagttccgagtaaacaaggccttcggtttggcttaatgcaatgtccagctctgcttcatccgcaggcgaaaatgcactcccccaactattattgacgacgcgcacattctggctgtgcaattgggcataggcggcgtgtaccgacgccgctgttgggaggggcgcgcgcataatgtctgttatggcaatggggcctcccaggtaggtattaccgaatttgcgcacgctgctcaagttggccgcgtaagccacaccatggactccggagccgtcacgattggcgagtgctgtgcctgcaacgtgagtaccatgcgcttcgtacgcagcacctacaactgcgagatattcatcaagttgtttgcgtgtgaggatgccgtcggcaatagcttcttcaagttcggctagtgcttcgggtggcaatgagtcgacaactatcactgccgcccgatcaccttcggtgtagaagcagcctccctccagcacggtcccactcttgcaaccggtgtcagccataagcacgccgatcgttggcttcccggcaaactcgccatggcgcaggtcgactccagagtcgaaaacccccatttgcactccagcgccactcaagcctcgtgcataagcgaaatcagcgccgattgctcccagcccccaattactcttgaattcctcactgcgccaactggccgcatcgttcagtcggccttgttcaacatagctcgcggcttcaaccggcatgcccgacaagcagccgagtacacagaggatcagagcatttcgcttgagtgatgattgaacgggcgcctttgcggatgccgttcgggcgttttccgtgggtgacatggtccacacacctgcaaaaaaatgaggctgacagggtgtgcgaggggggcgggagcgtgatgtaggacttggcttgtagcgaggagtgaaagttaactttttgcggggtttgcgccccctcttctaaaaagagggggctgcaacccttacaacaactcgaacgtctgctgctgcacatcctgggagtcgagcccgatctgcacattgaattcgcccggttctgcggcgaacttgagctgggtgttgtagaacttcaagtcctcctcggtgatggtgaagtgcaacgtgcgctcttcaccggccttgagcatgaccttctggaagtttttcagctccttgatcgggcggatcatcgagccggccacgtcctggatatacagctgcaccacggtttcgccatcgaccttgccggtgtttttcagcgtgacgctggcgtcgagcttgccggtcttgttcagggtggtggacgacagcgccatgtccgacaggctgaacgtggtgtagctcaggccataaccgaacggaaacaacggcccggtggtgtcatcgaagtattgcgaagtgtagttgcccggcttgccaggggtgaatggcctgccgatggtcaggtggttgtagtaggtgggaatctgcccgaccgaacgtgggaaggtgatcggcagcttgcccgacgggttgtagtcaccgaacagcacatcggcgatggcgttgccgccctcggtgccggcgaaccaggtttcgaggatcgcgtcggcttctttgttctcatccacaatcgacagcgggcggccgttcatcaacaccagcaccagcggtttgccggtggccttcaacgccttgatcaggtcgcgctggctttgcgggatgttcaggtcggtgcggctcgaggattcatgggacatgccacgggactcgcccacggcagccaccaccacatcggcgtccttcgcggcttttaccgcctcatcaatcagcacctgcggcgcgcgggtgtcatccacgacttcaggtgcagcgaagttgaggaagttgaggtagtcgaccacggccttgtcgttggtgatgttggcgccacgcgcgtagatcactttgcctttatcgccgatccccgcgttgaggccgtcgagcagagtgaccgattgcgccggtttgccggcggcggcccagctgcccatcatgtcgatcggcgccttggccagcgggccgaccagggcgatggtcgcggattttttcagcggcagggtgttgtcctggtttttcagcagcaccaggctgcggcgcgcgatatcgcgggcgtcgctgcggtgcaggcggctttcggcgtcggtgtcggccgggtcatcctcggctttgccgatgcgcaggtacgggtccttgaacaggcccatgtcgtacttggcgccgagcacttcgcgcacggcgttgtcgatgtcgctttgttcgatttcgccggacttgagcaggccgggcagttccttgccgtacagcgagtcgttcatgctcatgtcgataccggccttgatcgccagcttggcggcttcacgcccgtccttggccacgccgtgtttgatcagctcgacaattgcgccatggtcgctgacggccaggcctttgaagccccagtctctgcgcagcaggtcgttcatcagccaggtgttggcggtggcgggtacgccgttgatcgagttcaacgccaccatcacgccgccggaaccggccttgatcgccgcgtggtagggcggcaggtagtcctggtacatcttgaccgggctcatgtcgaccacgttgtagtcgcgaccgccttccaccgcgccgtacagggcgaagtgcttgacgctggccatgaggctgtcgacattggccgggctggtgccctggaaggccttgaccatcacttcggcgatgcgcgagaccaaataggtgtcttcgccgaagccttcggaggtacggccccaacgcgggtcgcgggagatatcgaccatcggcgcaaaggtgatgtcgaggctgtcggcggcggcttcctgggcggcgatgcgcccggagcgtccaatggcgtccatgtcccagctggacgccagggccaggctgatcgggaaaattgtgcggtggccgtggatcacgtcataggcgaagaacatcgggatcttcaaccggctgcgcatggccgcgtcctgcatcggacggttttccgggcgggtgatcgagttgaaggtgccgccgatgcggccggcggcgatttccttgcggatcagctcgcggggcatttcggggccgatgctgatcaggcgcaactggccgatcttttcgtccagggtcatctgcttgagcaggtcgctgacaaaggcgtccttgtctttaagcgcagcaggctttgtttctgcccacacggggtgactggccagagtggcaacaaggccgagcaaacacagcttcttcatgaatatcctttttcggctcactgcacagcgaaaatgcgctgttctgccaaaatgtggggaacatatgttgttgttcgagtgttattgcagtaaatgcacgacacttgtgaactcttattcgcgctgggcatctttttagctgattggctcgacgcaatccagtggtggcggattatgccccaagcgcgcggtttatagggttagtcgtcaacttccatcaagtttgggcaggagaaacaccatgcaagcagcacaaggttaccgctggggcttgaaagccgcggctttgctactgatcagcagcgtgctgagcggttgcggcatcaacacgattccgaccctggatgaacaggccaaggcggcctggggtcaggtgcagaaccagtaccaacggcgcgccgacctgatccccaacctggtggaagtggtcaagggctatgccgcccatgagcaagacaccctcaccgccgtgattgaagcgcgggccaaggccacttcgatccaggtcgacgccagcaccctcgacaacccggaaaaactcaagcagttccagcaagcccaggatggcttgagcggtgccctcagccgcttgatggtggtgtccgagcgctacccggacctcaaagccaaccagaacttcctggccctgcagtcccaacttgaaggcacggaaaaccgcattgccgttgctcgtcgcgactttatccaggccgtgcaggcgtacaacactgaaatccgtaccttcccaggccgcctgtggcacagcgtgatgtacagcgacttgccgatccgcgccacgttcgaggccaccagtgccgacgccgataaagcgccgcaagtgaagttcaaataaggcttctctgaggtgtcgatgcgtttattacggataggcttggcgctgtggttgctggcctgcgtcggtgcggcccaggcggcgctgacgttcccgccattgaccggacgggtggtggacaccgcccagatgatcgacccggcggtacgtgcgcagattacccagcaattgcaggcgctggagcaaacctccggcgaccagatcgtggtggtcaccgtgcccgacctgcaaggtgtgcccattgaagactacggttatcaattgggccgccagtggggtatcggccagaagggcaaggataacggcgcgctgttgatcgtcgcccgcgatgagcacaaattgcgcatcgaagtcggctatggcctcgaaggcgtgctgaccgatgcgcaggcgtgggtaatcatcaaccaggtgatcgcgcccaagttcaaggccggcaattacagccagggcatcagcgacggcgtctcggcaatggtgcaggtggtgggcggcgagccgctggcggtgcctgcccatgtggcggacgcgaattttgccaaggataatcccgggttctccatcggcttgttcattctgctgatcggcgtgttgtggctgtgcaatcgcctgggcctgccggttggcgctattttgctggctattctcagcagcagtgggcgcggtgctggcggtggggtttggcggacacaacggaaagggccttggcccggcgggggattgtcgggcggtggggggtggcgggcggggcggggggggggggggagcgcgcgcgggggctggccgcggggcggtgg

SEQ ID NO: 89 - DNA, 14112 bp, Pseudomonas poae FL10F
gccggtttagccgcgctgggccaaggatggcccatcgcggcggcccccgctccaaagccggagtgagggcacaccgaagcgtgagcgaggtgccgagtggtggggcaagagcccttttggttacttttggggctcttttccaaaagtgacccgccgtaagggcggaaccaatccccgccatcacccaaacaacggatatgtaccagcccccctcaccagcaatccagcccccagtttaatcggcggagaatttcaagacggtgttgtggctatacgtctgcccagggttcaaccgggtggaggcaaacgtcggctgattcggcgcatccgggaaatgctgggtctccagggtaaacgcgctccaatgcgcatacaccttgccggccttgcccttcaccttgccatccaggaagttgctggtatagaactgcaccccaggttcggtggtgtagagctgcaaacgccgacctgaggccgggtcgtgcacctcgacggcgagttgtttgatatcgcctttgttatccagcgcccagttgaagtcaaacccgccttgtttcggctcggcaaacttgagctgtgggtggtcgtccttgatgtgctggccgatcggcgtgggcttgaggaagtccatcggcgtacctttgaccggcgccagttcgccggtcggaatcaaggtggcattcaccggcgtgtagtggctggcatgcaaggttgcgacttgcttgagaatgtcgccattgcccgcgccggcaaggttgaagtagctgtggttggtgaggttcagcaccgtcggtttatcggtggtggctgtgtaggcgatgtgcagttcgtttttgtcgttgaggctgtaagtgacctcggtcttcaagttgccggggaagcccatctcgccgtccttggacaggtagctcagcttcacgccgaccgagtccttgcccttgatcggctcggcttgccacacctgtttgtcgaaaccctgggcgccgccgtgcagcgagttgggcccatcgttgagcggcacctggtaacgcttgccgtcgagttcgaaggcaccgcccgccaggcgattgccgaagcgcccgatggtcgcgccgaaaaatgcggtgccgctctgatagccctgcacgtcatcgaaaccgaggaccacgtcatcgaccttgccgtgtttgtccggcactttcagcgactgcaacacgccgccgtaggtgatcaccgtggcttgcatgccatggctgttgcgcaggatgtattgttcgacggcggtgccgtcattggttttgccgaacggtttgtgttcactggtaagcccggccgcctgggcgccgccgctggcgatcagcatggataaggcgaggcccgaaagcaggtgtcgagggtgcttcatggtcgaacttccttttgttgttttgagtggaatagttctactattgtgcgatatttcgtcgagttgacagcgaatttatagccttaaacgccagatacgccaaataaaataagactaattgatcggggcacacgttatatgagtactgcacacgccgtttatccggacctgaagggtaagaccgtaatgatttccggaggtgcctcgggcattggcgaattcatggtgcgcgccttcgccgcgcagggcgccaaggtggcttttgtggaccgcgcgcaaagccagggcgagcggctggcggcgttgttgagcgcccaggggcatagcgttgagtttgtgtgctgcgacatcaccgatgaaatcgcctacaaggcagcgatagcgcgttttgaacacacgctggggccgatcactgtgctggtgaacaacgccgccaacgatgtgcgtcacaccttggaagaagtcgattcggacatgttcgacaggctgatcgcggtcaacctcaagcacgcattcttcgcggccaaggccgtggtgccgatgatgaaaggcgcgggcggcggagccatcatcaacctcggctcggtcggctggatgatggcttccgccggctacccggtgtacgccgccagcaaggccgccgcccacggcatgacccgcgcgctggcacgggaattgggccccagccgtattcgggtgaacaccttggtgccgggttgggtcatgaccgaaaaacaactggcgatgtgggtcgacgatgcggccaaagagctgatcagccgcagccagtgcctgcctggcagtgtgctgccagaacacatcgccaatatggcgttgtttcttgcctctgatgcatcggcgatgtgctcggcgcagaactttattgtggacggcggttgggtgtagcgcgcttattcgatcgggtatttacggaaggtcggatgctgctcgagcaaccgggtatgacgctgcaggttgggaaacgcctcgggtctgagcaccgtcggcagtttgagctgggtgaaagaccaggcgactgcgatgctcaatgacgcctggctcaacggttcgctggcgggctgggccaggtgtttttccagcagcgaatacgcggccagcaactgcccgctcacccggtcgatccacggctcgtgcagtttttccgcaggccgtagattttgctcgtagacgatttgcacggttttctcacacgccgccagagccaggccgagcagttgcaggtccttggcgcgcgcactggtgttgtgtggcagcagctttttgtcgtttggcgccaggctttcgaagtagtccaggatcaggctggaatccatcaacaccgtgccatcgtccagcaccagcgtgggcgccttgaccaccgggttgatcgcggaaaattcagcgtaggtgctgaacaccgagagcgactcgtgcacgaagtccactccgtacagctccagggaaattgccacgcgacgtacgtaaggcgagtccagcatgccgaccagtttcatgaagcctccattgctcatacggtgttgggctcacgagattaagggcacggggccgggctgcgcaatggcctcgcgcagttgctgataagcctctaccagttgcgccaggctgaacgccaggttgcgcccgctcgggttgggcagcacccacaccgtggcgccgccgagtgcctgcggttgcggcccccactcaatctgccgccggccgcacaacgcgctgtagccgggcttgcccaggaacgccacgcagcgcggccggcagtcgcggaccttctgttcaaacgcgttcgccgcgtccttgaattcatgccgtgccaattcccccgcgctcgcggttgggcgttcgaccaaggtggtcaggccgcagtgatagtcgagcagggtgcgcccatcctccgggcgaatttcatgcggggtaaaacccgccaggtgcaacgtgcgccagaagcggttgctgcgattggcaaagtgctggccgagggcggcagagcctttgccggggttgatgccgcagaacaccacgtgcaggtggtcggcgaggatgtcgtcgaggccgtcgctcatgctgggctcctggcacgactcgctccaggcggttgcccggtgatgcgcttgaaggcgcggctgaaggcggcctgggaggtatagcccaggcgctgcgcgacttcttcgatcggcaaccgctccagggtcagccactggctggccaggcgcatgcgcagttcggtggcgtagcgcagtggcgggatgccgagggtcgcctggaagcggtcggcaaataccgaccgtgaagtgttcccctgcgccgccagttcggccacgctccagtcgcggcccggttgctgatgcaaggcgaggagggcgcgtgccaatcgcgggtcacgcaatgcggccaccaagcctgacgcattaccacaggcgcattcgacccagccgcgcacgatcatcgctgccaccacatcagcgaggcgcgccagaatgcccgcgtagccgatacgggcgctgcagacttcgcgctccatggtcgccagaattggcatcagcccaggataacgctgaccccgcgcatcgatcagcatcatcgccggcatcaggcgacccagcccttggatgctgcccaattcgaacgccatgcacgcgctgaacagcaagctgccagttgatccgtgagcgtcggtggaggccttcacggcacacaccgcgtcaccgagcgaggcagcatcgaagctgccgatatcccgaaccgctgcgcccgggctcgacaataactggtgagcgccgccatgggagatgaacaccgcattgccggccgacagttcgtagaggctgccgtcgtccaggcgcaacgtggcgcaacccgaggccaggaagtggaaatacgcgtgcccgggcttggcctcgaaactgatgccgaacacgggcccggcttcgatacggcggtactgcacaccgcgcaggcgcatgccctgcagcagttcattgatgaggtcggaagagacggtaaacgcgtcagctgaagtcatgctcggggtttcggtcaaaaactcaagggtttgcatcatagatcatccaggagggcgaacctagactgggccctcgctcatttccagaggatgttttgtaatgaatgattatgcagcccatgtcggtgccagggcgcagccgaccaccccggcctggatggcggtgttctccctggcaatgggggtgttcggcctgctgacggcggaatatttgccggccagcctgttgacgccaatggctgtggaccttggggtctcggaggcattggccggccaggcggtcacggtgacggcggtggtggcattattcgctggcttgctggtgccgggcctgacccgtggcatcgaccgccgcgtggtgctgctgggcttttccagcctgatgattgcgtcgaacttgctggtggcgttttcgtccagcctggccgtattgctattgatgcgcatcctgttgggcattgcccttggcggtttctggagcatggcagcggccgtggcgatgcgcctggtgcccgctgcgctgctgccacgggcattgtcgattattttcagtgggattgcggtgggtacagtcgtcgcggtgccgctgggcagctacctcggcggtgtatatggctggcgcagtgcgtttgtcgcggccgctgcggtgggggtggtgacgctggtgtttcagctgttcacgttgccgcgcctggcgccgaccgccaccgcgcgcttgcacaccgtgcttgaggtgctgttgcgccccggcatcgccatgggcatgttcggctgtgtgctggtgcacaccgggcatttcgcgttgttcacttatattcgcccgtttctggaaagcaccaccggtgttggcgcccaagggttggcgttgatgctgttggggtttggcgcggccaatttcgtcggcacgctgctggccggctggatgctggtgcgcaacccgcgtggcacgttggtgctgatgccagtgttggtgggcattgcggcactcgcgttggtgctgctaccggcgtcgctgccggggcaggcgttgcttctggcgttatggggcatggcgtttggcggcgtgccggttgcgtggtcgaactgggtggcgcgtgctgttccggatcaggcggaaagcgccggtggcatggtggttgcctcggtgcagtcggccattgctgcgggggctgcgggtggtggtgcgatgttcagcttgagtgggattggcggtgtgtttgttgcggctggggttttgatgctgctggcagctttgttgattgcgtggcgggtgcgggtgcctgggggctaggcgagtaggttttagtacttatccattagttgcgagaaggcggatatcggcaaaaacagggcaaaggcggagctgcttttctgtgggagctggcttgcctgcgatgcaggcacctcggtacatcaggcaaacccagtggatgccatcgcaggcaagccagctcccacattgaccgcgtacacacacatctacccgccgtaagggcggaacccatatccgacatcacccaaacaacggataggtactcaaaagccccgctttcagtcttccaggttagccagcaacgtcttggcaaactcatcggaggcgataaagtccaaggtctggcgcaactgcgctgccgcttcacggccgaacgcctgatcaaagcgctcggccattttgttcgagatacgcttggccgccgcgtgggtgcgcttgccgtgttcggtgagcagcacgcggcgggtgcggcggtcgagttcgtccacctgcaactccaccaacccatcgcgcaccagcggcttgagcgtatggccgagggcggacaggtccatcaccagggcctgggccagctcgcccatttttggcgtaccggctttggcgatacggttgagcacggcgaactgggtggctttcaacccgcagggcgcatacgcctcgtcatagatctggcccaggcggcgggacgtgcggcgcacggcaccgttgacgcaggcgctggggctatcggagcaaggcggggcagatttcaagggcagatactctctgatacaaaacacgacgccggtgattatgcctgcgcgacctgtcaggacaaggcctttcagaccgaagaagccgtgtagatgaatactgagacagcttgaaacaaattagttgcgtacgccactaaattcgatatcgtggcatatgcctctttgtgactcggatgtcgttgcaaaatccccaggaagcgcgtggggcgaggcgggaaaacggcacggctctgcctgcttgaacatccaacccctgtctggatcacctcctatgctgagcctcgtgcgcatcgcattgcggcgcccttatacctttctggtattggctattttcatcctgatcattggcccgttggcggcctggcgcacgccgaccgacatctttcccgaaatccgcatcccggttatcgccgtcatttggcagtacaccggcttgccaccggatcagatggcggggcgcatcacttcgccttttgagcgggtgctgaccaccaccgtcaacgacatccgccatatcgaagcgcagtcgatgaatggctacgggatcgtgaagatcttcttccagcccggcgtcaacatcagcacggccaacgcccaggtgacctcggtgtcccaggcgattttgcgccaactgccgccgagcaccgtgccgccgctggtgctcaattacagcgcctccaccgtgccgattgtgcagctcgcgctgtcggggccgggcttgagcgagcaacgcctgggcgatatcggcctgaaccaggtgcgcctgatgctcaccaccgtgccgggtgcggcgctgccatacccgtttggcggcaagagccgccaggtgcagattgacctcgattcggcgcgcatgcaggcgcgcggcctgtcggcgcaggacgtggcgaccgccctggccacgcagaacctgatcaccccggtgggcacgcagaagatcggcagctacgaattcaacctgcaactgaacaactcgccatcggatttccatgacctggaaaacctgccgatcaagaccgcagacggcaccactgtgctgatccgcgacgtggccacggtgcgcgacggcaacccgccgcaaaccaacattgtgcacgtcaacggcaaccgctcagtgctgctgccggtgctcaaaaccggttcggcgtcgaccctgggcgtgatcgccgggatcaaggataaactcgccgacaacaaggccgccttgccgcccaacttgaatatcgacctcatcggcgaccagtcgctgttcgtgcgctcggccatcagcggcgtggcccgtgaaggcttgatcgcggcggcgctgaccagcctgatgatcctgctgttccttggcagttggcgttcgacggtgatcatcgccacctcgattccattggcgatcctggcgtcgattgcgacgctgtcggcgctcggcgaaaccctcaacatcatgaccctcggcggcctggcgttggccgtcggtatcctggtggacgacgccacggtgaccatcgagaacatcaactggcacctggaacagggcaagccggtggaaacggcgatcctcgacggcgcggcgcaaatcgtcaccccggcattcgtgtcgctgctgtgtatctgcatcgtgtttgtgccgatgttcttcctcgacggcgtggcgcgtttcctgttcgtgccgatggccgaagcggtgatcttcgccatgatcgcctcgttcatcctctcgcgcacgctggtgccaaccctggccaactacctgctcaaaccccatgtacacggcgaagacgggcatgcgccatcgcgcaatccgctggtgaagttccagcgcggtttcgagcggcgttttgaaggctttcgcgagcgttaccacggcgttctggacagtgccttgcaccatcgccgcacggtggtgatcggcctgctggcgtttgttgcggtgtcgtttgcgctggtgccgttcctgggccgcaactttttcccggaggtcgattccgggctgatcctgctgcacgtgcgtgccccggtgggcacgcgggtagagagtaatgcgcacctgatcgccgacatcgaaaacgcgatccgacgcaaggtcccggccaacgaactcaaggccttggtggataacatcggcctgtccatcagcggcatcaacgtggtgtacaacaacaccggcaccgtgggttcccaggacagcgacattcagatcagcctcaacgagggccaccgcccgaccgccgaatacatgcgcatactgcgcgaaaccctgccacgggaattccccagtgcagtgttctcgttcccggcgtcggacattgtcgggcagatcctcaacttcggctcttcggcgccgattgacctgcaaatcaccggcaataacctggcgggcaacttcacgtacgccagtgcgttgctgcgcgacattcgccgcgtgccgggcgtggttgatgcgcgtatccagcagtcgcggcaactgcccacgttcaatatcgacgtggaccgcacccgtgcgcaattggtcggcctgaccgagcgcgacgtgaccaacagcctggtggtcaacctcgccggttccagccaggtagcgccgacgttctggttgaacccggccaacggcatttcctacccgatcgtcatgcaaaccccgcaatacagcctcgaaagcctggcggcgctgcataacctgccgctcagcggcagcggcggggcggccaccgaccagaccttgggcggcctggcgaatatccagcgcagccacagcaactcggtgtttacccagtcggatatccagccggtggtcgaagtgctcacggcgatccaggaccgcgacctcggtggcgtcgccgccgatatccagaagatcatcgccgctcacgccggtgaggtgccgaccggttccaaggtgatcctgcagggccaggtgcagaccatgaacgcggccttcagcggtttgctgttcggcctgctcggcgcggtggtgctgatttacttgctgatcgtggtcaacttccaatcctgggccgacccgtttgtgatcatcaccgcattgccggcggcgctggcgggcatcgtgtggatgctgtttgtgacccacacgccgctgtcggtgccggcgttgaccggggcgatcatgtgcatgggcgtggccaccgccaacgccatcctggtggtgagtttctgccgcgagcgcctggcggtgcacggcgatgcggtgcaggccgcgctggaggccggtttcacccggctgcggccggtgctgatgaccgccatttcgatgatcatcggcatggcgcccatggccttgggcctgggcgagggcggcgagcagaacgcgccgcttggccgtgcggtgatcggcggcctggcgtttgccaccatcgcgacgttgattctggttccgttgattttcagtcttgtccacgggcgtcgtcagcacgccacgctggcgaccaccgtttcccaaggggtttgacatgtccgtttctgcttctaaatccaagtcttcccgtggcctgctgtggctgatcgtgggcgcggcagtggtggttgtcatcgtcggtgtcggcatcggcgtgcgcgccagtgaatcgcgcgacctcaagacctggaccgacgcgcaggcgttgcccagcgtcaacctgatcaaaccggtggtgcaagcccagggcccggtgctcaacctgccggggcgcctggaggcatattcccgcgcgtcgatctttgcgcgggtcaacggctacctcaaatcctggaatgtcgacatcggtacgcgcgtcaaagccgggcaagtactggccgaaatcgacaccccggaactcgaccagcaactgctgcaagcgcgtgccactttggcctcggcccaggccgatgagcacttggccgaaaccaccgccaaacgctggcaggcgatgctggcgaacgactcggtgtcgcgccaggacgtggacgagcgcaccggcgacctgaccgccaagcaggccaaggtcacggcagccaaggccaatgtcgagcagttggtcgcgaccaagggcttccagcatctggtcgcgccgttcgcgggtgtggtcactgcgcgcagcactgacgtcggcgccttgatcagcgccggcggcacggccggtaaagagttgtttgcggtggccgacgtcagccgcctgcgcgtgtatgtgcaggtgccgcagaccttctcgccgcagattcgcgaaggcaccacggcgcgcctcagcgtgccggaataccgcggcgaaaccttcaccggcaaagtcatcgccaccgccgatgcggttaacgccgcctccggcagcaccctggtgcaactgttggtggacaaccccggtggccgcctgctgccgggcggctataccagcgtgcagttcgacctgccggtgcaggccgacgtaatccgtgtgccgtccagcgccttggtgttcgatgacaagggcatgcgcgtcgccaccctggatgcgaacaaccatgtgcacttcaagaccgtcagcatcgcccgcgacttcggcgacagcgtggagatcgccagcggcctgcaagccaccgaccgcgtgatcgacacgccgccggacggcctggccgatgatgattcggtgcagctggccgtcgccgcgaccgaggtcaaaccccatggctaagcgcaacctgctgggcctgctcgccaccttgagcttgggcgcgtgctcgttggcgccgccgctcaaggtgccggaaacgccgattgccgcgcagtttcatacccaaggcccgtggaccgtcggcgcacccaacgaccaggccagccgggatggctggtggcgtatttataacgacccgcaactggatgcgatgcagcagcagttgctgaaaaacaaccccgacttgggcgcggcactcgcgcactatcagcagtcccaagggtttttggcccaagaccgttcaggcctgttcccgaagatttcggccatcggcagcggccagcgtattcgccagtcggacaccaagccgttgcgttcggccacttcgccggatgtctacaactcggcgacgctgggcctggaggtggattatgaagtcgacctgtggggccgcgtgcgcgacaccgtggcggccggcaccagcgactccgaggcggccaaggccgatttggcctcggtacgcctgagcctgcaggcgcaattggctgacagctatatccgcctgcgcggtatcgactggcagaaccagttgctggagcagacccgcgatgcctacgccaaagccttgggcctgaccgaaggcctgcatggcggcgggatcgtctccggcctcgatgtggcgcgggcgcgcacgcaattgtcgacggtgaagtcgcagctcagccagagccaggtgcaacgggcgctgctggaacattcgatagcggcgatgctcggtgagtcggcctcgacctacagcgtcgccgtgaacgtggcgccgattgccttgccgaacgtgccgaccggggtgccttcgagcctgttgcaacgccggccggatatcgccgccgccgaacgtcgcatcgcggcggccaacgcgcggatcggcgtggccaaggcggcgtggttcccgcagatcacgttgagcgcccaaggcggttatcagagtgacgagtttgcccgcttgctcagcgcaccgaacctgttctgggccatcggcccgtcgctggtgggcacgctgtttgatggcggcgcgcgccaggcccaggtggacatcgccaaggccgccaccgatgaagcagcggccaaataccgcggcgtggtgttgggtgcgtttgagcaggtggaggacaacctttcgcaaatcgccggcttgggcacggccctggatgatcagcgcgatgcggcggcggcggcgcaatacgccgaagacctgtcgacttcgcgttatcgccagggcgccgtggcgtatctggatgtggtgaccgcccaagtggcggcgctggaagccaagcgcagtgtgttgcaattgcaaactcagcaattgagcgccaatgtgggcctgatcaaggcgctgggtggcggctggaatgtggctcaactggcggcatcgacccctactgaaaccaaggagaagtgagcatgaccgagtacgtacccccgaaagtctggacctgggacactgaaagcggcggcacctttgccagtatcaaccggccgattgccggtgccacgcatgaaaaggaattgccggtcggcaagcacccgttgcagctgtattccctggccacgccgaatgggcagaaggtcactattttgctggaagaactgctggccttggggcataccggcgcggaatacgatgcgtggctgatcaagatcggcgacggtgatcagtttggcagtgggtttgtggcggtgaacccgaattcgaagatcccggcgttgctggatcgcagtggcgatacgccgattcgggtgtttgagtcgggagcgattttgcagtacctggcggagaagtttgcggcgtttttcccgactgaaccggcggcgcgggcggagtgtttgtcgtggttgttctggcagatgggcagtgcgccttatctgggcggtgggtttgggcatttttatgcgtatgcgccgagcaagatggagtacccgattaaccggtttgccatggagaccaagcggcagctggatgtgctggatcagcgtttggcggtgagtgagtacatcgcgggggatgagtacaccattgccgatattgcgatttggccttggtatggtgggttggtcaaaggccggttgtatggggcgtcggcggagtttttgtcggtgcatgagtataagcatgtggtgcgttgggcggaggcgattgaggccaggcctgcggtgcagcgggggcgtcgggtgaatcgggtttcgggtgcgcccgaagagcagctggcggagcggcacgacgccagcgatttggactgattggtggtgggttgagtacatatccgttatttaggtaacggcggcttatggtttcgctcttacagcgagtcactttttgagggaccaaaaagtaaccaaaaagtcctcgccccaccactcggcacctcgcctaggctcggtgtgccctcactccggctttggagcgggggccgccgcgatgggccatccttggcccagcgcggctaaaccggcgtcctgccggtttacccccgctccaaagcctgcgttcggccagcgtggttgatggggcgactcagatcaaaatcaagatcaagatctacagcacggcggcctggtagccgacctgagtggtagaagcaaaagcagggcaaaagcacatccacctgatgcaatgcgatccaaatgtgggagcgggcttgctcgcgaaagcggtttgtcagtcaactcatctgtcactgacccaccgcattcgcgagcaagcccgctcccacaattagaccgagttcggccaacagaccgttgtgctctactttatctgtggaagctggcttgcctgcgattcaggcacctcggtgtatcaggcataaccagttgatgccatcgcaggcaagccagctcccacatttggttgagatcagcttccaatcaggtcggctgccaggccgcctcccacaattttacggagttcggccaccagaccagtgcgctctgcttttctgtgggagctggcttgcctgcgatgcaggcacattggtctatcaggtacaccgagttgatgccat

SEQ ID NO: 90 - DNA, 12929 bp, Pseudomonas poae FL10F
tgccttgatgaaaggacaaaccgaataccaaccgaagattggttgagggttgcccctcaaccatagaatctcccacaggagatcacccttgaagtttcgatttgtattcgccctgctgttcgtcagcgccagtgccagcgccgcaccgcctaccctcgcgccgttgctcgacagcatcgccgagcgcctggccatcgccgacgaggtcgcattgagcaaatgggacagccacaaggccgtggaagatcgccctcgtgaacaggctgtgatcgccagcgtgagagcccaggcaccgagctacaaagtggcgcctgacgcggcggagcagttcttcagcgcgcagattgaagcgaacaaattggtgcaatacacgcggctgtcggactggcacttcaccggcaaggcacccgacacgccgcgcccggatctggtcggcaagattcgcccccaattggaccaactgcaaaagcgcctgctacagcagctggcggacttcagccccgaacgcagcaacccgcagtgccctcaatggttggcacaggccgtacacgaaccgcttcgcgacccgctggcccaaatcgcaatagcccgtgccacagccgagctgtgcatctatacgccttgacagacatgggcctgcttcattgaaggccctttcccagtattcgtgttaaaccgcagaaatgtctgatacttcccagggagtcgagcttctacgatgcagcgtccagccgccagccgccgacgtacttcgcgatgactctcaactgccagctcctgtgttcactgacgctcgcaatcagccagctgaccgaagtacaacccaccctcgactccgcctccgacgccgagccccacgcctggacggtggagacaccctatccgcacagtacgattatcaacgccagaatcactggcacagccactcacgcacaaaaaaccagcatcgcaatcctgcaagtcgcctgctacagctccccctcccgcccgatgatttcgctgctgacccacaccgacaaactgcacttcaaccccaatatttacgaaggcccggacgctcgatcttcaggaccactcagccttaccaccggcaccctccctgcacgaacttaccgtgtaaacggctactacagcgcagaacccacccagcagcatggcgtactgtttaaattcaccatgcccgccaatcgccaagaactgcgcgagtggatcgccaacaacacgcacggccaactgatcacgatgaccttgccctcagcaatccccggcgactcgccgctgaccgcagagttcgtcctcccccaaaacagcactggcctgcacgagatcgtcaaatcctgcctgaacaaccgcaaaaacacgcctaaaaaaccttcctgaacaaagcgggtaaaactgcactatattggtgcagtaggccgcaccctcccaaccaaacagcccattttggttcgaatcttcccgagcacgctggcagaacgccacagtttcgagccttaaacccctgtttcagggctttaacgcttcttttcggagctttggtttggtttttgcattttccttgtatcagcgtgtgcctcaagcccgcgccttgctccaaaagaggtcctgatgaccatcagcgatgtactgcaccgattgttactcgacaacctgaccaccgcgaccatcttgctcaacgacgacctgcgtcttgagtacatgaacccggcggcggagatgctcctggctatcagcggccagcgcagccatgggcagttcatcagcgaattgttcaccgagtcggccgaagccctgagctcgttgcgccaggcggtggagcaggcgcacccgttcaccaagcgcgaagcgatgctcaccgccctcaccggccagacgctgaccgtcgactacgccgtaaccccgatcctgagcaacggcgcgaccttgctgctgctcgaagtacacccgcgcgaccggctgctgcgcatcaccaaagaagaggcgcagctgtccaagcaggaaaccagcaagatgctggtgcgcggcctggcccatgagatcaagaaccccttgggcgggattcgcggcgcggcgcaactgctggcccgcgagctgccggacgagaacctcaaggactacaccaacgtcatcattgaggaagccgaccgcctgcgtaacctggtggaccgcatgctcggctccaacaagttgccgtcgctggcgatgaccaacgtgcacgaggtgctggagcgcgtttgccagctggtggaagccgaaagccaaggctgcatcaccctggtgcgcgactacgacccgagcattcccgacgtattgatcgaccgcgagcagatgatccaggcggtgctcaatattgtgcgcaacgccatgcaggccatcagcagccagaacgagctgcgcctgggccgcatcagcctgcgcacccgcgccctgcgccagttcaccatcggccatgtgcgccatcgcctggtgaccaaggtcgagatcatcgacaacggcccgggcattcctgcggaactgcaggaaaccatcttttttcccatggtcagcggccgcccggacggcaccgggctgggcctggccattacccagaacatcatcagccagcaccagggtctgatcgaatgtgaaagccatcccggccacaccacgttctcgatctttctgcctctggaacaaggagccccatcgacatgagccgtagtgaaaccgtctggatcgtcgatgacgaccgttctatccgctgggtcctcgagaaagccttgcaacaggaaggcatgaccacccagagcttcgacagcgccgacggggtgatgagccgcctggctcgccagcagccggacgtgatcatctccgacatccgcatgcccggcgccagtggcctggacttgctggcgcgcatccgcgaacagcacccgcgcctgccggtgatcatcatgaccgcgcactcggacctggacagcgctgtcgcgtcctaccagggcggcgcctttgaatacctgcccaagccgttcgacgtggacgaggcggtggcgctggtcaaacgcgccaaccagcacgcccaggaacagcagaaccaggaagccccgccggccctgacccgcaccccggaaatcatcggcgaagcgccggcgatgcaggaagtgtttcgcgcgattggccgcttgagccattccaatatcaccgtgctgatcaacggcgaatcgggcaccggtaaagaactggtggcgcatgcattgcaccggcacagcccacgggcggcctcgccgtttatcgcgctgaacatggcggcgattcccaaggacttgatggagtcagagctgttcggccacgagaaaggcgcgttcaccggcgcagccaacctgcgtcgcggccgctttgaacaggcggatggcggcacgctgttcctcgatgaaatcggcgatatgccagccgatacgcaaacccgcttgctgcgcgtacttgcggacggcgagttctaccgtgtgggtgggcacacgccggtcaaggtcgatgtgcgcatcattgcggcgacccaccagaacctggaaaccctggtgcacgcaggcaaattccgtgaagacttgttccaccgtctgaacgtgatccgcatccacatcccacgcatgtctgaccgtcgcgaagatatcccgacgctcgcgcggcacttcctcagccgcgccgcccaagagctggccgttgaaccgaagctgctgaaaagcgagaccgaggaatacctgaagaacctgccgtggccgggcaacgtgcgccagctggagaacacctgccgctggatcacggtgatggcgtcggggcgcgaagtgcacatcagcgacttgccgccggagctgttgagcctgccgcaggattcggcaccggtgaccaactgggagcaggcactgcgccaatgggccgaccaggccctggcacgcggccagtcaaacctgctggacagcgccgtgccggccttcgagcggatcatgatcgaaaccgccctgaagcacaccgccggccgccgccgcgacgccgctgtgctgctgggctggggtcgcaataccttgacgcgcaagatcaaggagttgggcatgaaggtggatggtggggatgatgatgagggtgatgagggctgattgatcgttcccacgctctgcgtgggagcgcagctctggacgctccgcgtcgcatttcaaagtcgtgacgcggagcgtcactggaggcattcccacgcagagcgtaggaacgatcatcatccactgaagaacccatgtgggagcgggcttgctcgcgaaggcggtgtgtcagtcaacaggtgtaacgactgatccggcgccttcgcgagcaagcccgctcccacatttggatctccacaaggtttcggctccatgcataccttgacgcgcaagatcaaggagttgggcatgaaggtggatggtggggatgatgatgagggtgatgagggctgattgatcgttcccacgctctgcgtgggaacgcagctctggacgctccgcgtcgcatttcaaagtcgtgacgcggagcgtcactggaggcattcccacgcggagcgtaggaacgatcatccactgtagaacccatgtgggagcgggcttgctcgcgaaggcggtgtgtcagtcaacaggtgtatcgactgatgaggcgccttcgcgagcaagcccgctcccacatttggatctccacaaggtttcggctccatgcaccgcttcaatgcaccatgaactagcatcgcgcacggatccaacgcctgaaacacctgcctgattaacaaaatattaaaccgtaaaaacgccaaagccccgtattccggggctttgcgctttctggcaattttttttggcgagatttgcaaactctggcacgcgccctgcaacaacccttgtactacccagtttcggggaccttggtacaggcaggccgagaatcccctctttacacccggggtgcttgatgcgaacagcgtcgtgccccacacccgtttcgggaacctcggtacaggcaggccggggattccctctttaacaccgaagcctttggcttcaccccgttttgggagccctggtacaggcaggccgggaactcccttctttacacccggggcttatgcggcacagcgcccatagccccagcccgttttgggaaccttggtacaggcaggccggggattccctcttttattcctcgcgcagatggatctgcagccgccagcggccatcggccttctcccccttccactccccgcgcaacggccgagccgccaccaggttcagcagcaaaccgccatcagtcttgcgggtgcgccaattcacatccttgtcgttgaccttgagttgcccactggcggccatgccctgcgcgtcgaataacagcgccacggtgccgtcgatatgctcgccatgcagcttgggttcgctgttgaaccacaccaccaagccgtcggccgccgtctccacctgctgcagcgcgaccgggtccggcgtggtcaggcggccgatcatcaagccgatcatcaagccgacaatcgccaatgagcccatgacccgaggcataagcttcggtcttgggtcgtcttcaggggtagaatgcagcgcatctttgccttcggagccgtgcatgtttcacgtcatcctttttcaaccagaaattccgccgaataccggcaacgttatcaggctgtgcgccaacagtggctgccacctgcatttgatcgagccgctgggcttcgacatggacgacaaacgcctgcgccgcgccgggctggactaccacgagtacgccacgctcaagcgtcacgccgacctggccagttgcctggaaagcctgggccacccacggctgttcgcgttcaccaccaagggctcgcggccgtttcatgatgccagctttgccgaaggcgacgccttcctgttcggcccggaaagccgtggcctgccggccgaggtgcttgacgccctgcccgacggccatcgcctgcgcttgccgatgcgcgagggttgccgcagcttgaacttgtccaacaccgtcgccgttgccgtctacgaaggctggcgccagctgggctttaagtaacacacaaaacaaaatgtgggagctggcttatgtgagagccgggcttgcccgcgatgcaagcacctcggtgtgtcaggcacaccgcagtgaagctatcgcaggcaagccagctcccacataagccagctcccacattttttacagcgtcgacttactgaacggtcgacgaaccttctgtttgcatgcgctgcagttcttgcgcgtacagggcatcgaagttcaccggagccagcatcagcgcagggaacgagccgcgggtgaccaggctgtccagggtctcacgggcgtacgggaacaggatgttcgggcagaacgcgcccagggtgtggctcatggaggcttcgtccaggccctggatcaggaagataccggcctgttgcacttcagcgatgaacgccacttcttcgccgttcttgacggtgaccgacagggtcagcacgacttcgtggaagtcgccttccagtgctttttgacgggtgttcaggtccagcgcaacgcttggggtccattcctggcggaagatggccgggcttttcggcgcttcgaacgacaggtcacgcacgtagatccgctgcagcgaaaactgtgggccttggtcttgcgctgcttcagtgttctgttggtcagtcatcgcagatccttcttgatcttggggtcttttagggtttaggagtcagacgagcagcagcgcatcgagtttaccggcgcgctccagggcgaacaggtcatcgcatccaccgacatgcttgtcgccgatccagatctgcggcacggaggtgcgtcccgcttttttggtcatctcggcgcgcacttggggtttgccgtcgaccttgatctcttcgaaggcaacgccctttttctcaagcagagccttggctcgcatgcagtaagggcaataatcgctggaataaacgacaacctggctcatatcacttcaccagcggcaggttatcggccttccagctgccgataccgccggacagtttggcggcggtgaaaccggtcttgagcatctcgcgggcgtgggtgccggcgtgctggccttgggcgtcgaccagaatgatggtcttggctttgtatttttccagctcggccaggcgtgcgatcagcttgtcctgtggaatgttcagggcgccgacgatatggccggcggcaaaatccttggccgggcgaatatccacgacaacggcctcatccttgttgaccagtgcggtcagctccgacgtgctcaggctgcggccaccgcggctcatttcatgagcgatcagcagcgccagcaggatgacgaaggcacccgcgagcaggtagtgggcagtggcaaatgcaatcaggtgatcaaccatcaaggaggttccagggcgttaaaatggcggtaagtatacacagccgtcagggggggccaacccccgtaaagcggtgacgtggtcggaacttcgctttaaactgctactcccttttagattgccttcctttattaccgccgcgagaggatctatgactactacgcctaaacctttggtcctgataattctcgatggcttcggacacagtgaaagccaccacgacaacgccgtttactccgccaagaagccggtactcgaccgcctcaccgccaccgtacccaacggattgatctcgggttccggcatggatgtaggcttgccggatggccagatgggcaactcggaagtcggccacatgaacctcggcgccggacgagtggtataccaagacttcacacgcgtgaccaaatcgatccgtgacggcgagttcttcgagaacccgacgatctgcgcagcggtagataaagcagtcgcagccggcaaggccgtgcacttcatgggcctgttgtccgatggcggcgtacacagccaccaggatcacttggtcgcaatggccgaactggcgttcaagcgcggcgccgacaagatctacctgcacgccttcctcgacggtcgcgacacaccgccgaaaagcgcgcaatcgtccatcgaactgctcgacgccaccttcgctgcgctgggcaaaggccgcatcgccagcctggtcggtcgctacttcgccatggaccgtgacaaccgttgggaccgcgtcgcccaggcctacaacctgatcgtcgacggccaggccgaattcaacgccgccaccgcccaggaaggcctggctgccgcctacgcccgtggcgagagcgatgaattcgtcaaggccaccaccatcggcgagccggtgaaggtcgaagacggcgacgccgtggtgttcatgaacttccgcgccgaccgtgcccgcgagctgagccatgtgtttgtcgacgccggcttcaaggacttcgagcgcactcgccagccgaaagtcgaattcgtgatgctcacccaatacgccgccaacatcccggccccgtcggcgttcgcgccgggcagcctggaaaacgtgctgggcgattacctggcgaaaaacggcaagacccaactgcgcatcgccgaaaccgagaaatacgcccacgtgaccttcttcttctccggtggccgcgaagagccgttcccgggtgaagaacgcatcctgattccgtcgccaaaagtcgccacctacgatctgcagccggaaatgagcgcgccggaagtcaccgacaagatcgtcgacgccatcgacaaccagcgttatgacgtgatcgtggtcaactacgccaacggcgacatggtcggccacagcggcaacctggaagcggccgtcaaagccgtggaatgcctggacctgtgcgtcgggcgcatcgtcgacgccctggaaaaggtcggcggcgaagcgctgatcaccgccgaccacggcaactgcgagcagatgtccgacgagtctaccggccaggcccacactgcccacaccactgaaccagtgccgttcatctacgtcggcaagcgcgacctggaagtgcgtgaaggcggtgtgttggcggatgtggcgccgaccatgctgaagctgatggggctggagaagccgaaagagatgaccggcacctcgattctggtctgaccccgagaaacaccgcaagcccctgtgggagctggcttgcctgcgatagcatcaactcggtctatccgaagcaccgaagtgtccccatcgcaggcaagccagctcccacattggtttgtgggttttcacagatatctttttgccataccaccgccactcggcacctatcttgcctcccagcctgaattgggcgttttttttgccgcgcttggcgggcatactaggccgtccctttccctggtgtcgcccgcctctatgcttcgcgccttgattaccctcgctctagtctgcttgctccaaccggcgtttgccgatgagcgcgcacaaacccaacaacagttggacgctacgcgtcaggacattaccgagctgaaaaaactgctcggcaaactccaggaagagaaatccggggtgcagaaagacctgcgcggcacagaaaccgagatgggcaagctcgagaagcaggtccaggagctacaaaaagaattaaagaagagcgagtcggaactggagcgactcgacgctgagaaaaaaaaactccagagcgcccgcgttgaacaacaacgcctgatcgccatccaggcccgcgccgcgtaccagagcggccgccaggaatacctcaagctgctgctcaaccagcagaacccggaaaaattcgcgcgcaccctcacctattacgactacctgagcaaggcacgcctggcgcaattgaaggggtttaacgaaaccctgcgccaactggccaatgtcgaacaggaaattgccgaccaacagtcgcagctgctcgaccagaaaaccgccctcgacacccagcgcgaccagctggacaaggtacgcaaggaacgccaactggccctggccaagcttaatgaggacgtgaaggcccgtgacgccaagctgcaggcccgcgagcaagaccaggccgacctcggcaaagtgctcaaaaccatcgaggaaaccctggcccgccaggcacgtgaggccgaagaagcgcggcaaaaagcgctgatcgcccagcaggaagcggaaaaaaagcgccagcgtgaggccgaactggccgctacgacggacgcgccggcaccgcgtaaaccggcgcatgcagcccctggcccgctggtttcaagcgccggcgagaacttcggcggcccttttgcttcagctcgcggcaaacttccgtggcctgttgatggtcgattactggcacgcttcggtgaaacccgtggcgatgacacccgcgccaagtgggacggggtgatgatcagcgccgctgccggcagccaggtccacgccgtccacggtgggcgcgtagtgtttgccgattggctgcgcggtgccggtttgttggtgattcttgaccacggtaatggctatttgagcctttacggccacaatcagactttactcaagtcggcaggtgatgttgtaaaagccggtgaatccatctccactgtcggtaacagtggtggccaggacactccggcgctgtacttcgctattcgtcagcagggccgcccaagcgaccctgcacaatggtgccgttcccaaggatagggccgcatctacattaggagttcgttcgacatgctgcatttgtcccgcctcacttcgctggccctgacgatcgccctggtgatcggcgcgcctctggcttttgccgaccaggctgctccagctgcgcccgccgccacggcagcgaccaccaaggcgccgctgccgctggacgagctgcgtacctttgccgaggtcatggaccggatcaaagccgcgtatgtcgaacccgtagacgacaagaccctgctggaaaatgccatcaagggcatgctcagcaacctcgacccgcactccgcctacctcggcccggaagatttcgccgagctgcaggaaagcaccagcggtgaattcggtggcctgggcatcgaagtcggctctgaagacggccagatcaaagtggtctcgcccatcgacgatacgcctgcttccaaggccggtatccaggccggcgacctgatcgtgaagatcaacggccagccgacccgtggccagaccatgaccgaagccgtcgacaaaatgcgcggcaagctcggccagaaaatcaccctgaccctggtgcgcgacggcggcaacccgtttgacgtgaccctggcccgcgcgaccatcacggtcaagagcgtgaagagccagctgctggagtcgggctacggttacatccgtatcacccagttccaggtcaagaccggcgacgaagtggccaaggccctggccaagctgcgcaaagacaacggcaagaaactcaatggcatcgtgctcgacctgcgtaacaacccaggcggcgtgctacaggcggcggtggaagtggtcgaccacttcatcaccaaaggcctgatcgtctacaccaagggccgtatcgccaactcagagttgcgcttctcggccaccggcaatgacttgagcgaaggcgtgccactggcagtgctgatcaacggcggcagcgcctcggcgtcggaaatcgtcgccggtgccctgcaagaccagaaacgtggcgtgctgatgggcaccaccagcttcggcaaaggctcggtacaaaccgtgttgccgctgaacaacgagcgcgcactgaagatcaccacggcgctgtactacacgccgaacggtcgttcgatccaggcccagggcatcgtgccggacatcgaagtacgcaaagccaagatcaccaacgagatcgacagcgaatactacaaagaggccgacctgcaaggccacctgggcaatggcaacggcggagccgaccagccaaccggcagcggcgccaaagccaagccgatgccgcaggacgatgattaccaactggcccaggcgttgagcctgcttaaaggcctgagcatcacgcgcagccgttgatatgcgttttgccctgatcatcgctgtgctgtgcagcctggccggggtcgcccacgcgaccccggccagcgaaccgcataaagcctacctgaccctcatcatcgacgacctggggcaaaacctgccccgggatcgccgcgtactggccctgcccgggccggtaaccaccgcgatcatgccggacacgccccacgccgccgaattcgcccgcgaagcgcacaaggccggcaagatcgtgatcctgcacatgcccatggacccggccaccgggccgttcgcctggcacccggacctgccgatcgaagaactcggcaagcgcctggatgctgccttcaaggccgtgccctacaccgccggcatcaacaaccacatgggcagccgcatgaccgcccaacgggacgccatggcctggttgatgggcgagctgcaacggcgcaacaagttcttcgtcgacagccgcaccagcgcgcagaccgtggccgctgccgaagcgcagaagatcggcctggcgcacgtgtcgcgggatgtttttctcgatgacgagcgcaccgaagcggcgatttctacgcaactgcaaaccgcgatcaagctggcccacaagcaaggctcggtggtgatgatcggccatccctatccacaaaccctggcggtgctggagcgagagctgcccaagcttaaggcgcagggcattgactggattgatatcaagttgatgatcagcgtgcgtggcaaccaggccatggccgggcatggcaagaacggtcagtaccgttaaaagtgggagcgggcttgctcgcgaaggcggtggatcagtcagcctattcagtgactgacacaccgccttcgcgagcaagcccgcttgtatgctaggacttgaagggaggaggagggacaaagcccgattctgactgttacagcagtacaga

SEQ ID NO: 91 - DNA, 9082 bp, Pseudomonas poae FL10F
tgcgggaatagctcagttggtagagcacgaccttgccaaggtcggggtcgcgagttcgagtctcgtttcccgctccatatttaacgaaaacgccgatcagtaatgatcggcgtttttgttcgtgtcgattttttatcgggcaagactcaccagccccgtaggcttggtggtgaatctcgtaggaatggtctgtaattagcatctgccggctgtgtacctgtcccgctgtctctactctggccagattattctcactgttcatctcagagaactgcccagatgctgcaactcgatttctattcaaccttggtcgccgcttccctggtgttgttgctggggcgttggctggtgactcgcatcggttttttacgcacctacagtattccggaacccgtcgccggtggtttattggttgccgcgttactcctggcgttgcgcgcactggcgggcatcgaggttcgattcgatgcgtctttgcaaaccccattaatgttggcgttttttgccaccattggcctgaacgcggatttcgccagcttgaaacgcggcgggcgggttgtggggattttcctgctggtcgtgacggctttattggtggtgcaaaatgccatgggcatcgctttggccaaggcgttggggctcgacccattgatgggcttgctggccggctctattacgctgtcgggtgggcatggcacaggcgccgcctggggggcggtgttcagtcagaagtacggcgtggcctccgcctctgaactggcgattgcttcggcgacctttggcctggtgctgggcggcttgattggtgggccggtggcacgcttgctgatcaaacgcgtgcaggtgcctggccttgaacacgcgcaaccgcgcccggccaagggctttgaacagcccaatcaggaacgcatgatcacctcgttttcgtttattgagacgttggcgttgctggcgatcagcctgcaggtcggcacgttcctgagtggttatatccaaggcacggccttcgagctgccgacctttgtgtgcgtgttgtttgtcggtgtggtgttgcgcaacggcttgtcggcactcggctggcatcaagtgtttgagcgtgaggtgtcgttgctgggcaatgtcagcctgtcgctgttcctggcgattgcgctgatgtcgctcaagctctgggacctggcggcgctggcgttgccgattgtcatcctgttggccgcgcaggcgctattgatggcgctgttcgcgattttcgtgacgttccgggtcatgggcagcaactacgacgcggcagtgctggcagcagggcactgcggttttggcttgggcgccacgcctactgcgattgccaatatgcaggcggtaacacaacgcttcggcccttcgcagattgcgtttctggtggtgccgatggtgggggcgttttttatcgatatcaccaatgcggtggtgatcaagttgttcctggcgctgccgtttctgggcgcgtcgggctgaggcccggcgcattcaattcagcgcgtgagcatcctgttttggcatgaagaaacgcgcaaacagttcggactgcgacttgatgttcaatttgttgtaaatgttgcgccggtgcaccttgacggtttccgtcgacaggaacagcttgccggcgatctctttattagagaaaccactgagcaacaatttaagtacgtccttttcccgcgtggtgatctgggtgcccagctgaataatcgcttccgaccagagcggtggttcagtgaggtttttttccacatcaagctcaaagcacatgcgctggtgcatcagcgccatcacccacggcttgatgatatccagtgtggcgatctgctccgggctgaagcgcacgttactgccaaatgatatgcacagcgttctgtccgcatcgagctggacgttgtactgcacctcgtccacggacacatactgggcgaaatactggtggtaatactcagtcgtcaggaagtgctccggcgcgatgtcggacaaatggaaaaagccgctctgcgggttttcacggttggcgatgtagaacggatccagcaggtacagccctttcacataacgttccgtcagggcgtccacttcttccgcgtcggcaacctcggtcacgcacacaacgttgacctgttcattgctgaacaccagcaccacccagttatcgatctgcacatactcccttaacacgcgcaccagcgagctccagaaggctgggcggttcagctccatgatcagcttgccagccgatcggtgccaggccaggttatgcaggtcgagtgacatgttctacccctttagggttagggattcatggggccgagctaagtacttgtaggtatttactaatcggcgacgccgggtatattcaccagccagtgagtcgtggccatgatggcctgtcgtttttgacaaggatagttatatgagtcaatcacatttgcgagccctttttttggcctcgctggtctgcgtcggtatcagcgcgccggcagtggccgcagagtcacgggttaatctgtacaactggtttgggttgatcgcgccagagaccccaaaggaatttgagcaaaaaaccggcaccaggatgcacgtggacgccttcgacagcgccgaactcatgcagagcaaagtcatggccgggcgcaccgggtatgacgtcgtcgtcgccacctcgaatgtcctgccaagcctgatccaggcaggcgtgctcgcaccgcttgaccgcagtcagctgagcaactatgcccatatcgaccccgagatgctggccctgctttcggccaacgaccccggcaatcgctacgccattccctacttatggggcaccaccggcatcggttatgacgtggataaagtcaaagccgcattgggtgacaacgccccggtaaacagttgggatttgatcttcaaagaagaaaacatcagcaagctcaagtcctgtggcgtggcaatgctcgactcgccgagtgaaatcatttcgatcgcgttgaattacctcgggctgccaagcaacagccagaatcctgaggactaccagaaggctcaggcgctgttgttgaaaattcgcccctacgtcctctacttcgattcctccagaaccgacgccgactttgccgatggcaatatttgtgtggtcgtggggtgggcgaatggggcgctggcggcacaagctatcaacgaaaaaaaccacaccggccgcaagatcgcctacagcctgccgcgcgagggcgggttggtatggtcggagaattttgtgctgctcaaagacgcacctcacgcaaaagaaggcttggcatttatcaactacatgcttgagcccgacgtgattgccaaaagctccaatcacacgctttaccccaacgccaacaaggatgccacggtgtttgtagagcagaaactgcgcgacaacccgtgggtttatccgtccaaggagaccattgccacgctggtcccgctggagccgttgccgttgaagttggagcgcatccgcacgcgcgtgtggaccaaagtgaagagtggtacgtgatcgggtgagtaaagtcccagagagggagataaagcatgggccaacgtgattaccagtgcgacgtgaaatcggacgactaccaggcgtacaaggaaatcgaagagcagatcggtcactgtacgccggaacaagcctgggccatgtattacgtctccaccgggatggtgcgtgaacacgtgacgcgagcggtcatggagcacatcggcaggggcaaccgggcactgctgctggaatttcccgaacttgcccggcaggaagagaactctcgtttaatgctccctctctgaacgctgtaaccccccaaacgccgatcactcctgatcggcgttttttgtgcgcgtgtttcaacgggcgttcatggcccgcgccaggcgcagtgtggcttcacggatctcgtcccgatccagcgaggcgaagcccaggcgcagtgcattttccggcaggttcatcggcgaaaactgccgcgcgctgcgcaccacaacgccgtggcccagggcattttctaccaactgatcgacgtcggtttcatcctcgaaacgcacccacagtgccaggccaccttccggttcgcgcacctgaatgcgttcgccgaatgccgcgtgcaggcagccctgcagcacctcccgacgcgccgcgtattctttcgaaacccggcgcaggtgtttcttcaactcgccctgattgatcaggtctgcgagcatcttctgcgccaccgcgtcggtgtcgcccaccaccaaagcggcgctgcgctgcagcacctcgatcacactggcgggggcgaccacataactgcagcgaaacgtcgaccccagcgccttggataacgaaccgatatagatcacatggcgttgcgcgtgatcactggccagtggcaggtacggccgcccattgaagtgatattcgtggtcgtagtcttcttcaatgatgcagaagtcatgcaaggccgccagggccagcaagtgttggcgccgcgccgcatgcaggctgacggtggtggggaattgatgatgcggtgtgaggtagatcatccgcacgtcatgcgcctggcataactgctcgatgtggtcggtgcggcagccttcatcgtccatgtccacggtgatcaaccgcgcgcccagcttgcggaaaatctcccaggccggcgggtagctcaggcgctctaccagcaccacatcgccgggcttgatcagcaagctggcggtcaggtgcagcgacacctgggtgccgggcgtcaggcagatattctcggcgctgaccctcagcccgcgcgtgttgcgcagcatctctgccagcgcgcaacgcaactcatggccggtgccttcactgccgtagcgcacgctgttggaggcaaaactgctgcgcagggcgttgcggtagtaacgatgcaacaccgcctggggcagcaagcggtgatcgcaggcgccgttatcgaaaaacagcgcgtcatgccggtgttcgagggcgatgacctgggcgttctgggtgaaatacgggaccacagcttgcgccagaagcggcggtgcaaacgacggttgcacaccactgggcagtggcgtgggggccagttgcgcattgacgaacgtgccgcgccgcggctcgctgaccagccagcctttggtcaaggcttcttcgtaggccaggatcacggtcttgcggttgacggcgagcaaggtcgccatctcccgcgtgccgggcagcagagtgccgggcggcaagcgcccctcgaggatcgccacgaccaggccttcggcaatttgccggtaggacgcctggcgtgcactcgcatccagcttgagcaacgggcgccatttacgcatctggaccatctgaagtatccaaaactggaggttctaatgggcctagtctagcgcaacaatcaagcctcactcacccctgaggtttttatgcacacacgccatgtaatcgaactgtctccctcggggaaaacctttgaagccggtgacgaactgttgctcgacgccatgctcgccagcggcctgtcggtgccgttctcgtgccgacgcggtgcctgtggctcgtgcaaggtggtggtcacgcaagggcagtaccgggccaagcaactggcgcccggcgcacccgcgccttgttacccgctggcggcgaatgaactgctgctgtgccaaagccacgcctgcgccgacatgcgcctggagattcccggttggtcgctggacacgcctgcgctggtcgtcgaggcgacggtgctgagcaagcgcgcactgagccccgacatcatcgagttggtggtgatgccggataggccgctggccgtgcgggccggccaatacctcaagttccgcctggtcgacggcgactcacgctgcttctcgatcgccaacctgccggccgagggcgatggccgcctggtgtttcagattcgccgtgtaagtggcgggctgttctccgagaccctgctgggcgaccttgaggctggcgatctgctgcaactggaagggccgtttggtgcctgcacctggcaggacgatgacgctgcgcccgtggtcctgttcgccacgggcacgggctacgcgggtatcaagccgatcctgctgaccgccttgaaacgtgacgtcgaggtgacgttttactggggcggcgcccaggcgagcgatttttacgaccgcgcctttctggaccaggcagtcatcgaccatccgcattttcgctggcattcggtattggccacagaagggcgtgtgcaagaagtggcgctgagccatgggcacgcctgggaagcggcgcaggtgtatgcctgtggcaacggcgcgatgatcagccaggcgcgtgcgaattgcctggaagcgggcctgccgagccatcgttttgtcgccgaagccttcgtgcccagcggccggtcgagcgtcgatacgttactcggttcgctggatgaaacctgggaaaaagtcggcccccgctattcgctggacggcatgctcgccgcgcgggacaaaaccgtgcgagcgctggccgccatcgccagccagttgaaggtcggcatgaccaccggcgccgccctggaaatggccagccagcaattgcaggccatgggcgcctcgcacacttggcacccgacttacatccgctttggcgacgacacggtgcgtccgtcccgggaagggattgacccgctgcgcacactgcgcccgagcgacattgtggtggtggacctggggccggtgtgggacggctacgagggtgactacggcgacaccttcatcttcggcgaggcgccgttgcacctcgagtgcagcaaagtgctgcatgaagtcttcgatgagacacgcgaagcctggctgcgcggcatgaccgggtgtgaactgtatgacttcgccgaagcccgtgccatggccaaaggctggcggctgtcacgcaatctggccggtcaccgcctcgcggatttcccccatgcgttgttcggggacaaggagctggctgacttggcgatcacccccagcgaaatggtgtgggtgctggagatccagatctgtcatccgacgttgcccatcggcgggttcttcgaagatatcctgatgcgatgagcccgccattgcggcgggctcagagggcgtcagagcttcggcagttgcccgacgcggccgatcatttcagtgacgatctgcaggtccagcaggaactggtcgacggtcttgaactcaccgtcggtgtgcccggtgtacttctgttccgggcgcgccaggccaaattgcacgccattgggcagttcatgcacggacgtggcgccggcggaggtgccgaacttgtgttccatgcccaggttttcagtggccacggccagcagagccttcacccattcgccttccggattgcggtacatcggcgcggccaccgagtaagtgaagctcacgttgaccttggatttcttgtcccaggcgctgagcttgtcggcgatttgcgccttgagtgtgtccggcgacttgcctttcggcacgcgcaggttcactgccagcttgaaggctttggcatcctggccgacaaaggtcagcgaggtggtcagcggccccatgaagtcgtcggcgaagcccacgcccagtttgccgcccaggtaatccaggccccagttgtcggctgcataacgcgcggcgtcggtgatgtggttgtgcttgagggcaattttgccgtcgacgccgtggatcagctccagcatgcgtgccaccgggttgacaccggattgcggcgcggacgagtgcgcggacacgccggtgacggtcagcttgacctctttgccgacgaccttggcatcgacagcaaagtcgccgccattggccttgacgtaatctgcaccggctttctgcaggctggcagccagttccgcgggcttgtcgctgaccagggtggccaccgacaccgaaggaatctggttggtcgccgcgccaccggtcatcgagataatttctgcgccttttccttcacctttgcgcaccgggaaggtggccatgacggtgccgtagcctttctcggcaatcaccaccgggtagccgccgtccagcgccaggttgtattgcggcgtcgggttgtgttcgaagtagtaaggaatcgcgtcgccggaggtttcttcggtggtgtccaccagcagcttgaaattgcgcgccagcggcagcttttcttccttgatcaccttcatggcgtacatcgccaccacgatgccgtttttgtcatcctcggtgccacggccatacatacggtcgccgatcagcgtgaccttgaacgggtcgagcttggtgccgtccttgagcacccagttttccggcgtcaccggcaccacgtcggcgtgggcgtggatgccgaccacttcatcaccgctgccttccagggagatctcgtagacgcggttgtcgacgttgcggaagttcaggttaaaggccttggccaagctctggatcttgtcggcgatcttgaggaattccgggttcttgtactgcggcaggccgtcgacattgaaggtcgggatctcgaccagctcgcgcagggtttcgagggcggccttgccgtatttaacgcgggtgtaaatacccagcaggcgattgatttcgttctgctggtcggcggtcagggttttgttggcgagaaaggcgtcgatggccgggccgacgtcagcggttttgcccaggtcgcccttggccacggtgccgaggaaaccacggaaatcggtgaccgacgtatcgctgaagtgcttgataatcgcggtgctttgttcggcgctgatgttggcgaaggcaggcgcggcgagggtcgagaggccggcggcgaacaggctggcagccaccagttttttgagtggaaagtgcattgctagaggcattcctttgcaaaatgggagtgggaaatttctgatcgaaatgtcagaaacaatttcacacactaccatcaccaaggagcggtaggggagagctggatgaaggaaatgtccgacttaaatttccgaactgtagagattcaaatgtgggagcgggcttgctcgcgaaggcggtgtgtcagtcgaagtaggagctgactgacacaccg

SEQ ID NO: 92 - DNA, 7416 bp, Pseudomonas poae FL10F
gggcattcagcttgccactcaccgctctcaacctcagtttaaacctggctcaagacacaagcgggcttgctcgcgaatacggtgggtcagtgacacatgagctggctgatacaccgccttcgcgagcaagcccgctcccacaattagaccgagttcggccgccagtcttttgcgctctgcttttctgtgggagctggcttgcctgcgatgcaggcacctcggtgtatcaggcacaaccagttgatgccatcgcaggcaagccagctcccacatttgattgaggtcagcttccaaaatcaggtcggctgccaggccgcctcggccttgcttttgatctaaccactcaggtcggctactaggccgccgtgctcttgcttttgatcttgatcttaggcgccccgttaaaccacgctggccgaacgcaggctttggagcgggggtaaaccggcaggacgccggtttagccgcgctgggccaaggatggcccatcgcggcggcccccgctccaaagccggagtgagggcacaccgaagcgtgagcgaggtgccgagtggtggggcaagagcccttttggttacttttggctgggccggcattccgggctcttttccaaaagtgacccgccgtaagggcggaacccatctcagccctaacctaaataacggatatgtacccaacgcccccaagatcaacctcaacccttacccggcccattcccgatctgccacacaaacggcggctcagccccattaatcacccagtcccccacaatccgcgccttgtagatcaccggattatgcgaagacaccgtccgcgcattccgccaatggcgatccagcgctttgccctggcgcacatccgacgccccaagcgcattaaacaactcggtcgtcgcccgctggatcaacgcggacaccaccacctgcgccgtcgccgattcaatctccgccgccacattcgcttcacgctcagccgcctcatccccagcaaaccgcgccaggtacgcccgttgcgccggcacagcagccttcaacgcactggcctcagcggcatacaccagcgccgccacatcccccaccacctgttgaacctgcgcatcctggctgacatgcgcagcattcccatggctgtaaatgcgcttgcggctgcgcacctgatgcgccacgtcattgagcgccgcgcgaccaatcccggccaggctcgccagcaacaccaactggtaaaacgcggtctggtatttaaaccgcgtggcaaagtcgatcacgttttccgcttccaccacagcatcggtaaaccgcgtggtgccgctgccggtggtgcgctggccgaagccgtcccaatcatcgctttgcaccacgccaggttgacgcgtgcgggtggccgcgatcacatcgccaccggtgtcgctgcgctgcgcgtacacgtcgatccagtcggagaacaggctgccggtgctgtagaacttttcaccgttgagtttccacgtgtcgccgtcagggctgacctgggtgaccacatcaccgatggccacgttgccgatttcggtccaggcgcagccgacgatatcgccgtcgacaaaacgcttgaaccacacctcacggccggcgctcggtggcgcgttcaggcggtcttcggcgaaggcgaaatgcccgcgcaaggcttgcggcacattggagtcggcggccgccagttcgatcagcaactcgaacagctgcggcagcgatgcgccaccgccaccgtattccactggcacccgcaccgcgccaaacccggcgtctttgagccattggatcggttcgtagggcagggtacgcgtgtgttcgcgctccaccgcgccctcggcgatgcgctggaagatcggccgaaagcgtgcggccaacgtggggtagtcgacgccggtggacagcgggttgatgacgtgttgctcggtcatggggacggctccttggcagtgatcaatgcttggggtgattgcacagtccgtgccggacccttcagcccgtatttgcgggcgaagggctgcggacactgttgctccagcaacagcagatggacaaaccggcgcgatccctgacatcaaaggctcggcagttcaaccttgcgttcagggccgagacgcccatggccagggcctttgccggtgcctggcacgcttgctgctcaagccctgggtacatcccttcgtgcgaggtactgccagatgagtcagcaagccgtgaaatttgcctattgggtgcccaacgtcagcggtgggctggtggtgagcaagattgaacaacgcacccattggggcatcgattacaaccgcaaactcgcgcagctggccgaagcggccggctttgaatacggcctgacgcaaattcgcttcaccgccggatacggcgcggaaaaccagcatgaatccgtggccttcagccatgcgctgctggcggcaaccaccacgctcaaggtgatcgcggcgatcctgcccggcccgtggcagccggccctggcggccaagcaactggcgaccatcgaccaactcaccaacggccgtatcgcggtgaatatcgtcagcggttggttcaagggcgagttccaggccatcggcgaacactggctggagcacgatgagcgttatcggcgttccgaggaatttatccgcgcgctgaaaggcatctggacccaggacgatttcaccttcaaaggcgacttctatcgtttcaacaactacaccctcaagcccaagccactgggccagccggaagtgttccagggcggcagttcgcgggcggcgcgggacatggccgcgcgcgtctcggactggtatttcaccaacggcaacacgccggaaggcatcaaggcccaggtcgacgatatccgcgccaaagccgccgcgaataatcattcggtgaaagttggcgtcaacgcgtttgtgatcgcccgagacaccgaggaagaagcccgcgccgtgctcgccgaaattatcgacaaggcggacccggaggcggtaaatgcctttggcgatgcggccaaacaggccggtaaagcctcaccggaaggcgagggcaactgggccaaatccagctttgaagacctggtgcagtacaacgacggcttcaagacaaacctgatcggcaccccgcaacagattgccgagcgcatcgtcgcgctcaaggccgtgggcgtggacctggtgctggcgggcttcctgcactttcaggaggaagtcgagtacttcggcaagcgcgtgttgccgctggtacgcgagctggaagccaaggccgggatcaagcaggtggcctgagcctttaccgagtgaagagcaccaccgccgcgcgcaacttgttgttgccaaaccggcacattcgttcgaactccgcgtggctgaccggcaagtgctggcagtccagcggctggcggtgttggctgtggtccacgtccgggtcgtgcaggtagacaaagtcgtcgtcgcaatcggtgaccatcacccaatgcggcgatttggagcgggtgaggcggtagctgctgatcaacaccagcggctgcccgccggcctgcaaaacctgcggtaaatccagtgcgccgccgagcacctgctcgacgtcgctgcccgccagttcctcctcaaacgcctcgtgcaccaggcgcatgacgtcctttttatgctgatcgcgcacgccatccagaaacagcggcccgcgcacattcacctgcatgcgcacccgaaagccgcgacgccaggccgccagcgccaagccttgcgggctgcagccgccgtggccggcggtcatgaacacggtggttgcttcacgccagatttgcagctcttcgcgccgcccagccacgcggcccggcaccagcgcgcccatggccatcagcaggcacgcggcgccgcaggtgaaatcggtggtctgctggtaatacggcacgctttgcgggcgggcgtgctgaggctgcacgatgcgtttttccaggcgcagggccggggcgtggtcttcgtagtagtcgttgatcagcgcaaagcgccggtagccagtgcgctcatacagggcgagggcgccggggttgtcggtgcgcacttccaggcgcaggtaggcgcaatcatgcgccaccgcgcaggcttcgatgcgcgccagcaactgtttgcccaggcccatgccgcgcgcgtgttcggcgatggcgatggaatacaggcgtgccagcgaggtgccgcgatggaacagtaccaaggcgtaaccgagcaaaccggcgtctttttcggcgaccagcaactggccatgggcgcggctgatcatccactggaagctgcgcggcgagagccggtcggtggtgaaacaatgctgttccagtgccaccaattcgggcacatcagcgggggttgcaacgcgaaaggaaagagccatatgaccgccgtaaaagttgcgtaacgaaacgggacttctctaaaagatcgtgcttaatagaaaaggtcgagttctctaaagcggatcaaatattatgtcggcggtacaaagtcattggcgtgaagtatccgagcaaactgtcgcggcgacaataacttccaaaggttatttttctccacctcttaaaggctccagtcaagtcgtgatcattgtcgagcgcaaggaagattgggcctcctatttccccagcgaagacatcgtcaccgcccaggaatacctcgagcaaacccgcgagaacgagacgggcaagcgcgtgcaggtgatcaacctgtgccgcagctacaagtacctggggcacggttactactgctcgctgctggccgaggcgcgcgggcacaaggtgattccgtcggtgcgcaccatcagcgaactgaccaaaaagtcgttgtatggcctgtcgctggatgacctggataaaaccctcgataaagccttgagtcatcacctctacagcaataccgaaggctttaccctgacactttattttggccgaaccaatatagaaccgttgcaggagttggcccgccagttgtttgaaacctttccgtgcccgatcctgttagttgagtttcgcaagaataacggctggcacatcgaaggggtcaaatccggcgtgctgcacaagttgcgcgatgaccaggaagaccagttcgcccacgccctcgacaacttcagccgcaagatctggcgccaaccgcgctcgcgtcgtttggcccgttatgacctggccatactccacgatccccaggagcaactgccgccgtcgaatgccaaggccctggaaaatttcgtgcgggtcggcaagggcttgggcattgatgtggaactgatcgagcgcaaggattactcgcgcctggccgaatacgacgccttgctgatccgcgagaccaccagtgtcgacaaccacacctaccgtttcgccaaaaaggccgaaagcgaagggctggtggtgatggacgacccggcgtcgatcctgcgctgcaccaacaaggtttacctcaccgacttgctcaacagccatcaactgggcatgcccgccaccgagattctgtacaaggagcgaccggaagatttcgaacgggtcggcgaacgcctgggcttcccgctggtgctgaagatccccgacggttgcttctcgcgcggtgtgatcaaggtggaaagccaggcggcgttgctcaaggccaccgccgagttgttcgaacattcggtgctgttgctggcccaggagtttttctacaccgagtacgactggcgcatcggcgtcctcaaccgcaagccgatctttgcctgccaatatttcatgtccaagggccattggcagatctacaaccacaaggccatcggccaggacatcaacggcgaatgccgcaccctggcggtccacgaagcacccaaggcggtggtcgagctggcggtgaagaccgccaacctgatcggcgacggcctctacggcgtcgacctcaagcagtccggcgacaaggtggtggtgatcgaggtcaacgacaaccccaacatggacgccggcatcgaagacgcctacctgcaagacgacctgtatgccctggtgctggaggagtttgtgcggcgcctggagttgaaacgccagggccaggtgtggtgacgcgcgatgatccagcgctatgaattaaccgatggcaagctgcgcagtggcgagggcgatgacgccccgatcatgttattcaacaaccccgaccaggccgagcgtgagtggctgcgcgaccaccataagctggatgaacatgccctggcctcggcgctcgacccggatgaagtatcacgcatcgaatttcacccggacaacctgttcctgatctggaagcgcccggagaactattccggcggtggcaacctggtgtttgaagtgtcgtcctgcgggctgttgttttcgccggaccgcctgctggtgattgccaccgatgaaaccccgttgtccgggctcggcgcacgccggccgctgcacacgccgctggatgtgctgctcgatctgctgctcaacaacatccatcactacctgggccacctcaaggtgataaagctggtggcgcgggagttgcagcagcagttcaacgcctcgatgagcaaccatcacttgatgcagatgttcagcctcagcgagagcctgatctattacatcaacgcgctgcacagcaatggcgcggtgctgtcgcgcctgcgcaaccacgcggaaaaggagcatttcagtgccgagattctgggcctgattgatgacctgatcatcgagaatcaccagtgctacaagcaggcggagatctattccaatgtgttttccgggctgatcgacgcgcgcggcaacctgatgaacaacagcatgaacaacctgctgcgcaagctgacgttgattaacgtggtgttcctgccgcttaacctgattgccagcgtgggcggtatgtcggagttcagcatgatgacggcgggcacgccgtggtgggtgtcgtacccgctgtttctgctggcgatggcgatgggggctggtttgatggtgcttgggcttaagcggattgcaggcggcgccaatgtcgtgtgaaggctgatcaactgtgggggctggcttgcctgcgattgcggtgggtcagtcagcaaattgtcgactgatgtttggcagggccgctgggtacatatccgttatttggatcacggctgctatgggttccgcccttacggcggccccgctccaaagcctgcattcggccagcgtggtttaacggggcgcctaagatcaagatcagaagcaaagcacggcggcctggtagccgacctgagtggtagaagcaaaagcacagcaagagcagggcaaaagcacatctagctgatgtactgagatccaaaatgtgggagcgggcttgctcgcgaaggcggtgggtcagtgacacatgagctggctgatacaccgccttcgcgagcaagcccgctcccacaattagaccgagtt

SEQ ID NO: 93 - DNA, 5170 bp, Pseudomonas poae FL10F
cgttcaactgttcgggctcaatgaccagagtggagaggtgagtggcagcatgggctcccacacgtgctttaagcaccacgggcattcagcttgccactcaccgctctcaacctcagtttaaacctggctcaagacacaagcgggcttgctcgcgaaggcggtggttcagtaacagccaagctggctgacccaccgccttcgcgagcaagcccgctcccacacgtgtttgtgcctgaccaacatgtcgcgcccgccgccgttcaaatgtgggagccgggcttgcccgcgatggcggcgtgtcagcaccgaatttatcgactggcacactgctatcgcgggcaagcccgctcccacacgtgtttttgcccgaccaacatttcgcgcacgccgccgttcaaatgtgggagccgggcttgcccgcgatggcggcgtgtcagcaccgaatttatcgactgacacactgctatcgcaggcaaaccagctcccacacttgtttgtgccggaccaacatttcgcgcctgccgccgttcaaatgtgggagccgggcttgcccgcgatggcggcgtgtcagcaccgaatttatcgactgacacactgctatcacgggcaagcccgctcccacatttgttttgtggtggtttttagaggtgggtgctgagccaggagacggccagcgccagagcgaggcaggcaaacccgacgcggtaagccaggcgatgcgcccgttcggtgcgcacatccagaaacaacatcggttggtcgatagcgcgatcttcgctttgcgcggtcaggtcggccagcgcacgttgctcgcgtagacgggtaacgaacagcagcgctgcacccgggcaggccaccaataaagccacagcattgatcagcagtgcggacagcgccatcgcgaacctcagtcggacagtgttctggtatcaattcagatacaaacctgaatgatattggcctcctgccgctgaaacgttccgtcccccatgtacgattaatgtatccattaatttacagcgtcacctgaacgtcaccttaacaagccactctgttgcccttcgaacgctcaggagctcgtcatgttgcatgcgcaaaaccaggatcggctgtatctgatcgccccgacggatgaacaggaggcgcttgtcggcggcttggcgttcaacgttcaggatcgccactggctggtgtattgcgcgctgggtgggcaccagcatgccgacctgccggagctggacctgctcaccggcgtgagtgtgctggacttgtatgtcgaaacggcggcatgaacgttacaggcataaaaaaaccgggctcatcactgagcccggtgatcgttcccacgctctgcgtggtaacggcgatcggggcgctccgcgcccgcccgacggttactgcgagctgagaagcgaaccgatgctcgggtctttgaacaaacgcgtcagcgcgtcgctcaacacgtcactgaccagcttggtgttggtttcctggttcggcgacatgccaaaacgctggttcagcgaggcgccgtagcggccactgtagcggcgcgtaccggcactgacgtcggacttgaacgtcgcgccaatcgcggcttcagtcacgtacaggccttccttgggcgactggtacttcagttcggccagggtgatcgtcaattgaggcgcgcccggcgagttggccggggtgaagcccagcaggcgcacggcggcttcagcctgggcttgcagcttgggcaacacgtcctggccttgtaccgaaatcagcgcagtctcagggtacaggccgccgcgcgagcccagggtcggcgacggacgaccgtctaccacacgcaccgataccggctgaccgtggccgacaggggccaactgcgcggtgactttaggttgcgggctgagttgttgcgggctgttggcgcagccaaccagggtcaaactggtcacagtgatcaaaccgaacaacaggcgttgcaacatactcatttctccaggactagatgcaaacaggccgccagtataacggtgcacacgcgccactcaccagccatcctgaacggcagctgaaggcgggctcaaattacaatttcgcataaatccgtcatttcaatgtcatggcacactggcaaccttcaagcatgtaacgtaacaggtacaaagccatgcgccttctcaagtcattgttcatgcctcgcggccgtcatcggcactatgccctgctcgattgccatggccattgcctggcgttcaaacagtgcagcttgccgcccgtcggcgacggctgggtggaggtcgcagagacgcacctgggctggatgcaccgtccgctgccggcaagcgcccggatcagcccgaaggttgcacacgcgcaaacccggcatgcgttggcctcctgaccgagacgctaataaaagtcataaaacacgcccatttccctgacgttcttcgctacaatctccccccgattataaggacgtctcctgatcgggcctcgcagcatcgttaatgcctcggcattaaccccaaaatcgcccacagagagccgcccacacagatcgagtgaagctggcgcgcttgctgttttctttgcaaacctcccgccttaccgaatctgccagagctgccattgcgctcggccacttgagttgtttgcccgttttgccgcgtgtcggcagaggtttgcgggccaggtgccaggctggggcagcccttttttgaggttcacgtcttcaaaagagcgtgaaaaaacgggttttcacaacttcacaagagtgtggcgagcaaatgaatagtttggcgtttgtacaagcaccatcagcgtctggaacagcccaaccaaacaggaccgagtactcctcaaaaaccggagcttgagcctgtccgctacggattggttgcacaaatcacacgctttgaccataagtcgaattgccacaggcgcccatgaatgcgttcataggcagattagcccggcaggaagcgtgtgctgaagatgcaaagaattgcgaaacggacatggcgatcctggccatgggtaacctggggcaacacgtgaaccgccccgtcactcctggcagccatgccgtcaatttggtgctgcagattttggagacgcgttaaatggcgcataacgaagcagtcgacgtagttctggtaggggccggcatcatgagtgccaccctggccgtactgctcaaagagctcgaccccggcctcaagctggaagtcgttgagctgatggattcgggtgccgcggaaagttccaacccgtggaacaacgccggtaccggtcacgccgggctgtgtgagctgaactacacgccgcaggccgccgatggctccatcgacatcaagaaagccgtgcacatcaacacccagttcgaggtgtcgaagcagttttgggcgtacctgaccaaaaaaggcacctttggctcgtccaaatcctttatcagcccggtgccgcacctgagctttgtgcagggcgaaaaaggcgtttccttcctcaagaagcgctttgaaaccctcagccagcaccacgcgttctcggatatgcactacaccgaagaccgcagcgaaatggccgagtggatgccactgatgatgccgggccgcccactcgacgaaaaaatcgctgccacccgcgtgatgaatggcactgacgtcaactttggcgccctgaccaaccaattgctgtcgcacctgaccagcgcaccggatgcccaggtcaagtacagcaagcgtgtcaccggcctcaagcgcaatggcgcaggctggaccgtaagcatcaaggacgtcaacagcggcaacagccgtgaagtcgacgccaagttcgtgttcctcggtgccggtggcgcggcgctgccgctgctgcaagcctcgggtatcgaggaaagcaaaggcttcggtggcttcccggtcagcggccagtggctgcgttgcgacaacccggaagtggtcaagcatcaccaggccaaggtctacagccaggctgcggtgggttcgccgccgatgtccgtgccgcacctggacactcgcgtcgtcgacggcaaaaaatccctgctgttcgggccctatgccggtttcaccaccaagttcctcaagcacggctcgttccttgacctgccgctgtcgattcgcgccggcaacatcggcccgatgctggccgtggcccgcgacaacatggacctgaccaagtacctggtcagcgaagtgcgccaatccatggagcaacgcctggaatccctgcgccgtttctaccctgaagcgaaagccgaagactggcgcctggaagtggccggccaacgggtgcagatcatcaagaaagacccgaagaaaggcggcgtgctgcaattcggcaccgagctcgtcgcggccaaagacggctcgctggcagccctgctgggcgcgtccccaggcgcttcggtgacggtgtcgatcatgctggaactgatcgagcgctgcttcccggaaaaagccgccggtgaatgggcggccaagctgcacgagatcttcccggcgcgggaaaaagtgctggagacggatgcggagttgtatcgcaagatcaacacgcagaacaacatcagcctggaactggttgagcaaagcaacgaagccgaaagctacgcttgaggacgtgacgcagagcgtcacaggacgcactcccacgcagagcgtgggaacgatcaaaaaaaacgcccctcggggcgtttttttatgtctcgcgtaatcagccgcgggctgctttgatcaattcgatgtactcatcggcgttgcgctgatccttgatcaggtcaacgaaggtctggccatgctcgtccttgccgtccaggtccaggccggcttccttgaaaaagcccaggaaccgctcaaagtcatcgatacgcaggccacggtaggccttgatcagcttgtgcagggacggtgaagtcgcgtcaaccggctcgaagtccaggaacaacttgatctggtcgtcgccgatctcgtcaccaatcacctgtttcttatctttacgcattaccgactccagcctgcagacatttacacgggaaacgcagtttacctgcggcgctctagcttcggaagcgacgcagaaccaatgtgggagcaactgtcttgatggcttttttccaagctgctgttccagagatgacagtgcccccacagcagtacac

SEQ ID NO: 94 - DNA, 2931 bp, Pseudomonas poae FL10F
ctgcgatagcggtctgtcagccaacccacctgtgcctgacacaccctcatcgcaggcaagccagctcccacagtgattcggtttcgccagcgaaagtcagtcaacaaaaaagccccacccagctcacgccaaatggggctctgcaccacctaccccgccttacgcgacgttcatggtcttgtgcgtttcaatcaaatgcgccaccacacctgggtctgccagcgtggagatatcccccaacccgtcatactcagccgtggcaatcttgcgcagaatccggcgcatgattttccccgaccgcgtcttcggcaagcccggcgcccactggatcacatccggtgaggcaatcggcccgatctctttgcgcacccagtttttcagttccaggcgcagcgcttcgtttggctcttcgccgtttttcagcgtgacatacacatagatgccctgccctttgatgtcatgcggcacgcccaccaccgccgcttcggcgactttcgggtgcgcaaccatcgcgctttcaatttcggccgtgcccatgcggtggccggacacgttcaacacgtcatccacgcggccggtgatccagtagtagccgtcctcgtcacgacgcgcaccgtcaccggtgaagtacatgccacggaacgtcttgaaataagtgtcgacgaaccggtcatggtcgccgtacagcgtacgcgcctggcctggccacgaatccagaatcaccaggttgccttcggccgcgccctcgatcaggttgcccaggttatccaccaacgccggcaccacaccaaagaacgggcgtgccgcggaacccggcttgagcgcgtgagcgcccggcagcgggctcatcatgttgccgccggtttcggtctgccaccaggtgtcgacgatcgggcaacgggattggccgacgttcttgtagtaccagtcccaggcttccgggttgatcggctcgcccaccgaaccgagcaggcgcaggctgctgccatcagcgccttccacggcagcggtgccagaggccatcatcgcgcggatcgcggtcggcgcggtgtagaggatattgaccttgtgcttgtcgacaatcttcgccacccgcgtgatatccgggtagttcggcacgccttcgaacagcagcgtggtcgcgccattcgccagcgggccatagacaatataagtgtgaccggtgacccagccgacgtcggcggtgcaccagtagatttcgcccgggcggtagtcgaacacgcgctcgtgggtcagggccgcatacagcaagtagccgccggtggtgtgctgcacgcctttgggtttgccggtggaaccggaggtgtagaggatgaacagtgcttcttcggcgcccatctctttcggcgcacacacggtgcccgccactttcatcaggtcttcgtaccagatgtcgcgatgctggttccacttgatgttgccattggtgcgcttgcacacgatgactttctggatgctgctggtttccgggttggtcagcgcgtcgtcgacgttggccttcagcggaattttcttaccggcgcggatgccttcgtcggcagtgatcactaccttcgacttacagtcgatgatacgaccggccagggcttccggcgagaagccgccaaacactacggagtgaatcgcaccgatgcgggtacaggccaacatggcgaccacggcttcggggatcatcggcatatagatagtcaccacgtcgccgcggtgcacatcctggccgcgcagggcgttggcgaacttgcagacttgttcatgcagctcgcggtaggtgatggtgcggctttcggaagggtcatcgccttcccagatgatcgccgcctgatcgccacgctcggcgaggtgacggtcgaggcagttgtaggaaacgttcaaggtgccatcagcgaaccatttgatgtcgacatggtggtcgtcgaaagaggtctgcttcaccgcggtgaaaggcttgacccagtcaaggcgcttggcttgctcgcgccagaagccatcggggttgaccaccgactgctggtacatggccttgtaggtcgcctcgtcggtcagcgtgttggctgctacttcggggcgaacggggtacagggaagccgcactcatctttcttacctcggtgacaatagttgtttttgtatgccctgttgtagccggggcgcccccatagaaccattcgacgatggtagtaacaagcccctacaaattgccctgccatgccgatttacggctctggcccgcgccctgcgcggatttcacgcttgatgaaaaaacctttaccacgggattgttacaaaaaccgccaatagtgtttatcaaaagcacgggtatatgaatataacgcgtgcgcctaaaatcaacgccgtcaacaagacactgtgattaacaacgtaacagcccccacgaaggcaacgttaatccgaacttcccaactcttaagttacacacgtggcctcacaagggccccgtgacccctttcgccctgaagaaggtaagtaaagaaatgaaagctctcgtagttatggccctcagcagcttgtgcgccaccgccgccctggccgacgaggccccgaccgagctggccggccagaacgccccgatcgttgaagattacacctacagcacacacttggatgtggccaaagtattgtccatgagtactgttccggaagtctgccacgttgtaccggtacaaatggaatatgaagactcacaaggtcaacgtcatattcttaattaccaggtaatgggtaatggttgttctaacgggtaatagtgattgaaacaggtttaaacccggatcttggtcgccgcaagaaatcgttcttgcggccaagaacctatctgcaacccaccacgctataaaggtgggagctggcttgcctgcgatggcaatttcagcctttttacaccgcccaaaac

SEQ ID NO: 95 - DNA, 2423 bp, Pseudomonas poae FL10F
aatccagatattggtcgttacctgacacctgacccggtgaagctggcgggtgggatcaatgcgtaccagtacgtgcctaatcctacggggtgggtggatccgctaggtttaaacacctgccccggcgccaatgtatgtaaacccgagcataaagccgagagcccgacacggaacgcaaaagcttccgatggcgagccaacgttaccagttaccacatcaaaccaagaaaaaaccgtaagggtacgacactacacgagcagggcaggctcaaaaggcattgaaaaagagggagcaatattggctcaagacaacaatagagtttatcttgaacctgcgaaaagcaaagtactaaacccaacagaagcgcaggacaaatatcaaattaaaaaaaataaaggacgagattacattgaaacggatgtagaggagtcacgattggagtggataaaaaaccctagatataactctaccgagctaaccgtaaaaggaaacttgatattaaaaaacccaaagatcacaaggagaaagtaatgttagaaaaaaatgaaaaaatagtactccccggaaaagaagcacttgacgctctcaaagaaatcgagttcatattgatatccttacacaaaatgggcagttattatgctgaaaagcctggcgctctagaagagtatcgaaaagcaaccactgacttcatcgacgattgcgccgttacacagcgcttggcgaaggtccgcaggatcatttctacgcaatttgacgactctctcggtgatgacgacatggatgatatggaaagacatttctccgatttgaaattctgggaacccattcaacccttgaatcgaacaaaccatggcacagaacagattactatctcaaagggaaccattgaacaagtcacttgcaaaagaaatgaattattagttttttttacggacctacaagatcaatcactgctaatcacttttcataacccggtcgcttttaaaggtataaatgcgatcaactctcaatgtgagatacacgaagaaaaggtttctaacctttcgcaagaggtagcacgcattgctccagacaaaccgggtaaaagttattgcttcaaggatagcagcagcggcgaagttgtcttcgcagtgatagcaggcagctacagcactgagaggatatgagattaactgaacacctgttttggatgcataacgatccggtaacggacggatgagaagttgtatcaactggggagcacagacagtggataaatacatcaaaaatgcaggaaccttatttgagtgaacgcgtggaataatttgcttgtactgatgcaatcgtgactacgacagacgaagacaaaaatagtcaagaaacatcccgaagagtattaaggtcgcagatcacctcaacggaggcgacgtcaaagtctacgaccttgcattaccgggtacaagacgatattaaagcctttagggcgagttccctagtaacaatacctctccgaatggaagcaaaagggtagaccccaaagcgaatacaatgaagcaacccacttcaacagggcctcaaaaaaatgaataccatttgcgtaccactcacgacagaagccatggagttactagatacaaacgaatgcccctcctcgctacttgagagcactacgcttacgaaagaagaatatcaagaacttttaaagtctggcgtcttagaaagcataaatgatgcacttggaaagataattgatgaatatgaggatgagtttataaacacacctgaagagctagataaaacattaaatatattaaaaacctatttgagacctgaaaactcaaaaacattaaataaattaattaaattaaatgtattagtcatcaacaaaacacaggattatttttcttcttttaacactcacctcatatcggctaccagactgctggaaagcgcggtacagggggagcaaaaagaggccatattttgctcaacctgatccccgtcaaccgctccaggattggtgttactcaatgagttacctagaaacagaaatcaacgaaagcttagaaaagctaggtattcaaaataaaaaaatcacccccaaggatctggatacgcttatggaatctcttggcaatgcttttttctgcgaaggtgccaactgtcttgacccgactcagttacgggttaaacgcgcagaacataacccaaacttttggcaagaggtatcagcgcgcattcacagtgatcagttgatcctcatcgtccttgacacgtcctacagagcatgggaaatcggcccaccccaacaacttcaacgtgttttagcagatacaactggatatccattctgggtgacggacgtgagcttttcttttctaatctacatggatgatcatgattgcgttagttgggctcaaactcaaaacagcccccctcacccc

SEQ ID NO: 96 - DNA, 2171 bp, Pseudomonas poae FL10F
ggcggtaacttcgagaacttggtgactgatccgaaggcggctgaaactacgatcaccgattcgatcgacaacaccacggtttctctgactgccgataaagcatcggtggttgaaggtggtgagattacctacaccgcgaccttgactaacaaggcgcagactgacgttaccgttacgctttcgaatggccagacgatcaccatcaaagccggtgaaaccgtaggttcgacggtgttccagacgccggctaacgacgtctacaacaacggttccaccgtcagcaccaccatcgctaaaaccgaaggcggcaacttcgagaacctggtaaccgatccgaaggcggctgaaaccacgatcaccgattcgatcgacaacaccacggtttccctgactgccgataaagcatcggtagtcgaaggcggtgagattacctacaccgcgaccttgaccaacaaagcgcaaaccgatgtcacggtaaccttgagcaatggtcagacgatcaccattaaagcgggtgaaaccgttggctcaacggtgttccagacgccggcgaacgacgtttacaacaacggttcgactgtcagcactacgattgctaaaactgaaggcggcaacttcgagaacctggtgacagatccgaaggcggctgaaacggcgattaccgattcgatcgataacaccaccatcacgctgactgctgataaatcatctgtagttgaaggtggtgagatcacctacaccgcgaccttgaccaacaaagcgcaaaccgatgtcacggtaaccttgagcaatggtcagacgatcaccattaaagcgggtgaaaccgttggctcaacggtgttccagacgccggcgaacgacgtttacaacaacggttcgactgtcagcactacgattgctaaaaccgaaggcggtaacttcgagaacttggtgaccgatccgaaagcggctgaaaccacgatcaccgattcgatcgataacaccaccatcactctgaccgctgataaagcatctgtggttgaaggcggtgagatcacctacaccgcaacattgaccaacaaggcgcagactgacgttaccgttacgctttcgaatggtcagacgattaccatcaaagcgggtgaaaccgttggctcgactgtgttccagacgccagctaacgatgtttacaacaacggttctaccgtcagcaccaccatcgctaaaaccgaaggcggtaacttcgagaacttggtgaccgatccgaaggcggctgaaacggccatcactgattcgatcgataacaccaccgtttccctttccgccgacaaagcctcggtcgttgaaggcggtgagattacctacaccgcgaccttgactaacaaggcacagactgacgtcaccgttacgctttcgaatggtcagacgatcaccatcaaagctggcgaaaccgttggctccacggttttccaaacgccggctaacgacgtctacaacaacggttccaccgtcagcaccaccatcgctaaaaccgagggcggtaacttcgagaacctggtaaccgatccgaaggcggctgaaacagccatcaccgattcgatcgacaacaccacggtttccctctccgccgacaaagcctcggtggttgaaggcggtgagattacctacaccgcgactttgaccaacaaggcgcaaacagacgtcaccgtgacgttgagcaacggccagaccatcaccattaaagcgggtgaaaccgttggttcgactgtgtaccagactccagccaacgacgtttacaacaatggctccaccgtcagcaccactatcgctaaaaccgaaggcggcaacttcgagaacctggtaaccgatccgaaggcggctgaaaccacgatcaccgattcgatcgacaacaccacggtttctctgactgctgataaagcatcggtggttgaaggcggtgagattacctacaccgcgactttgaccaacaaagcgcaaaccgatgtcaccgtaacgctgagcaacggccagaccatcactatcaaggctggtgaaaccgtcggctcgactgtgttccagacgccagccaacgacgtttacaacaatggttcgactgtcagcaccactatcgctaaaaccgaaggcggcaacttcgagaacctggtaaccgatccgaaggcggctgaaaccac

SEQ ID NO: 97 - DNA, 1761 bp, Pseudomonas poae FL10F
gggtggcgaattggggctggctatgggggccatagtgtctgactactttgtttgcctaaccatgatctaatggggtcggatcaatcagattgcacacacctcttctcgcatctcagtagcacgctgaatccgggtcgttgaaatatacagatggcccacagagcgaaatatatttcgccttgaactcaattactgaagttgcggattttgcttgcaaggcataaaaattttcgtgtttggttattaccatttttagtggttccttagtcgggatattgctgattctaacgtcgctcaggcctccgcaatctaagcctatccggcatgtattgaactcctccggaatccacttttttggtggtgcgtcaggaagctccgaaatatcgaaccctaaaccgatattgggcctgtcattgtcaattgtcacagaaaaaagtgttatttcgcctatttctaccggataggtaaacaccttgttgaagaagatagtatcttctagatcattccagtacttcatttcttgcctcggaagtaatagtgggctttgccaccgtctaattttccatttctgggcctgtttttcggccgaaggttgaaatgtgatgtttgatcaccctttccctcaggtgcggaaaatttgtgtccagctccatgatcttgaattagaattttagagccgtcggcgcgggtgaactcatactctcgcgtcattattggtcggcctcgctcatctagaacttcattattttgcttgtctctcattgataccattgaatattgccttgtcttccctagtctaggatcaagcactgggtctgggtgttgcgtacgcggaactcctgcatcgactttagcttgtttgaaagcaccattccttgaaacctccggagtagacggttcggcaggtttgtcacatgctagagttttactacctttaggtggacagttggcgcttaaccccgttgggtccacccaccccgtaggattgggcacgtactggtacgcattgatcccacccgccagcttcaccgggtcgggtgttagatagcgaccaatgtctggattgtagtagcgatggcggttgtagtgcagtccgctttccgggtcgaagtattggccttggaagcgcagcgggttgtcgattttgtttatgtcgaggcggctgatctggccgtaggcgcggtaatgcgcggaccagacgatttcgccgtcgggggcggtgagttcttgcggtgtgcctagatggtcgagttgatagtggaagggctgggtgtcttgtgggccaaaaccttccagcagtgctaagggccgaaagctgtccggctcgtagatgtaactgcgatgacgatcggcatgatgctcggcaaccagcttgtcgccttgccagaagaactcagtggttatgtcgtcgacggttttactgatccgccgaccaaatgggtcatagcgataactggccgtttgcccgttaggttgagtgatgccgatcagccgatgctgacagtcgtagcgatactcggtgacgagttgatggcctttaccgcgcctctggcagatcaggttaccaaacgcgtcatagtcataatgatgatcgccctgaatcaccagccgattccccgccacgatgtccgggccgggtcgatcctgcatcagcaggtttccagccgggtcgtggccgaagcgctcttgctggtcttgcgaatgatcggcgcgggtcaggcgggcgagggggtcgtagtggtagtggtgttcgcctttgcg

SEQ ID NO: 98 - DNA, 1409 bp, Pseudomonas poae FL10F
tgaactgacccccaaaggctggacacaacctttgggggcgtcatgggtaagtacacagagcaagcaaaactcgtagcagtgcaggattattgttccggtagcgcgggtttgagggatgttgcacaccgtcacaatgtggacttttcatcccttcgccaatgggttgcggcctatcaggtacatggcgctgctgggctgaaacagaaaaggctgcagcgctacagcaacaacttcaaactgtctgttttgaagcgtatgcgtgaggagcagctgtcctatcgacagacggcggccttgttcgatatccgtaaattcgacatcatcggtctctgggagcgccgctatgatgagggcggttttgatgcccttaccaagcagcctgatagagccggacgtccgaaaaaaatgccaacctccattcctcctgttcaacccaactcacctgatgacgattcgcgctcacgcgatgaattgcttgctgaagtgaagcagttgcggatggaaaacgactacctaaaaaagctcgatgccttggtccaggagaagaaacgagtagcgcagcagaaaaagcgcaaatcgtaataggactgaggccgctgcactctctagaaagcctgctgacgtttgccggtttggcacgcagcaccttttactatcagcaaaaggcgctgcaagcggctgataagtacgccgagctgaaagacaagattcgttctacgttcgatgagcacaagggccggtatggctatcgtcggataacggctgcggtacgaagcgccggccatctcgtcaatcacaagacggttcagcgactgatggcacaacttcagctcaagagcttagtgcgtgtgaaaaaataccgagcttacaaaggcgaggtaggcaaggcagcgcctaatcttttgaagcgagagtttgaagcgccgtcccccaatcaaaagtgggtgaccgacgttactgagttcaaagttggaggtcagaagctttatctgtctcccgttttggatctgtacaacggcgaaatcatttcctacgagattgccagaaagccgctgttcgacatggtcgggaagatgctcaaaggtgcattcaagcggcttcagccgcatgaaaaaccggttttgcattcagaccagggctggcagtatcgaatgccaatttatctaaaggctcttaaggaacgctcaatcacgccaagcatgtcgagaaaaggtaactgctacgacaatgcggccatggagagtttcttcggtacgctgaagtcagagtttttttatctaaataaatttagcgatctggatgagcttcaggcaggcatcgacgagtacatccagtattacaatcactcgcgtatcaagctgaagctaaacggcctgagccctgttgcatatagaactcaggccgttcag

SEQ ID NO: 99 - DNA, 1307 bp, Pseudomonas poae FL10F
ccttcaacgaccgaagccttgtcagcagtcaacgaaaccgtggtgttgtcgatcgagtcggtgatcgtggtgaccgctgctttcggatcggtgaccaggttctcgaaattaccacccgcagtcttggcgatggtggtgctgacagtggaactgttgttgtagacgtcgttcgctggggtatggaaaaccgtcgagcctgcggagtcgccagctttgatggtaatagtctgaccgttgctcagcgtgacagtgacgtcagtttgcgccttgttggtcaaagtcgcggtgtaagtgatatcgccgccttcaacgaccgaagccttgtcagcagtcaacgaaaccgtggtgttgtcgatcgagtcggtgatcgtggtgaccgccgctttcggatctgtaaccaggttctcgaagttaccgccgacagttttggcgatggtggtgctgacggtcgatccgttattgtaaacatcgttagctggcgtctggaaaacagtcgaaccaacggtttcaccggctttaatggtaatggtctggccgttgctcaacgtcactgtgacgtcagtctgcgccttgttggtcaaagtcgcggtgtaggtaatctcaccgccttcaaccacagatgctttgtcggcagtcagggaaacggtggtgttgtcgatcgagtcggtgatcgtggtgaccgctgctttcggatcggtaaccaggttttcgaagttgccgcctgcagttttcgcgatcgtagtgctgacggtggaaccgttgttgtagacgtcgttcgctggagtgtggaaaaccgtggagcccacggactcgccagctttgatggtaatagtctgaccgttgctcagcgtgacagtgacgtcagtttgagctttgttcgtcagggtcgcggtgtaagtgatatcgccgccttcaacgaccgaagccttgtcagcagtcaacgaaaccgtggtgttgtcgatcgagtcggtgatcgtggtgaccgccgccttcggatcggtcaccaggttctcgaagttaccgccttcggttttagcgatagtggtgctgacagtcgaaccgttgttgtaaacatcgttagctggcgtctggaaaacagtcgagccaacggtttcaccggctttaatggtaatggtctggccgttgctcaacgtcactgtgacgtcagtctgagctttgttcgtcagggtcgcggtgtaggtgatctcgccaccctcgactaccgacgccttatcagcagtcagagaaaccgtggtgttgtcgatcgaatcggtgatcgtggtttcagccgccttcggatcggttac

SEQ ID NO: 100 - DNA, 1201 bp, Pseudomonas poae FL10F
atgccccgtagtcagggttatttacgtcgaaggtccgtagaaattgatgacagaagtagacatcaaataagccatctctctcagcgttaggacgtattgcgatgtgttgtccacgcagacctttggcgatgctgaagtagcgtttctgaaagcgaaatcgactgtcataaaccttagccaacacatcatctgggccatattcaaattccgacagttgctgtggatacgcccagggactgctccgatagcggtccataggcaccttgtaacccagcgcctggtgagggcgctgcaggttataaacctcacgccattgatcaaaagccgattgggcctccatcagtgtggaaaaataacgtccatcaagcacctctgctttgagcgagcggtggaaacgttcgatctttccattggtttgaggatggcgaggacggctgaagctgatccgaattcccaggcgaatcagccagatactcagttctgaaacttcacccggattgcgtggcgagccccagggagcaccgttatcaacgttgatccgaactggcaaaccatagcgctggaaaacctcgatcatcttctccttcaccgtggctccccgttcgttatcacaggcatcaatggctaggctgaaccgggagtggtcatccaacagagtcagggggtggcatcgaccttgttgcagtgcgaaatgccctttgaaatccatctgccacagatcattaggcgcgtcgtgttcaaatcgcaacgtcgccgtatgttccttctgagacggttgaatcaggccatggcggtgcaagacattggtgacggtgctgggagcaatgcgcttttccaacaggctactaatggtgcgtccgccccatgctggatgggcctgtctaagtgcgatgacttgtgcttccaaagccgtctgagtcagtttagggctggtcgctggcctgcgggatttctcttgcagaccaggctgacccagctcctcgtagcgtttgagccacttgtacgctgtttgtgggctgataccgaatcgtcgacacaactcacgtttgttgctgccgggttgccgtgctaaggcaacgaactcttctttcaggctcatggcgtctctcgtagtccaaggcatgatggctttccgacgaagttggctcgccgcaaagtgtccaccatgtccccgcacacccgtcaaccatgtgtccggtcc

SEQ ID NO: 101 - DNA, 1195 bp, Pseudomonas poae FL10F
gcaagcccgcttgtatgctaggacttgaagggaggaggagggacaaagcccgattctgactgttacagcagtacagaccgtgggagatttcgcccctcctcctttcacccaagcgccgataaagaatgcatctggctatgaccgacgataggaacaagcctgcgcctctgggtgagcccttcaagtgctcaaaaccttagcccggaggaagtccccatggcaatgccagtttccgtttcaaagccgatcgttggtgttgatgtcgctaaaaatgagttggtgatttatcacgccgagctcgatctgctggaagcgatcccgaacaacaaagccgctatcaaaaagtggttgaaggctttgccgggcgccgtagcaatcgcaattgaggcgactaatacctaccacttggagttcgctgatctggcctatgaagccggctgcgttatctacatggtcggtggttatgaactcagccattaccgcaaaggtgtgatggttcgggccaaaaccgacgccctggatgcccagttactggcgcggtatttgagaaaagaagccgacgaacttcaaccctggaccccgccatctcctctttatcgccaacttttaagccttttccgtcgccgtgccgctttggttcaagctcgcgtcagcctaacgcaaagctgggcgaacgagccgcagctgaaggcctcttttgctgaacagatgaaatccatgcaaagacttgaagggctgatcgaaaaaatgatcggtgatcgcctgaaagaggccgggttgctcggccaactcaaacgctgcatgaaagttgaaggtatcggttttttgaccggagcccgcttgattaccaccttccaacgaggtgattttagaaacgccgatgcgtttatcgccttcctgggcatggatttgcgcgtttctaagtccgggcagaaagataatcgtcgtagtttgagcaagcgcggcgactcagaagcgcggcgccttctgcataacgcagcaatggctgctagccgaacggcagcatggaaagagttttaccaagcgcagcgggcgcggggatatagcacgacccaggtgctggtgatgctggctcgcaagctggctcgggtggtatttgccttgatgaaaggacaaaccgaataccaaccgaagattggttgagggttgcccctcaaccatagaatctcccaca

SEQ ID NO: 102 - DNA, 1194 bp, Pseudomonas poae FL10F
ggtgcttaaagcacgtgtgggagcccatgctgccactcacctctccactctggtcattgagcccgaacagttgaacgagcccacctcgaacagttacaagcgtgggccaagccagagcgctctcacttttagtgtaagaggatttggctatgttttcctatccagcaggtattgatgtctccagcggtagccttcaggtccaggtaaatcaactggatgctgcgatgagtttccccaactcagaaagtgactttcccagcttaatcagatggttaaccctgcatcatgtcggtcgtgtattgcttgaggccactggtggttacgagcgcaaagttatgaaagcgcttcagacagcaggcttcgaggtggtacggatcaatccttgtcgagccaagagttttgccagggctatggggcagcacgctaaaactgatccgatagatgcaagcctgcttgcacaatttgcagcagtcatcaaatcgcccgatagccggattacaagcgctgagcaggatgatttacgcgccctggtccagcagcgggagaactttgttcaacaaagagatgacgacaaacggagacttaaaacggccgcctctgaggtgatcaagcctgcgttgcagagccatatcgactatttgcaaagtgcggtgaaggcgctggaaattctgatccgtcaaagtgccgagcgtttggacagcaaaaaagcagcccttctgtgctcggtaaaaggcatcggactcgttacagcagccagtttgatgtcctaccttccggagctaggagaagtgagtaggcaccagattgcggcattaagcggcactgcgccctacaacgacgatagtggcaagcacaaaggcaagcgccatatcagcggaggtaggtttgccgcgagacgttcattgtatatggcctgttggtcagtgatcagatttcagcctgagttcgccaagcggtatcaagagctgcgcgcgaaaggcaaatgcgccaaggtggcgctcatcgcctgtatgcgcatcttgctggtacgtctaaacgcgatgatccgtgactgttctgaatggaaagaaaacgccgcctagagctagcagcggctgttttctaaggcacttacacggtgtactgctgtgggggcactgtcatctctggaacagcagcttggaaaaaagccatcaagacagttgctcccacatt

SEQ ID NO: 103 - DNA, 1074 bp, Pseudomonas poae FL10F
atcagattgccaaacgcgtcatagtcataatgatgatcgccctgaatcaccagccgattccccgccacgatgtccggccctgggcggtcttgcatcagcaggttgccggccgggtcgtggccgaagcgctcttgctggtcttgcgaatgatcggcgcgggtgaggcgggcgagggggtcgtagtggtagtggtgttcgcctttgcgggtgtcgagcaggcgtgtgaggttgccggttttgtcgtagtcgtagtggcggcggtagagcttgtgttctttctgggtcaccgcgtgggcgtgcaggcggttttgttcgtcgtagtggtagtggctgagcagttggccttgctggcgctggcgctcgcggccggttttgaacaggtgtgaggtgagggttttgccattcagttcgacggtggcgaggtggccgcttttgtcgtggttgaaggtgaggcggttgttgtccggcaggcgcaggtttttcagttggccgcaggcgtcgtagccgtagcgcagggtgccccagccttggtggtcggcggtgaggcggttttggctgtcgtattcgtaggctagggcccagtggccgtcgtcgacgctgaggaggttgccctggcggtcgtaggtgtattcaacaacgttggaatcgggaagggtttttcgtacaagccgcccggaagggtctcgctcgtagcgggtaattagctgactgccgtcatcgccgtgttcggtcttttccagcaggttgccgttgaggtcgtagacgtacgccgtacgctggccgtcaaagccgatttcctgctggatcaggccgttggggtggtaatccagccggtaggtttcaccgacttcgttttcgatctcggtcagcaataaccgcacgttgtcgtagcggtatttaacctgggtgccatcggcgttgaggcggcggctaatcagatgcaggccgtcagcgtattcgtagcgggtgacgtggcccaattcgtcacgttcagaggtgatttttccgtacgggttgtagctgaattcccgcgtggcaccgcctggaagaacgacacgaaccaaccgacccaca

SEQ ID NO: 104 - DNA, 419597 bp, Bacillus velezensis FL50S
aggaaatggcgcacatttacgccggttatatggataaaaaggagaaaagcgtatgaatgcaggagcacaaccgaaaatttccgtcatcatgggaatttataattgcgaagagactttagcggagagtattgaatccatcctgagccaatcgtataagaattgggaactgattatgtgtgatgacgcgtcaactgacggaacgtatcagattgcgcgccgttacgcggatcattacagcgaccggatcacgctgattcaaaataagacgaatcaacggcttgccgcttcgctgaaccgctgtctgacatacgcaacgggggattatatcgccaggcaggacggtgatgacatctccaacccgaggagactggaaaaacaggccgctttcttaaacaagcacacccactatcaagtcgtaggcacgggcatgctcgtatttgacgaattcggtgtaaggggcgcccggcttttgccgcccgtgccgaaaccgggaattatggcgaaaggcacaccgttctgccacggcaccattatgatgcgggctgaagcgtacaaagcgcttggaggctaccggtcagtcaggcggacgcggcggatggaggatatcgatttgtggctgcgcttttttgaagcgggtttccgagggtacaatctccaggaaacgctgtataaagtcagagaggacagtgatgcgttcaaaaggagatcgtttacgtactccattgataatgcggtgctcgtttttcaggcatgcagacggctgaagctgccgatttcccattacgcgtatatcgcaaaaccgctcatccgcgccattacgccgcccgcggtcatgaaccgttatcataaaaacagggacatccgccaaaaagaagggcttgccgaacatgattgacaaaccgatgcgggtgctgcacatcttcagcgggatgaacaggggcggcgcagaaacgatgatgatgaatttgtaccggaagatggacagaacgaaggtgcagtttgattttttaacccataggaacgatccgtgcgcttatgacgaggaaattctcgctctcggcggacggcttttttatgtgccgagcatcggcagcacaaacccgattacatttgttaaacaggtcaagcgggtgattcaggaaaaaggcccgtttgccgccgtgcacgcccataccgattttcagtctggatttatcgcgcttgccgctcgtttagccggcgtcccggtgcggatctgccattcgcacagtacgtcgtggcgggggcgggcgtcgcggcttgccgggatgcagctgtttgttttcagacggctgatcacggcaaacgccacggcactgtgcgcctgcggaaaagaggcgggccgtttcttattcgggaaagaaaaagacgtgcatcttttgccgaacggcattgatctcgacttatttgccggcgggtgcgcggacacagaagctgaaaaaaggaagcggggcattgcagacggccgtttggtgatcggccatatcggccgatttacagaagaaaaaaaccacgaatttctgctccggctggccgctgatatgaaagagcggggcatcggcttacagctgattctcgccggagacggtccgcttcgcaccgatatggaaaatctggcggcgaagctggggcttgatgatgatgtgcgttttatcggcatagaagaccgcgttcatgatctgctgaaaacgctggatgtatttgtcatgccgtctctttatgaagggctgcccgtcacgctcgttgaagcgcaggcctccggggtgccgtgcgtgatatcagacggcataacggaagaagccgatgccgggctcgggctggtcaaaaggctcagccttaaagaaccgccgggacaatgggcatccgcggttttacgggcagcagaggcggcaaagcctgacggggcgcgtattaaagaaaccctcaggcggctgggatatgacgcgggagaaaatgcgggggctgttatgaagctttacaatatgaattggaaaaaggaacagtaacgaatgattgtatatgtagtcaatatgggaattgtttatatttggtcatggttcgcgaaaatgtgcggcgggcgtgatcaatcgctttcgaccggataccggccgaatcagctcgtcatgctcgttccgctgctatcgctggtattggtctccggtttgcgctacagagtcgggacggattttcagacgtacgcgctaatgtacaagctggcgggaaattacggcagcatttgggagatcttcgggttcggagcgaaaaaagcagccgttgatccggggtttacggctctcatctggctcatgaattttatcacgaaagatccgcaaatcatgtatttcaccgtggcggtcgtgacatgcagctttattttaaaggggctcgttgagttcggccgtccgtttgagctgagtgtatttttgtttttgggcacgtatcactattacgcttcctttaacgggatcaggcagtatatggtggcggccgttttgttttgggccgtccgctacgtaatcagcggaagctggaagcgttatatgtcaatcgtgctgctgtgttcgctttttcattcctcagcgctgattatgattccggtttattttctcgtcagaaaaagagcctggtcgcccgcgattttcggactgtcggcattgtttcttcttatgacgtttctgtatcagaagttcatttcgctgtttgtcgtcgtgctggaaaacagctcgtacggccattatgagaaatggctgatgacgaatacgaacgggatgaacgtcgtaaaaatcgcggtgctgctgctgccgctgtttttggctttctgctaccgggagcggctgcggaagctctggccttacattgatgtcatcgtgaatttctgtctgctcggcctgcttttcggtcttttggcgacaaaggatgttattttcgcccggtttaatatatatttcggcctgtaccaaatgatcctgatcccttattttgtgagaatttttgatgaaaaatcaaatgcgctgatttatatcgccattattgtctgttattttctttacagttacttgcttatgccggtcgattcgtctgtgcttccgtacagaacgattttttcccggtaatggacactggaggtttatatggaaacacccgcggtcagtttattaattgctgtgtataatacggaaacttatttagaaagatgcttagattcattgctcaatcagtcgctcgccaatatcgaaatcgtggccgttaatgacgggtccacggatcaaagcccggcgattcttgaaacctatcagaagcgggatgagagaatcagggtcgttcatcagcaaaaccgggggctcggcgcggtccgcaacaagggcatcgaggcggcgcgcggcgaatttatcgcttttattgatgcggacgactgggttgaacctgattattgcctgcgcatgtatgaaaaagcgaaggctgaccaggctgatctcgtgatttgcgaatatgcggctgaatttgcggatacggggaagaccgccgtttcaacgatcgcttcagcgtacgagggccgcccgaaacaacggtacctgaaagatttatttgaaggaagagtcagcggcttttcatggaacaagctgtacaaaagatccatgatcgagcatcatcagctgcgctttccgcttcgtgatgagctggagcacgtggaggatcagtatttcagcctcagggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacacgaataccggcaggagctggattttttcatcgttcagcacggaacagtctgcctgctgaatgaatggaagcggaataacggcggccggttttctgagaagtggaagaatatcagccggatatgcgctgatcccgtattccgcatgagcctttccaaaacgggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatctcgcggaatggcttttgcttaaggtcaaatacccgtcccaatttcatttcggaacgggagcggatggggcggcggggcttacagcggcaagaaaaaagatcattctgacgctgctcccgtcccacgataatctcggcgatcacgccatcgcctacgcaagcaaaacgtttcttgaacgggagtatcccgattttgacattgtcgaggtggatatgaaggatatatacagatcggcaaaagcgctgatcaaaaagcgccaccccgatgatatggtattcatcatcggcggcgggaacatgggggatttgtaccggtatgaggaatggacgcgccgctttatcataaaaacattccggcaatatcggatcgttcagcttccggcgacggctcacttttctgaatcaaaaaagggacggaaggaactgaagcgcgcccgaaaagtgtacaatgcgcatcccgaccttttgttgatggcgagagatgagacgacgtatcaatggatgaagcgtcattttcccggaaaaacagtgctcaaacagcctgatatggtcttatatttggataaaagcgagcggggcatcccgcgggaagggatctacctctgtttacgggaggataaggagagcgcgctgacggctgaggacagaacgatggtaaaagaagctttggccaaagagtacggagagctgtattcctttaccacgacggtcggccggagggtcagccgccatacacgcgaaaaggagctggaagcgctttggaatacgctgaaaggcgcggaagccgtcgtcactgacaggcttcacgggatgattttttgtgcgctgacgaaaacgccttgtgtcgtcattcgttcgtttgatcataaggtgatggaaggctatcaatggctgaaaaacataccgaacatgacattgcttgaacgtcccgaccctgaagccgtaacatccgccgtaaatcggctgctcagcggcaagcatgaggaaggcggttctttgcgaagtgtttattttgccgggctgcgctcgaaaatcaacggtgatgcccaatgaccgcgccgcttgtgagcgtgatcgtgccgatgtataagacagagccttttattaaagaatgcgcggtttctttaacaaaacagacgctgagagacatcgaaatcattttcgtcaatgacggttcaccggatcagtcaggccggatggctgaacaattcgccgcagaagatgcgagaatccgggtgattcataaagaaaacggcggcctcagctcggcccgcaatgccggaataaaagcagcccgcggccgttatatcggttttgcggacggcgatgactatgtgacggaaacaatgttcgagcggctttatgaagaagcggagaagaaccggctggatatcgccggctgcggttattacaaagaaacgccgtctaaagaaagaacgtatatgccgccgtcccttccgccgggccgcgtcttcacagcggatgaaatgaccgcattgctgacccgcgcgcacgaacatcggtttatttggtatgtgtggcgctatatataccggcgagaagcattgcaagggctgttgttccatgaagatatccggtttgccgaggactctccgtttaacttggcagcgttccgccaagccgcgcgtgtcaaagtgatagacgaagggctgtatatctaccgggaaaatccgcaaagtcttacagaaacaccgtttaagccccgcttagatcacgaactgcaaaagcaatatgcagcgaaaatggctttttatgaggcaaacgggctgacggacgcctgccggagcgatattgatacatatttgtgcaagcatcagattccgatgctgatcgccaacgcatgcgccgccccgcagccgtcacaccagattacggcgcatatcggcagaatcttaacgtatgacatggtaaaaacggccgtgcgcaggacgccgtgccgccataaacagctgctggccggggagcgcgtggtgctcggtctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgttgaggcttttgggtttgtccatctgacacagaatatcattaactatttctctattattaccgttgcgctgagctcagtcgttgtgaggtttttctccgtcgccgcccacagggggaacagggacgaggccaatgcgtatgtaagcaattatttagccgcgtctgtcgtgatatctctattactcgctgtgccgctcgccgggactgctttttttattgacaggattatgaatgtaccggccgggctcttaacggatgtgaggctgtctatcgtaatcggcagcgtgctgtttatgctgacgttttttatggcggggttcgcgacggggccgttttttgccaacaagctttatatcacaagttccattcaggccgtgcaaatgctggtcagggtgctgtgtgtgctcgctctgtttacgtgcctgccgccgaagatctggcagatccagctttcggcattagcgggagccgtctgtgcagctgtgctgacttttttcttctttaagaaattgattccgtggttttctttcagccgtaaaactttatcattacagacaagcaaagtgctgttttcggccggtgcctggagttctgtcaaccagatcggcgtgctgctgtttctgcagattgacctcatgacggccaaccttgtgctggggccgtctgaagcgggtgtctatgcggcgattattcaattcccgcttctgctcagaagtcttgccgggacgcttgcttcactgtttgcgccggttttgacttcctattattcaaaaggcgatatggaaggtctcctgtcttacgccaataaggccgtgcggatgaacgggcttctcctcgcgcttcccgctgcgttattaggagggcttgccgaaccgtttctggcgatttggctgggcccgtcgtttgtgcagacggcgccgcttttatatattcacgccgcgtatttggcggtcagtctctctgtcatgccgcttttttacgtatggacggcttttaataaacaaaaaacgcccgccgtcgttactttatgtttaggcggactgaatgtcatattggccgtggttctcagcggaccggcacatctcgggctgtacggcatcaccattgccggggctgtctccctcattttgaaaaatgccgtcttcacgccgctgtatgtttcgcatattaccggttttcagaaaaccgcgttttacaaaggcatgttcggcccgttggcggcggccgtatttgcctgggccgtctgccggggtatccggctgttttcaccgcttgacagctgggccggtctgatcgccgcagggcttgccgtatgcataagctatgccgcattcgcttttttcttcatttgtacgaaagaagaaaggcggcttgctttacagaaatgccgaaaagtgaaaggagctgttcagatttgaaggcgaaacgtgtatttgatatagcggccgcgacgctgttattgtgcggcgcgagtgtcattcttctcttcgccatggcagccgtcagatgcgccatcgggtctccggtattgttcaaacagacgagaccggggcataatgggcgtccgtttacgttgtataaactcagaacgatgacggatgcgcgtgatgaaaacggtgggctgcttccggatcatctgcgcctgaccaaaacgggaaggctgatcagaaaactgagcatcgatgagcttccccagctttttaatgtgctcaaaggcgatatcagtctggtcggcccccgccctttgctgatggattatctgccgctttacacggcggagcaggcgcggcggcacgaggtgaagccggggattacgggctgggcgcagatcaatgggagaaacgcgatttcatgggaggagaaatttaagctcgacgtgtggtacgtcgacaaccgcacctttctgctcgacttaaagattctgcttttaacagtgaaaaaagttctcgtgtcagaaggcatacacgaagccggccatgtgacggcaaagcgcttcacaggcagcggagatatgtcatcgtgaaaaaggtcgtgctgatcggaaacggcggacacggaaaagtcgtgaaggaaatcgtacaggcccgttccgatatggagcttgcgggcatattggacgacggattcagcggttttaccgctcggaacggtttatatacgggccggacggaagacgtgcacatgcttcggaaactcgtccccgaggccgtgttcacgatatgcatcggccgtaacggcgtcagaaagcagttcgctgaaacgcttgggattgaagctgccgattatgcttcactcattcaccccggggcgatcgtcagtgaaacggcttccgtcgggcacggaacggttgtgatggcgggcgccgtcattcaggcgggcgctgacatcggcgcccattgcatcatcaatacgggggcggttgccgatcacgacaatgcaatcggagattacgtccatctttcaccgcgcgcggcgcttgccggcggagtgaaagtcggggaaggaacgcacatcggaatcggcgcgtccgtcataccacagatggacatcggcccttggtccgttatcggcgcgggggctgcggtcatcagcagaattcccggtcatgtgacggcggtcggcgttccggcccgcgtcatctcccctatccataatgaaaaaggatgatttcatgcaaacaaacaaacggatttatttgtctccgcctcatatgagcggaaaagaacaggaatacatcgcagaagccttccaaaccaattggattgccccgctcggtccgctcgtcaattcgtttgaagcgcggctcgcggaatatgcgggagtgaaaagcgcggcggccgtaagctcgggaacggccgccatccatcttgccctgcggcttgcgggtgtgaaaaaaggagacgttgtattttgtccttcctttacgtttgtcgccacggcgaatccgattgtgtatgagcaggctgagcccgtttttattgattcggaatgggagacgtggaatatgtcgcccgctgcgcttgagcgggcgctccgggatgcaaagcggcgcggcagactcccgaaagcggtgatcgccgtcaatctttacggccaaagcgcgaaaatggatgaattaatgagcctttgtgacgcatacggcgtctgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcacaggcgagagatgccgccgttcattaccagcacagcgagctcggttacaactacaggctcagcaacattctcgcaggcgtggggatatcgcagctggaagtgcttgaagatcgcgtccgggcgaggagagaaatctttcaccggtatcgggaagcgctcgaaacatatccgggcatccgcatgatgccggagcttgaaggaacggtttcaaaccgctggctgacggctctgacgcttgataacggcgtgacgccggaagaagccgtcgcctgtcttgcggaacagaatattgaggcccggccgctgtggaaaccgctgcatacgcagccgcttttctcatcttccgtcttttatcctcacagcgaccatgagcgtgtctctgagaaccttttcagccgggggatttgtctgccgtccgggtctgacctgtcttctgaggagcagcagcgtgtcattgacgcacttgcgcaactgtttaaaacgaaaggggagaaaacatggacagccgccatgttatgagccgattaaaagagacgctgacgggtctgctcagcgttataccgccgcaatccgacatcatatatgccgactatcccctctacggaaatgtaggggatttattgattatgaaagggacggaggcgttttttaaagcgcacggcatccgcgtgaaacagcgctggaatcccgacaattttccattcgggcgccgggcgtacaaaaagacgatcatcgtctgtcagggtggcggaaatttcggggatctctatccgtactatcagacgttcagggaaaaaatcgtcaaatcctttccggaaaacaggatcgtcatcctgccgcaatcgatttattatcaggatgagacacggctgcaaaagacatcggcgctttttgcggagcacaaggatctccacctgtttacgagagatcatgtgtcatacgagactgcgaaacgctttttttcggcgaatcatatcgggcttatgcctgatatggcccatcagctgtatccgatcgcggcgtcagcggttccgtcacgcggcaggctttattttatccgcacggatggggaaatcaacccgaagctgcaaaacaattcttccgttaaaaactgtgactggcaggatgttctgtcagcaagcgaccgcaggggaatcgcttttttccaaacgctgaatgttttgaataaaaaagcgggaaacccgctgccgattgcgcggttttggaaacgctattccgatttcttaacgaaaaaagcggtcctgtttttcagcaggtacgaatcggtggaaacgtcaaggctccacggccacatcctgtcctcgcttctcgggaaaccgaataccgtcattgataattcatacgggaaaaacgcgaactattattacacctggacgcacgaagcgccggacgtccggctgatcggtgaaaccgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgtacaagggttgagacgacggagcggtaatagctgttcatcgcatgaattcggtcttcattcggattcatttcaatgtgctgtgtaaagttttcaataaaatagggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggccatcacattactcggatacaattccgcggagctggccggatatattgatgagctctcactggaaaaccctctgattgaacgaaaggaaacagacacgccgccactatcttaccataaaacaaataaaaacaggatgaaagaacgggacggaagccagcagatcagacttacccgcaaaacgctgcaggattcgctcaaacagcaagccttagacatgaagctgtccgatgatgagaaaaaaattttcaattatctgatacattcattggattcaaacggttatttaaaagaggacataccagccgccgccgaccatgtatccgcttcacaagaggagacggaagcggttctgaaaaagcttcaatcccttgagcccgcgggaatcggcgcccggtctttgcaggaatgcatccttcttcagctccgccgtctgcccgagcggaacgaacaggcggaatggattgccgaagcctattttgagctatttgcaagaaagaattggaaagcgcttacacttaaaacgggcattccgcttaaagacattcaggacatcgctgacatgatcagcgcgcttgatccgaggccggggctccgttatgcgcatgaggagccgggtttttacgtagaaccggatattttcatcacggtgaaaaacggcatcattcaagcgcggctcaacagccgttcgtttcctgacatccagcttcatgcccattatcagccgctcttgtcagccgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcatcgggggacggcggcgcctccaattatgccgtaaaagcgcatctggaagcattggtccgtaaagaagataaaaagaaacctttttcagaccaaaagcttgccgatctgctgcatgaacaatatgacatccgaatctcaaggcgcaccgtcgccaaataccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaagcggaaaaggtcggcttccttgcccgccagaccgacagcggcacaggcaaccgcaatggattgcggagaaatcatttttccggtgacaccgcctgatgaattggcggcaacggagagaaccgggtccatcccgacagatagcgccgtcaccttttgcaatccgccgaacaataggttggccgatgtatcagagccggtaataaatacgccgagccagccgagcaccggcgaaaaaaaggtaaacatcgcgcccgtcatggcaagcgcaagaccgagtgtcgtgctcatgccggaagcattcgtcacatatgcaaagccgacaacagaaacaatggtcacgaccggaagcgttaactctttcaccgtttctataaacgcttcgccccacgtcttccacgacatgccgagggcgaacttggagatgacggcggcaatcagaatcgccgttcccgctgaaccgaaaagctcaagtttgtacacggcttcaatcggcgtgccgtccgcctgaagaatctgctgatttacaaatgggacgggaggcgtgaaggtcaatgctttcccggctgcattcagccaggaaagccacattgacgttccttcataatgaccggttaaagcagccttcacgccgggaatcccccaaacggatatcatggccgtcagaagaaggaaaggagaccacgctttaaacaccgcggcgcccccgtacttgatcggcgcccggtcagcggccgctgctgattcccgttctgccgcgaaacgaaaggccgttttcggtttccaaaatttcaaaaatacagcgagcgcggccatggaaacaagcgccgacagcacatccggaagctcaggccctaaaaaattcgagcttgcgtactgcacggccgcaaaggagacgccggaaacaagaatggccggccatacttcaaaagcctttttaaacccgctcatcaaaatgattaagtaaagcggaataaagacggataaaaaaggaagctgccggccgaccatttgggaaatttccattgccggtatcccggtcggaccttcaacggcggtaatcggaatgccgatcgcaccgaaggcaacgggcgccgtattggcaatcaggcaaattcccgccgcatacagcggctgaaaaccaagtccgacgagcaaagcggccgagatcgcgacgggagcgccgaaaccggcggcgccttctaaaaatgccccgaatgaaaaggcgatgagcagcgcctgcaaacgccggtcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgttaaaagccccgctatgtaccccttcatccgtttcaccgcaagcgcccaaaaaaagaagataatcggtacgagcgcgcaagctgccgataaaagcaaatttccccctaaaggagcgtacccctgtgtccattgcatccctaaaaaacccctccttatgtcatgtaaacgattactttttatgataaggtcatctgatgaccgggttaattagcattatatttagaaagttttgaaagtacaatacttttcttgaacaaattgtctgaacctgtcggcaacacaaaaaaagaagtataatagacgataaacatcaagattcacaagtgacggggtgatcgcgttgaaatataaacaaattaaaacgaaaaaaatctacgaagaagtcgctgacgcattgctggagaagataaaagcgggcgagcttaagccgggtgaaaagcttgattccgttcaggcgctttccgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgccctcttgatgaaaaaagaggacgtcaaacagctgctcgaagtcagaaagctgcttgaactcggcgtcgccgccatggccgctgaaaaacgcaccgaagacgatttgcaaaaaatccgccaagctctcttggagatgaaagacatcgacggagacgaagaattgggcgaaaaagcagatttctcctttcacatggcgctggcggaagcatcacaaaacgggctgcttaagcatctcatgaatcatgtctccgcgctccttttggaaacaatgagagaaacgagaaaaatttggctgttttctaaacgaacgagcgtgcagcgattgtatgaagagcatgaacgcatttacagcgccgtcgccgccggagacacggatgaagcggaagcagcgatgacggcgcacctgacgaatgtggaagaagtgctgggggcttattttgaagaaaatgtatagaagctgacttgtgaaaggggataacatcacatgcaggccgaatcttttttttctgaccatgtaaagaaagctctgacaaatgatcctcccggggaatggatgccggcagttccgaaagcgtgcatccccctgcattccggctatcccgatcccgcactcgttcctgataaggagctgaaagaagccgcctcccgccttctggatgaggagcgcgatctgccgctgcattatatgggaagcccgaggacggccgttttaaaaaagcagattcaagaacggttagccatccgcggcattcactgccgggacgatgagctgatcgtgacgtcaggcgcctgtcaggcgatagatctggctgcgcgggttttcctcgatgaacaaaccgccgctgccgttgaagctccggtctatatggaagcgctcgagatttttaaaaattatacaccgcatatcatgagcattccgacagatcaagagggcctgcaaacagaaacattagcgtttatgcttgaggaaagaaaacgaaaagggcttctgcttccccgtcttctctacacgatacccgcttttcagaatcctgcgggaaccgtaatgtcagcgaagcggagaacccgcctgcttcagcttgccgaaacgtatgattttctcatcttggaggatgatgcatacggcgagctcggattcaccgatattccgccgcccttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccatccgttttcccaagcggtgaccgccgtctatctggaacaaacgaatattgaagaacggctcgccgccttgcgggaagcatatcgaagcaaacgtgatgttttgctcgccgcatcagcgcgatatcttccggaatccgcatcctggcacgtgcctgaaggcggttactttgtatgggtgaaagcgccgggggctgatacgtccgcactgctggcgagggctctgtctcacggcgtttcctatgtacccggaaaatatttttttccgcatcaggaagacggtgccgaatatctccgcctgtcgttcagttttcccggtaaagccgcgataaaagagggtgtgcaaaaactgggacacctgctgaaaaacgggatctagaggagcatgggaagctttcaggcttctcttttttttacccttcagcgcatcgggcgaaaggatttttcagaaaaaccttccaatccatattcagaatagtgtaggatatttatagagctttccaaaaacaggtcatcggatgaccggatcacatactgaggatgaaagaggggttcatcatgaaagtctcattatttgtcacgtgccttgtggatatgtttcagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcaatgaagcggatgattgccgcgtttgaagaagcggagtacgtcgtcagcccgtcaggttcctgtacgacgatgttccgtgaatatccgcatctgtttcaggacgatccgaagtgggccgcaaaagcgcagcagcttgcggacaaaacatatgagttaacggattttatcgtcaacgttctcggggtggaggatgtcggggcggtgctgcataaaaaagcgacagtccatacatcgtgccacatgacgaggctgctcggcgtgtcggaggagccgatgaagcttttgcgccatgtcaaggggctcgagctgaccgcgcttcccggaaagcaccaatgctgcggattcggaggaacattttctgtgaaaatggcgcaaatctctgaacaaatggtggatgaaaaggtcgcctgcgtggaagacacggaggccgaggtgctgatcggggcggattgcggatgtctgatgaatatcggcgggcgtcttgaccgtaaggataaaaacgtcagagtcatgcacatcgcagaagtgctgaacagcagataagacgagaaacaacaagggggtaaaatcatggcgatgaaaatcggtaccgccgcttttaaagagcgggtatcagaaggaatagataatgagtttatgagaggagccgtctccggagcgcaggaacggctcaggacaaggaggcttcaggcggccgaggaattgggaaactgggaggattggcgttcacatgcggaagaaatcagacagcatgtgctggacaatcttgatttctatttggaacagctcgccgaaaacgtcgccaacagaggcgggcatgtctttttcgccgaaacggcggaagaagcgtcctcctatatccgcgatgtcatccggcagaaaaacgccaaaaaaatcgtaaaatccaaatccatggtgacagaagaaatcaatatgaacgaggtgcttgaggaagagggctgtgaagtcacagaaacggatctcggcgaatacattctccagattgacgatcacgatccgccgtcacatatcgttgctcccgctcttcacaaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcatcacgggctgcaactttgcaatcgcggataccggatcggtcagtctcgtgacaaacgaaggaaacggccgccttgtgtccgcgctgccgaagacgcagatcaccgtgatgggaatggagcggatcgttccttcattttctgagtttgaagtgcttgtcagcatgctgacgagaagcgcggtcggccagcggcttacaagttacattacggcgctgacgggcccccggcagcaaggagaagctgacgggcctgaggaatttcatctcgtggttgtggataacgggcgttcccgcatactcggcacggaattccaatcggtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcgtgtccggttaaaattccgctgcacgagctgctgctcaagcatcggcagaacattgtggaaaaagagggcaaagcgccgatcagcgaaaaactggcgatgaaagccttcgggctcggctcgtcatccccgtccctttataaactgggatcgaaatgggcgcctgccgccatgacgccgtttacggaggatgacaaaatatcaaaagggccggggccgttaaaagaatggacggcaatacgggacttcccggcgccgcataaatcgagattcagagattggtttaaagaccgggaaaaacaaaagggggaagaatgatgatgaaagggacggttacacatcaggaatcctttctaaaccggatcgccggaagtctgggcagagagcgcaggaaatcaggcgtgtccctgcctgaatggaagtatcagcctcaatatcaaacgcatgcggactgtacggaagacgatcttgtcacgatgctgaaagaccactgcgtcaacattcataccgaactgatcgaaacggatgcagccgggctttacgacgctttgcgcacgcaggtgaaccgctttgaaggagggcctgtcatcattccgaaggacagccggtttgaaatgtacggcttgcagacccttatgacagaagagtggccggacgaagggattcccgtttgggaatgggacgcggaacaaggagcgaaaaatattgaaaaagcggaacaagcgaatgtgggcatcacattcagcgagatcacgcttgcggaatcagccaccgtcgttttgtatgcgtcagagcatgccggccgttccgtcagcctgcttccgaccacctatatcgcaatcatcccgaaatcttccattgtgccgagaatgacacaggccagcgatatactgaaacagcagatcagagacggcgtcaccgttccttcctgcatcaactatattaccggaccgagcaactcggccgatatcgaaatggatttggttgtcggcgtccacggacccgttaaagccgcttatatcctcgtgaatgaccgataaaaaaacaaaccccggtttgcggccggggtttgtttttatataaacgcgttaatgatcatgataaaacagatcgcactgacagaaataatcgtttccatcgccgtccatgtcaggaacgtttcttttaccgtcattccgaaatactcttttatgagccagaaaccggagtcattgacatgtgacagaatcaaagagcccgctcccgttgccaaaacaagaagctcgctgctgacgcccggcatgacagatgcaatcggagcaacaatgccggccgccgtcatcatggcgacagtcgctgaacctgtggcgacacggatgaccgccgcgatcgtccagcttaaaagaacgggagagaagcttgagtgcttcgccatgtcagcgatatacgtgccgacgcctgaatcaatcaggacgttgttaaaagcgccgccggctccgatcacaagcagaatggaagcgatcggtcccagacagtcattgctgaattttaaaatgctttccctgtcgaagccctgataaaaaccaaggctgaaaaaggagtaaaccgtggcgatcaaaagcgccgtgacagggtctccgataaatttaaaagtttcatagagcgtgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaataccgacgattaaagaatacaaaatcgtttttccgacattggcgtgataaatgccgacagccgccatcgccgccgggtggggcggaaccaatccgtgcacgacggaaagtcccgcaaggagaggaatcccgatcgtcactaatgaaaccccggtttcaatcgcaatcgtaaacaaaagcggcacgagcaggacgaagccgacctggaaaaagaccgggatgccgacaataaaagcgacggccatcatcgcccaatgcactttctttttgccgaagcggccgatcagggtgtgggcgatccgctccgcaccgcctgattcagccatcatttttccgagcatcgtaccgagggccagcacgatcgcaagcagagacagcgtattgccgagcccggttttcatcgaagtgataatgtccggcagattcatgcccgttgcgaaaccgacaaggatggatgtaatcaaaagactgataaacggatttaatttagcgactgtaatcaataagagtaaaacgataatagcggcaatgacaataaacagtaacatgaccttttcaccctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatggcggtgcgaaattctgatccagtcctgaacatcctcgatccgttccatttcgccaaggctgtgcaaagcgagaacggccgctccgagcgcagaggcttcgtaactttccggaacgaggacttcccgtcccatcgtatcggacaaaatctgcctccacagcggcgatctcgcaaatcctcccgaagcccgcacgtcttttgcggggcccgccaaatctctcaatgcgacaccgattgaaaagacgctcatgatgacgccttccagcaccgctctgataaaatgctcccgtttatggcggaggctgatgccgaaaaacgttccgcgggcattcgggttccaaaacggcgcgcgctcccctgataaaaacggcagaaacagcaatccctcagagcctgcgggcactttatcagcaatatcaatcattaaatcgtacggatcaatgccgagccgcttcgccgtttcaacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgcttgttccgatcgtaacggccacttcgcctttgccgatcgcgccgactcccaggttggcgagcacgccgtcatttgcgccgataataaacggtgtatccgcatgaatgcccatccgtgcagcgatttccggcgcaaggccgcgcagctgatgagtggtcggcacaatgtccgacagctgatcttcccggattccggcaatcctgagcgcttcttcatcccaggaaagcgtatctaatcggaacagtcccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcggatgaatcggcgtacccgttcttttataaatatcaaaaccgttcatctcttttaaaatccgttttgattgctcggcgctgcggttgtccgcccaaatgatgcttttggtcagcaggccgccgttttgatcgacagctatcaatgagtgcatggcggtgctgatgccgatcgcaagcagattgtcaggactcagtccggcctttgtgacggcgcccctgatgcttccgatcaccgcttccaaaatgtgctcaggatcctgctcggcccatgccggctttggctgtattaaatcatagtgaaccgaatgcttggctaacactttgcctcttggtccgaacagaacggctttcgtactggtcgtgccgatatccagaccgataacagcttgggtttccttcataatatatcccgcctaatctgattgaataataagatagatttataatgtatgcccttacaaagtcaattataggaataatttttttataaatcaacgatgaagaagaaaaattttttcataaaattgcctcaattcccgctgtatcggctttctctcttttgaaaaaaatatttagaaaacgattacaaacgtttgtgcgcgatcatttttctgatttgctgcaagttggcgagcgttttctcctgccgcagccgggccgtggcgaaatacagtgtatcaatgaccgacagctgggcaagccttgcggacatcgcctccgttctgaaagccgtctcccttgttgatgtatacagcacaacgtcggaaatctgggtgagcggcgacttttggtagcttgtaatgccgatcgtgccggcgccgagcgatttggccgttttgaccgcgtcgagcacgtccttgttgctccccgaatgagaaatgccgatgactgcgctttcaggaccgagaagacccgctgacatcgcctgaaagtgagaatccgtatgcgcgatgcaatttatacccgtacgcataaatttatgatacgcgtcagtggcgatcagcccggaaccgccgtttccgtaaaattcgattctgtctgcgctgtggatcatttctgccgctttttcaacgtcggccggatctaataattgaaaggtatcggtcagaccggaaatgtttgtgcggaaaactttccggatgatgacttcgatatcgtcgtcggggctcatttcttcatgaatgtgctgcaccggctcctgaacgatctcctgagccagcgcgatttttaaatcctgatagccggaaaaaccgagccgcttgcacagcctgaaaatcgtcgcttcagagcttttcgttttttcggccagctgaatgatggaaaggtgaaccacgtctttcggttccttcacgatatggtctgcaatcgctctcaattttggcgacaaacctttgctggccgcctgaattttcccgatgctgcttgaattcacaggggtcatactataacctccctactcgaatgtaaacgcatacttttatgataaagcaagttctgtcataagggaatcaggttttgctttctttaccgcaaatgaaagaagaaaagtatatcggggacaccgcctcaatgacacttcatatgtccgattttcacaaaaagtgatcgttctctgaaaagtgccggtgcccaagtcgccggcgcttgaagttccagatgaatttcttcaaattagtgttccccattagcagtcagttctttgattaactggattgattaaaagagaaggattattaagcaggagaacacttgagaagcacagtataatcagcttctcagaaaaacttcaaattaatataataatctaattgctctgaaacgcgtaccatacattatactttcaatgatttttaaactctgaggaggaaattcacatgaaagtaattgcaattgacttagatggcacgctgttatcagagaacttaactatccaagaacaagatgtaagagctttaaagctcggacaaaaacaaggtcatcttgtaacaatcgctacagggagagctttatttgatgcaaaaaacatcatcaataaatatgatttggattttccgatcattgcttcaaacggcgctcaaattgatgtgggaaatcagttaatattcgaacattttatggattcagatgtaatccaacctatcatcacatggttaaataaagaagaaatctattatcagctttacttatctgacaaaattgtcgtatcaaatcaaggaattcagcagcttgaaaaagaactttacaatacagtaatggaagaacctcattttaatcaagaagtattttggaattctattaaagctcagatacatcaatacgggttagaggaaatgccgggtgcaattgaccctatcgattatcggtatgtcataaaatgtatgatcgtttcgccaaaccaaagaaaattaaaaaaagcaaaagaatattttggacaactgaaggagtgtgccgtaacaagttcaggagcattcaatctcgagatcacaagttcaggagtagataaaggagcgtcattaaataaactttgtgaacattatggaacggatgcgcggaatgcaatcgcaataggtgataatctaaatgatctgcctatgtttcatgcagcaggaatagggatagccatgggaaatgcagataagaagcttattcaattggctgcttttaaaacgttatcgaatgatgagtgtggtgtatcttatgcttttgatcactacattctgacgaaagaagaagaccctaaactgcggagtatacagccatgagccattttgtgaaaagatgtttaatctatattgtcggattgtttattttatccgtaggggttgtatgtatgattaaatctaatacaggaattgccccctgggacgctctgaacgtggctttatcagaactcattggccttacaatcgggtcatgggttttcattgtcggaggaatccttatttttataaacagcctcataaaaatgcggtttcctaatctagccggttttattccgattgttattattggaagttttgttgaccttttaaacttaaaggttctttcgttcttaaaaacagatgctgtaattcttcaatggagtttatttttgatagggttgtgtatattggctatgggaatcgctatttatttaagagcatcttttccttcgataccgaatgatgaattgatgctggctattactgaacgtacaggttggggtattaatattacaaagacgataggggaagctttagcttttgtgcttgcaatcattcttcaggggccgattgggataggaaccatcattgtgttgctgtgtctggggatattagtaggtttatttgacaaactattacacaagatggggaagccccgttctatctatagtgtgggacaggaaggcgcacatattcatgcaggccatgataaaacaattaattaaatgctttttttcccttgtgttgttcagtgtgaaatgctgataacgctgtctaaaaaggagtagcagtaatgacaaacattacagagatagcaaagaaagcgaacgtttctcggacaacagtttctagagttctcaataatcatccttatgtaaaacctgagaagcgggacgctgtgttaaaagctatgaaggaattaaattatgtaccgaatttcaacgcgattaacctatccagggggaagacaaatgttttcggagtcattgttcctaaaatcaaccatccgtttttcagtaaactgattgccggaataggcgaagagtgtaataaacataattacagtttacttgtgcaccaatcaaataacgatcctgaacaagaaatggagttttttaacagattgaaatacaaacttattgacggtcttattttgggatcctgtgtaagcccccatcacgtactcgacgagatatctgggtttggtaatattgtttcctgtgaagcttctgcgagtaaacaggttgcacatatatttattaatcatgagtcaggaatcaaaatggcaatagatcatctgcgaaatcaaggacatcaatccattggtctgtgtataggaaatcctaagagcggtgttggcataagcagaaaaaaatcattttttcactttcaaaatgaatacgggttgaaatggagtgataattggtactttgaggaacagtacactattgagaatggtatagaaatagcaaaattattactaaataagtcacctcgtcctgcggcaatggttgtaggaagtgattacgttgcggcggggatcatttatgaagcgaaaagacagggaatacgaatacctgaagaactggcggttataggatttgataatcagccgatatctaaggtaatagaactttcaacgatacatcaacctattaaagagttgggacaaacagcagcaaatttattatataacttaattaataacaaagatgtccctaatataaataagttggacctaaaacttattaaaagaaagtcaacttaaaaagaccactttatggtggtcttttttgcttagcgtagaattagctctggggcaggcgctttgaaatgagctctttttttcgtttcatctataaaactgaagggcttcatggataggttttcaagttcatttaggaaaagacaagcttttaatggcacaaatgatgtcatattccatacaactttctcattaaaacctatagcacgaatattatgcataagccgatcaattgtgtaagagcctgccgctacatacccttttccttgataccacagattattcccctcaattttttccaatgactggccgcacatggaatctgtgtcaatgcgatctgtcattgctataatacccttagagccaacaagttctacaacccgccgtgcaacttctaagtctacatgttcactatcaaaattcatacaaatggttaataaaccttcttttgcggctctcatcaaagtaccgggaacttctccgacaagtgtgttgatattatctatgttccatttatctagccgagcatcttttaacccctctaatctatgtactctttcttggggtgttctccaggtgtgtttaaaattgtttggcatatcattaaacaaatgatctgttaaaactgcatctgatccagtgtaattgctgcgtttttgcgctgtatctataactttcattataagttcagaggtttcctccgggtatgctttttggaagtgacccagcgccggttttactccagcctccacaagtgtatctacaatccattctaaacttggatgtttttcggtgatatatttctttagataggagttttcagtcatagcatctggagacagtacagtataaataagaccgtattctccacatgaagcgatcttttcccattcttcttttaagggtgcccaattccctttttccggtgtgcctgcaaagctggccaataatggtccttctagtgaaatacctaaaatattacggtaacgtccctttctcttttgtgtatggaactctttcataaaggctgcaaattgatctaattgattatgaggaagaaagatagagggtacacagaaaatcccttctatttcagctagtgtattgatcttttcaatatctaattggtctaaattgctaaaatcatagtcaccgattccatgacaatgaaattctactggaagagatggaactaaataagaacctgatttcttaaaaatcccttctcctccaatgtcaaagttcagccattcattattactataggttatatcagcgattttcattactccatttgtttcaaggtaagccgggctgttaaatgatgtgctagactgcataggaaacgcctcctggaaatgtttatttagtattcagtgaagacacatcatcatcttaaagtatgaaacccgtaccatatcaacctcttattatcatttttttgtaaaaaaataggtgttttattcaactttctacacctgattttctctttattgttatttatatcctggaaatctcctttaaaaactcaaaaacactagctgtaacgccactaatgcatctatactatttcgtgttacgccagctagtgtcctccacgagtttaatttgtggaattggtttcatgtcaatagcttttccaaaaggaatattacttccgagtatagaaccctgcgtattaattcgagttggactattagaaatgaaatgtgtacagttactaagctgagataccggaataaggataaaacctttaatttcctttttgtcgctcagtccatacattatagaaatttttttagggatttctgtttgggaaaaatatataaagtgctgattactccatggccgactcaacccacatatgaatataactatgtcagtcaaaatgtcttatataggtgataagaaaaccagcggaaaaaattagtattgactttgaaaatagaagactgtatattatgttactatattcagaaaataaaaactcaagagattcatttaacataaaacactgtgaacgggagtagtaaaagaatccagtcagaaaaagagagccgcgggttggtgaaacgcggactgattgttctttgaactcgcccggaagtggcagggcggaacggaattgtcggaatattccctatgtcctaacggctgaccttcgttaaaaggtttttaagctggattccggatattcgggatcaacaagagtggtaccgcggctgcctgaggcacgccgtctcttttcctaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcaatcggggccgggctctttaaaggcagcagcacggcgattgatgaagcggggccgtccgtgctgttggcctacctcctcggcggaatcattctgctgtttattatgcaggggctggccgaaatggccgtcagaaacaaacatgcaaggacgttccgtgatttggttcagcagtctctcggttcgtacgctgcatactttttagactggatctattggaaaatgtgggtgctcaatattgccgcggaggcggtcgtagccgccattttcattcaatattggctgccggaatgtccgatatggatactggctttgatcatttccatcgtggtgacggtcgtaaacatgctttctgtgaaactgtttgccgagacggagtactggctcgcgctcattaaaattacggtgattgtcatctttatattatgcggaattctgctattatttttctcattcggcaatcacacggcgccggggctgtctcatttaacggatcacggagggtttttcccgcatggagcggggggcgtcattacggcgatgctcgtcgtgatctactcatacggaggaacggaaatcatcggcgtcacgctggcggagacaaaaaaccccgaaaaggtgattccgaaagctgtccgaagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaactcgggactgtacggatcatcccgcgtcttatttacgcaggcttctgacggccgggtgccgaaaatcttttcaaaactatcgaagaaaaaggttcctgtctatgcgattctgacttgtacgtcatttttatatgtaggcgtcctgatttctttattcgcaggaagccggacgtttaattatttgatgggttccctcggctataccgtgctgttcatctggctgattatcggattcgcccatttaaaatcaagaaaacattcaacagaacagccggcttattacgtcaaatggttcccgtacacgacatggttcgcggtgcttgcgcttttggccatcctgatcggcgtaattgcgacgacgtccatcgtcatcacatgcatcactgcggccatctacctgcttattacggctgcgtatctcgtaaaagggagacgtcaataaataaaaaaactcttgcccagcggcaagagtttttttaatgaacggcctttttttctgcggccagagcaggtgttttcagtttcttcggtgttatattcacaaaacaaatgcttgtgacgatcagaagcagtccggctaaaaggctgacggtcagcggctcatgcagaaatatcgagctgacgacaatggatatgagcgggatcaggaaggtgtaagaggcaaccttgcttgcttcccctgaaccgacaagcgtaaaaaaggcgagccagccgagtgcgatgacaaataccgaaatgaacagaaggctgagaatgaacggagctttccattgaatcgctgaaaagctttctgaaaaatggccggagctgacaagcagcacgccgccgatcagaagctgaagagcgaccatccagatagagtccgcccgtccgcccgttcttttcacatataccgtgccgagcgcccagctgaccgcggagcccagagccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaacaccggctggaaaaacacgatggctgaaaataagccggcaggcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcgagcgcagcttttgtcagcggccagttaattccccataccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacacagcccgccgtaagccatgccatctcggcgcttgagtcagagctcggcatcaagctgatcatccgcgagcgccgcaacggcgtaaggctcacggacacgggcggaaaaattctcgttcatatcagagaggtgctcaaaggcatagaaaaagccgagcagctggcggccgcggaaagaggacttgaacagggaacgattcacatcggcacatttccggccgcttccgcttatttcattccaaaactgatcagcatgtttaaaaaacggtatccgaaacttgagttggtgcttcatgaaggaacggttaacgaagtaaaggaatggctccgctcccgggtaatagatgtggggatcactctttttcctacggaagacatggaatatctgccgctgaaaaaagataaaatggccgtcgtgcttagaaatgatcatccgctttgcagctgtgagtcaattactctgaaagatcttgaccgccagccgatgatcatctgtgacggaggatacgaatcaccgtttattgatatgtttaaggaggcagggtctgtgctgactgccgcattcactgtttacaacgtcaatacgtccatcagcatgatcaaagaggggctgggaatagcgatattatcacaaatgtctatgtccggaatatcgctgccggaaaatgtcgtgacaagggaactcaatcaggcggtgtaccgtgatgttctgcttgccgttccttctgtaaaagaggcttcattggcggcaaaactttttattcaaatcgcgcaggagctcacaaagaatgaataaaaagaccctaatgatcttagggccctgaatcttatcggttaattttaaaagagtttgtcgtattgacaagttttgaaccgctgaacgtagctttgacacgataataacctgtcttgcatccttttaaagagaatgacttagtcacccttactgagaaagaaaaggttgtttttttgcaagtcgtccatttctttccggactttcgctgtaagtataggtttcctttaaaggttcgatctgacggatacgctgtactgagagtaaaatcgacacttttcgcttttttcgtgtagtaggaggcatcggtaaatccgcttacatttaaatgctgctgagtgccggaataaaagtctgcggcatatgccttatcggtgtttccggtaaagaagattgctgccagtaaagctgttgtgagtgccattaagatttttttacgcatatagactatgacttccttcctattcaatatatgacatatgttaacattattggttctgttctttcaatgatatcttttcatttttatatcattctaggctcttcatatctgaatgtaatagattcattcatacagagttcactagtgacgaccgctgactgattgttcgaagatcatcgaatcaaattgtttaactcacgggaaaagctgtggtaaggtgtgtggtagagaccttgtttaagatctgcttacactaaaccataaaggagaaaacgatggctgaacatacattgaaagatactgcgttttccgtattgaatttatcgccggtcgtacaggggggaacggttgctgaatcgttccgcaacagcatggatttagcgcgccgcgccgaggagtggggctataaccgctattggctggcggagcatcataatatagaaggtgtcgccagctcggcaacggcggtgctgatcggccatatcgccggcggcacgaaaaaaatccgtgtcggttcagggggcattatgctgccgaatcattcgtcacttataatcgcggagcaattcggaacccttgaaacgttatatccggggcggattgacctggggctcgggcgtgcgccgggaaccgaccaattaacggcgagggccttaagaagaaacataaacagcggggaggatttcccggagcagcttgaagaattgagaaattacttcaaaccgtcaggcaatgtgcgcaatcaagtccgcgccattccgggcgaagggctggacgtgccgatctggcttttgggatcgagcggcttcagcgcgcgtcttgcgggagagctcgggcttccgttcgcctttgcggctcacttctcaccgaaaaacaccgtgcccgcccttgagctgtaccgaagctccttccgtccgtcagacgtactggatcaaccgtacgcgatggtcggcgtcaccgtcattgccgccgatacggatgaaaaggcggagcatctggcgacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggaaaagctggaaagcttcatccggacaacacaggcggatgaaatcatggtgaattcagaaagctttgagcatgccgacagaatgagatcatttgagatcatcgccgaattaaaaaacagctgagcaaaaaaagcaatgtgccgcgcacattgctttttttattcgccgatccgcctgacggaattccggatgacgagttccggttcatacacgacgtcatccttcttcggttttttatgctctaagcagtcgatgacgtattttgccgccgctttccccataatggatttcggatgcttgacagaggtgagcttcacctcggaaatctgggcgaaatgtgaatcatcatagcccatgactgacacgtcatcaggcacctttaagccgaattctctgagaagattaatcgtcttcagcgcaatttcatcattataacaaagaatggccgtcgggtatgatccgctgttttgctcaagggtatgcttaattttttgaagaagcacggtttctttttcttcagtcgtgtaagtcacgatcatgtccggagacggaaaaatcccgcgctcccggtgcgcctgaagatagccgttcatccgtttgacgccctgcgtgtcatccgctttaaagattcccataatgtgcgtgtggccgagggacatgacgtattcgcaagccatcatgccgcctttgacatcattgacggaaaagctcggtgcggccagctccgaataagaggcgttaatcatggcaaacggaatgccgtttttctccaggttgagatagtagccgatgttgggcgtctgcagcgcgcttttcgtaggctcgacaatcagcccgtctatatttttggacagcaggttttcaaggccccgccgctcactttctgtattgttgttggtgctcgtcagcagcatggaatagccctgttcgcttaaataagattcaattcccctgatgatgctcgggaaaatatagtctgatatgtacgttgtaatgacaccgatcgttttgtttgaatgcatggctgatttcgccgtgcgtgaagcgacaaaggtgcctccgccctgaacgctgtacagcagcccctgcgagaccaaatctccgatcgcctttctgatggtatggcggctgaccccgaactgctgcatcagctcattttccgtaggcagcttttcgtccggctgtattttcccctgattcagccatgaacaaatttcttcttttacttgagcatatttcggtagcatatcaattcctccaaaatgtatacggacaaattccagtataacatagtaagccctttcatcaagctgtaaaaataattgacagattgtgaaaaactgcttattctttatttgtacgtactaattttccttatttttagataaaattctttataagtacgtacaaatgtggcggttctgaagaaaacaaagcaactcaagcgccgcactctgttttgtaagcgtttttattctattattcgcgggagggtaaaattcatgaagaatcacccggcaccaattggctcaaatgtacctgtcactcggcagcattcgaagtggtttgtcattctcatctcatgcgcggccggactgggagggcttttgtacggttatgacacggcggtgatttccggcgccatcggtttcctgaaagatttgtaccgcttaagtccttttatggaagggctcgtgatttcaagcattatgatcggcggtgttttcggcgtcggaatttccggatttttgagtgaccggttcggacggagaaagattttgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggctatacgcggcagtctttcctcactgtatcagctgtttacgatattagggatctccggcacttattttattaaccttgccgtccagcagtccggctcgtatgaatggggggtgcacaccggctggcggtggatgctcgcttacggcatgattccgtccgtcatcttttttatcgtgctgcttatcgtgccggaaagtccgcgctggcttgcgaaagcggggcgccggaatgaagccctcgccgtgctgacgcgcattaatggcgagcagaccgcgaaagaagaaatcaaacaaatcgaaacgtctttacaattagaaaaaatgggttcattgtctcagctgtttaaaccggggctgagaaaagcgcttgtgatcgggattctgctggctttattcaatcaggtcatcggcatgaacgcaattacgtattacgggccggaaattttcaaaatgatgggcttcggacagaatgcggggtttatcacgacatgcatcgtcggtgtcgttgaagtgattttcaccattatcgcggttcttttagtcgataaggtaggccggaaaaagctgatgggggtcggatctgcctttatggcgctgttcatgatcttaatcggggcatccttttattttcagctggcgagcggtccggctttagtcgtcatcatattgggattcgtcgccgctttctgtgtatcagtcgggccgattacgtggatcatgatttcggaaatctttccgaaccacctccgcgcacgcgccgccggtattgcgacgatattcttatggggggccaactgggcgatcggccagttcgtgccgatgatgatcagcgggttggggctcgcgtacaccttctggatattcgccgtcattaatattctctgtttcttgtttgtcgtgacgatctgccctgagacgaaaaataaatcattagaagaaatagaaaaactctggataaaatgaaagcgttttacgacaaaagtccgctccggcgggcttttgtctgtcaccttcattccatttctgtatataatgactgtataaaggagatactggtaaatcctgcgaagaatgtcgaggaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttacagaaccgatcggccgcagaagtcttgcagccagtctcggattgaccgagcgcgttctcagaagcgaggttcagttcttaaaagaacaaaatctcatcgatattaaaacaaacggcatgacaatgacggaagagggctattcactgctttcgattctggaagatacgatgaaggatgttttaggattgacgcttttggaaaagacattaaaagagcggctcaatctaaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgcctgattcaaaaaaccgcgagctcctgtttgtgcccgcaagaggcggtttaggcgaagatgtgaaaaaccaggcgaacaccatatgcgcgcatatggcggaaaaggcttcaggcacttaccggcttttgttcgttcccggccagctgtcacaaggcgcctactcatctattattgaagagccttccgtaaaagaggtgcttcagacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagctcgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcagttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaacttaacaaagacgtaacggctgaagacgtaaacgcagctcttaaagaagcggctgaaggcgatcttaaaggaatcctcggctacagcgaagagccattagtatccggagactacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgagctgcgcttccaacaatcaaacaccttgcagaccaaggcgcgaaagttcttcttgcgagccacttaggccgcccgaaaggcgaagtggttgaggagcttcgtttaactcctgtcgctgcacgcttaggcgaactgctcggaaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacctgatcatcggcggaggtcttgcttacacattcgtaaaagcgcttggctatgaagtcggtaaatctcttcttgaagaagataaaatcgaacttgcaaaatcattcatggaccgcgcgaaagaaaaaggcgttaaattctatatgccggaagacgttctcgttgctgatgatttctctaacgatgcaaacgttcaaatcgtgccgatctctgagatcccaagtgatttagaagcgatcgacatcggaacgaaaacccgcgaaacgtacgctgaagttatcaaaaacagcaaacttgtcgtatggaacggacctatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccgggtgtagctgcgctgaacgataaataaaaactgctataaggaagtggaacagatgagaaaaccaattatagccggtaactggaaaatgaacaaaacactcggcgaagctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggacactctgagcgccgtgaaatgttcgctgaaactgatgaaacagttaacaaaaaagcgcatgccgcttttaaacacggcattgtgccgatcatttgcgtaggtgaaacgcttgaagagcgcgaagccggaaaaacaaatgatcttgttgccgatcaagtgaaaaaagggcttgcgggtctttctgaagagcaagtagccgcttccgttattgcgtacgagccaatctgggcaatcggaacaggcaaatcttctacagcgaaagatgcaaacgacgtctgcgcgcatatccgtaaagtcgttgctgaaagcttcagtcaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttaaatatcggcgccggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgatggaggcgtacacagtcacatcaatcatttattcgcgctgctgaaacttgcgaaaagtgaaggactgacgaaggtgtatattcacggtttcctcgacggccgcgatgtaggtccgcaaacggcgaaaacttacattcagcagctgaatgagcagatcgaagaaatcggtgtcggcgaaatcgccagcatttccggacgctactactccatggaccgcgacaaacgctgggaccgtgtggaaaaagcgtaccgcgcaatggcttacggcgaaggcccgtcttaccgcagcgcgatggatgtagtcgacgattcttatgcgaacggcattcatgatgaattcgtcattccgtccgtcatcacaaaagaaaacggtgaacccgttgcgaaaattcatgacggcgattctgtgattttctataatttcagaccagaccgcgccatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtcggtgaagtattagcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccattatcgctaaaggcggacatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgaccggaacatctttaattcaaaaataagcgtaaatcaaaaggagagacaaactcatgccatacattgttgatgtttatgcacgcgaagtccttgactcccgcggcaacccgacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcattgctccagagcttctcggctttgacgtaactgaacaaaacgcaatcgatcagcttttaatcgagcttgacggtactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaacgtagacattcaagaattcatgattatgcctgtaggcgcgcctaacttccgtgaagcgcttcgcatgggcgctcaaatcttccacagcctgaaatcagttctttctgctaaaggaatgaacacagctgtaggtgacgaaggcggattcgctccgaaccttggttctaacgaagaagcgcttcaaacaatcgttgaagcaatcgaaaaagccggcttcaaacctggcgaagaagtgaagcttgctatggatgctgcatcttctgagttctacaacaaagaagacggcaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggtgacgaccttttcgttacaaacacgaaaaagcttgctgaaggtatcaaaaacggcgtaggcaactctatcctgatcaaagtaaaccaaatcggtacattgactgaaacattcgatgcgatcgaaatggcgaaacgcgcaggctacactgccgttatctctcaccgttccggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaataccacggtatcaactctttctataacttaaataagtaatgtaatggacgccgggagaatatctcccggcgtttttttatggtcccgggcttttccctcctttttcatcatcttcatttggtcaataatattcatttttcccctttttaaaggaatcagtgttcttcaatcgaaagggaagaggtgttaataagaggagggattatgatgaaattttcatttatgtcagccgcggtggcagcaagcgtcatatggggcgcgtctgccgggccgctgtccgaaactcatgcttattcaactgtgaccgcgccggtttttgatgctgatgaggcattggacactatgcatgatctgagtgaaaccatcggtccgcgggaaaccggaactgcgaaagaaaaggaagcggctgaatacatatcgaatcgtctgcgggctcagggcgccagtgtcaaagtacagtcatttccattgaaaaagtacttttcaggttcagtcacagcgggagatcatgaattcccgctccgctccgctgatcaatccgctgttgaaaaagagctcaaaatagaaggcgggatttttgacggcggctgcggatcacgcaatgacgtaacaggagccaaaggaaagattgcagtgatacgcgaaggaaagatccccgtttctcaaaagatcaaacatgccgaacaagcgggagccaaagcagtcattatttataatcagacaacaaaaccgctcgccgtccgtccgcataccgataaaggaatcacgataccggcggcgggtatgaaaaaagaagacggtgaagcattgcttcaggaaaagaaggcagtcattcaatttaaaaactataaaaaccgcacctcacaaaatattataggaacgcgcaaagcggcacaggccaactcttctgatgctgatattatttatgtcacagcgcattatgacagcgtaaaaggcgcgcccggagcggatgataacgcctcaggcacatctgccgttctggaaatcagcaagcaactcaaacatataccgaaagacaaagagatccgctttatcctgttcggtgcagaagaattatggtctgcgggttcatcttattacgtcagtacactcacggataatgaaagaaagcacagccgggccaattttaatgccgatatgattgcgactgactgggaagaagcgagtcaaatgtgtgtcacgactcctgacggcagggaaaacccgagtgtccggtatgctgaaaaagccgctgaaaaatcccggttggtcaagccaaacctgattcagctcggttactcagaccatgtctctttttatgaagcggggattccgtcggctaactggatttggctcagccccgatacacaggagccggggccctggtaccacaccgaaaatgataatatgaaacacatcagcaaagaacggctagagaaagctggagcactcgtttccgcggcagtaactgaggcaatgaaggaataaaaaacaggcttcggcctgtttttttatattattttctgtatattctatcaattaagggagattttctcactcgttaccagatatataccatttgacaggattttattttacaaataaaagaaaaataaatagataatacctaattcacaaaaggatgtaaaactcatttatcaaattttaacttttgttataattgcgatatcgatcgatatttgttttaaattgtaaaaaacaatactcttttctatctattagggggcgaaaaatgaatactgtcacaaaagaagccagcaaccttggtcaaaaacggctgttacatctgattgaaacgaagcaggcgatagtaggcgtgttaggcatgggatatgtgggatttcctcttgcgctggaatgtgtcgataaaggatacaatgttatcggatttgacaaaaacagtgaaaaggtttccttgttagccgccggaagcagccatattcaagatatagaggacggcagactgaactcggctttacaaacaaaacgctttcaaatcagcgccgacatgtcgctcatccaaaaatgcgacatcattgtgatatgtgtgccgacacccctgaacaaaaaagacaagatccccgatttaacctacatcgacagtgcagttgacagcatgatcgcttatggaaggcagcatcagcttttaattttagaaagcaccacctatcccggaacaacgaaaaaaaagattgccgacagaatggcatcaagccgcggcatgaaaataggaacagacttttttacggcttattctccggaaagaatcgatccgggcaacaggcaatatgaagtttcagatattcctaaagtagtcggcggaaccacacagacttgcacagaacttgcctcagcgttttacaacaccattgttacaagcattcacccggtcacctcacccgaagtagctgaaacagctaaactcctagagaatacttatcgttatgtcaatatagctcttatcaatgaaatggcgcttaattgccgtgaacttgatattgatatatgggaagtcatctgcgcggcggacacgaagccgttcggctttcaaaaatttatccctggccccggagtcggaggccattgtatcccgattgatcctttttacttcaaatggatcgcgaatgaaaaagggctgcagacaaaattaattgatctggcggacgaaatcaattctaacatgccgatttctgtctctgactatgctttgaaactggcgggcaaagacaaatgcagcatcttaataataggggccgcttataaaaaaaatacaaatgacccgcgtgaatcctcagtgtttacgataatggaagaattgatggacaagggatgcgcgattgattatcatgatccgtttatcagcgagatccgcttgaatgacggaagccgcaaacaatctgtccctttcacaaaagaacaaatcaatcagtacgacgtcatcatcattcatacagatcacgatgtaatcgactacagtattttgaaggatgcctcaccgattatctttgacacaagaaatgtatgcagggaaaaatcagccgacaattgcagagttgtcactttataggagggaacggtcattagtaatcgatttatctcttttcacagacctgatatgacaaacgaagaaatcgcaagcgtaaccgaaacgattcagtcgggctggatttcgaaaggcccgaaggtaatcgattttgaaaaaaagctgggagaatgtattggagccgaacacgtcatcagctgtaattcaggaaccgctgccttacatatggctttattggcgctcggtgtgggagaaggcgatgaagtcatcgtgccgagcttcacgttctgttccagcgtcaatgtcatcctgcacgccggagccgttccggtgtttgcggatatatgcgagaaaagtctatgtgccgatcctgaagatgtcaggaagaaaataacgccgcgcacaaaagcggtaattgcggttcattttgccggctatccggctgatctggaaaacttgcagtccatttgtaaagaaaacggattgtatctgattgaagacgccgctcatgcgctcggtacaaaatataacggaagcatgatcggcactcacggtgatgccgtgtgcttcagcttttatgccaccaaaaatattacaacgggggaaggcggagccctcgtcatgaaagacgaacaggccgcagaaagagcgaggctgtacggctggcacggcatcacaaaaaatgcctggaaccggtacggtgaaaaaggcagctggagatacgacgtgttactgccgggctttaaatataatatgacggatattcaggccgcgctcggtctggttcaattgaagcgcgcaaacgaaatacaagaaaaacgggcacagatcgctcaattttatgtacgtgaactgtcgggccaatctgacaaagcagcgcttccgctttctgacattccgaacggcataacgcactcatggcatttatttattttgcggatccgagagaacggcggcatggacagagatctgtttattgagaaaatgaaagaaaaacagatcgggctgagcgtgcactttattcccgtgcatatgcatccttactatcaaaaacattttccggccgagcttccggttactgaacgtgttttccgggagatcgtgtcactgcctctttacagccagttatcagatgaggattgcagctatattgtcaagtctataaaagaagttttgactatcagccaggaggtaggatcatgaaacatattgcgattatcggaggagccggttttatcggaagcgaattggcggcattattacaggctaaaggttatcacaccattattgcagaccaaaaggagccggcttttgacactgaataccgccaaacggatatccttgatcggacgtccctccgcgaatcactgcggggagcggatgcggttgtccatttggcggcaatggtcggtgtagacagctgccgaagcaatgaagaagacgtcatacgggttaattttgaaggaacgaaaaatgtcaccgaggtatgcggtgaattgggaatcagaacacttcttttctcatcgagctcagaagtattcggagattcacctgattttccttataccgagacaagcagaaagcttccgaaatcggcttacggaaaagccaaactgcaatcagaggaatatttgagagaacaggcttccgacaagcttcatattcgggtcgtccggtactttaatgtatacgggccgaaacagcgcgaggattttgtcatcaacaagtttttcagcctggccgagaatggctctgagctgcctctttacggggacggcggacaaatacgctgcttcagctacatcagtgatatcgtcaccggaacttatctcgcgctcattcatgaaggagcagtctttgaagacttcaatatcggaaacgaccagccgatcacgataaaagaactggctgaaaaagtcaatgtgctctctggcagagagaaggataactatctgtttaaaaagctgggcgaagacggcgtgaggggaaaagacatcgagatttttaaacgggcgccgtcaatcgagaaggcgaaacgtttactcggttacgctccaaaagtaagtctgaatgaaggcctggagatcataaaagatgaaagacaaaagcacaaactttcactttcctgaaaacccggaagtagtcaaatatcccgtttatcccggacagctttccgtcaggggccgtctgcgcgcggtgaagcacttgcttactggcggacaaagcggactgactgaaaaactggaaaaacggtacggaaaaggggttgtgctgacctccagcggcagtgcggcactggtgctcgccttaacttattcgggagccgggccggggaaagaagtgattttctcatccttcagctgcccgaatgtcattgatgccgtattgcaatccggtgcaacgcctgtttttgcgcagctggatgagcatctttctttatcgtttgaggatgtcaaaaaaagagcgacgcggcagacgtgtgcggttatcctcacgcacgtatacggccggagagaaaataccgccatcattgactgggcgaaggaacacggtatttttgtcattgatgatgccgctcaagccatgtttacaaaacaagcggatacatatgccggcggtctgggcgatttcggtgttttaagcttcggcccgtcaaaaccgcttgcgagtatcggaggcggcgcgttaatcgcgccgaaagaatggcttcggcaaaaagcaaatttcccgatggaacagcgcagccaagtggcagctgactatcgaatttatatcagaaatcaaagaatacaggctgttatgaaacggaaacggcatcatcccgtttcatatatttataggaaagcgggcgtcatgccttccatgaaagccactaagctcgaagctctgccggataaaccggctgttgtaccggtgcttcgcatgcatccggcaagggaagccattattgaagatcagctttcacgtatggatcagcttgtaacagcttcgctccgaaacttacaagcggcgggagaaatctttataaaggcggaagagacgtacggcataaagatgatccagccccaagaaggagaacatctgaattatttaacgattgtattcccccgggatgaagagcggtacgggtgttccgtttatttagctgaaagaggcatccaaacatgctggaactatcttcccctcggacgtattccgatttatgaaacatatgcggcggaagaaggggaagatccgctttggaaaagagttctttctctgccgtttaaacctcctcttcaaaaggagcaagtcagatatatagccgaatccgttttatcatattgtgagcaaaagaataagactgaatagtggtgataacaatgcaaaaaacagcagtatgcacgagccgccaggcatgggatcgggccgctgacatgtatcaggcggggttgtttcaaagctatgattggggaattctcatggaagagcttcccggcacgtcatttcaccctgtcagactgacaacggacggaggacaggtcatctatcttccgctttttgaacagaagggcgtattatccggcaatatgatcggatacggcggcgttatttcagatcgccccatctcatttgaatggcttcaaagtgaaatcgaggccatattcggccggaacatatcccggatgctgctgccgtacggtcagacttcttttacagaagaaatcggggaaggatggacggaaaaggcgacacggattcttacgcttccggacacgtttgacgaactttggacgggcatttccggaaaagcccggacggcagtcagatacgctgaaaaagagaatattgtcaccaggctgatcgggcgacaagaacttgaatcattttacgacctctacaaggagcatacggcggcaatcggcgctgcttatgtgctgagtcaaggatttttccaaaaactgcttgacacgtttggggaccggatgttttgggtcggagcatatcaggatgagacgctgatcagcagcagtatttttctctatgaccgctctcatttctattattggcagaatgtaaacagcctggcgggaaaaaaagcgcaggcctcttacttgttgatgcgtgacgctttgcaattcgccatcagccgcaagcttcaatgggctgattttggctattcacacagtaaagaaatcgcaagaccgaaacgatattggggagctgaagaaaaacaatgccgactttttacgaaaccggaatgaaaacaataagcggccatcaatccagttatctgccgtggtacggtttttttgaaaaaatgtataagtcggatctgtttgccattcatgacacggctcaatttgagaaaaaagggtttctgaaccgcaacagaatcaaaacgccgcagggccccagatggctgacggtgcctttgcagatgaaacaatataaagacatagagcttcggcatatgaaaatcgaccagacacaggattggcggaaaaaacattggatggcgattaagatgaactatgcgaaagctccctattttgagcggtaccagcatttttttcaagatgtctatcagagggagtgggaatatctccatgatttgaatatgcacatcattgaatttttccgaaaagagctccgaatcgaaacgccgctctgttatgtctctgagcttgaatgccggaaggagaaaaaaagcgattttgttttagcgctttgtcaggagctgggggcggatcgttattattcaggcagtcagggttccgactatttaatagaaagcgattttgaaagaaacggaattgtcattgagtatcagcagatccggcattttgactatcctcaattattcggggagcatatccctcacctctccatgcttgatatgctgatgaactgcggagcggatacagctgaaatgttagttaaaggagggcaatatgatgaaagtaatggtatttgcagcgcatcccgacgatgaaattatcggcgtcggcggcacgctcgccaaacatgtccgccaaggtgacagcgtgtcggcagtcattatggcggaaggcaagtcatcaagaaaaacggattatgagaagcctgaagagtccgttatgcagcattctgctcaagaaacggaacaagcgctcagcactttgggcatccatgattttgtcaggctgaaccttcctgataacagaatggattcaatggatttgctggatgtcgtgaaggaagcggagaaacaaatcaatcgttttcagcctgacattgtatatacccagtacggcggtgacattaatattgaccactccgtcgtattcagagcggtcatgaccgcaacccgtccgcttcccggccatacggtaaaacgggtttttgcctatgaaacattgtcttcgacggaatggaattattgtcagaaggatcagtttcatgccaatttcttcgttaatattgaagacgagcttgaaacaaaattgaaatcgatggcgtgttacggctccgagctcagagacttccctcatccccgttctttgcaggcgattgaacataatgcccgtgtatggggagcaaaatcgggtttttccgctgcggaagcgtttatgcttgtgagaggaacatggtgactgtcctatgattgctcaaattccgtttttcggacttgatccgaagcaaatcgatgagaaatgggtggaagcgggatacggtctggaagcgaatatttttgacggcagctcctttagtgaagcggattatctcaaaacattcaatcagacgctggaatatgcaaaacagctggatccttcattattgacgctgcatttcccgacagatcatgccgattatgtgcatgaagatcacatcaaaaaacagctttatcactttgcggagctcgctgtgaaatacggcgccaaaggcataaccgttcatgcgaatcaatttatgacggttgaggaatttcaagtgtatgacctggaaggaaaccgtaaaaaaatcattgagtttttcgcagagtttgatgagcagctgaaagggacggacatttggatcggtgtggaaaaccttccgatcatcgggaatctgggagaggattttgatccgattttcatttatcctgaggattttacagagctggttcagctggatctgaagcatgtcggtattacgtgggatctgtgccattgggcgattacctatcagactcacttgtcttccgcgcttatgttcagaaatgaccagctgagatacccggatttctttcagtttctctcgataaaagagagcattaaacattatcacttcagctcatttcgccagcttgcgttcccgcatggcggcgtccgctgttttgagggccgccatccgagtgaagggacgatcgctgaggagctgctgagacgggctgccgatactttgcaggagctttatcggaatcaagataccggcattgtatttgaggtgatggaagaggattatacggaaagacgggaatcatggagaacgctggaatggttcggcggtgtttctgatgccgaggatcaaaaaagggcctgatatgacatatcgaacaccgaactatgcaaagctttggtgtgcgcaggtgttttcttcagcggcggacggtatctggcttattgcactgccgctgttagtgctggaattgaccggcagtaaaattcttgtcggcgttatttcttttatcgaactcgtgccgttgacatttggcgtgctggcgggaccgctgattgatttattccgaaaaaagtcgatcttgtatttgtgcaatacgggccgggccgtcatcatgatcctcttggcggtgctcagcgcgaacgatttattaaccgtgtggatagcaggggtgtgcgccttttgtctatctctgcaatcgatgctgtttgcgccggcgaaagtcgcgatcattccgctgctcgtccgcaaacagcatcttgatcaggcgacatctctgatcaatacgagtgacttgatcggactcatcgtcggaaaactgatcagcggaatcatgattgcggctattccgttcgggctgctgtttgccataaacggaactgctttttttatctccgcggcatttatcgcgttcattcgtatttcagaacagcccaatgaaaaaagcaacggggctgaagatgtaaaagccggctacagaatgctgaaaggaaatgcggcatggctgacatcggtcggatactttttcgtcgtaaatctcgtcattgccggtcttatttcagtaatggggccgattcttgctgtggaacgttttcagcagaactattctgtatggtttgccgtcatgtattcaatgtttcaggcggggatgcttttgggcaatctggccgtatttttcaaatggaatacaaaacgcttgaaccggctgtatccgcggacgttaacggcagcgggactgctcattttggtgctgttttttccgcttcacgggtttgagtgcatcattttcctggtgcttggcatcatcatctcgtatattgatgtgcaaacggtgctgtatttccaaaagacggttccggccgcatatttcggaagggtttttgcactgattttttccattgtcaaaatgggtgaaccgctgtctgccgctgtctacacagggcttctgctgttgatgaatgcggattatatttttgcggcggtcggactgacccttacgatcgtttttgctgttttttcagtcagacaagggagtcaaagaaattcagagaaacaagcggatcaatccgtctgaatggtaaacgaaggggcgccggtatcagccggcgccctttttatcataaatccaaataaagccgtatcatatcccggcattgaatgccgttttcaaaaatgtcttcatcataatgtctgataaaaaaatcatggtcgacagcctgaatgcggaatccgcatttttgatagagtgacagctgatgaatactggaatttccggtgccgatttcaatcgtgtcagctcccgattgtctcgctttttcaatggcatcttgcaccagctgttttccgaatcccctgttctgcagcgattcttttaccgcgatgtttacgatttctatcgttttaggccttgtttgcaataaaacgtaaacccctgcaagctcgtctgacgtccaagccgtatagcattctcctcttacaagataatcatcgacaatctctttcgacggatcggccagcagcaatagttcatacagcgcttcatccggatccgcggcttttcggatgctcagtttttgcatgtccgtttctcctcctccgttatgatcgacagctatttttcaaaataactccaaaatcattctactttattataaaatatgaaacataggaaaagttatacaagttttgtagattgaataggaggaaagtcatgtttttttgtaagtattgcggccgacagaacaacgaagaggcgcatttctgtaaagaatgcggaaaaccgatcgggaaaggaagccggcttgaacggcaggcggctgtaagagcggctgaacctgcttcacaaatgagaaagccgatccctaaaaaaacgctcttcatatggggcggcatagccgcagcgctgatcttattgattgccgcatataaaaccggagcctggctgacatctgaaaaaaggctcacggatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggaaacgcttcgcggcaattcatcagaaaaagatgcggtatacgtcaaaaaagagggtaaaacccttcttttgtttgaccattacgaactgaaagtcgatccggtttatttccgcgtcaccagcaattataaaggcgccgatctttatatcaacagcgagaaaacagggacggtcaaaaaagccgatgaaacccaaatcttcggcccgtatgcacccggtgtctacacggcggaagccaagcttaaaaatgacacggttgacgttgtcaaaaagcaagaggcagaggcggccggcagccggaatgttgattttgatctgccgttagacgccgaggatgtgacgttcactccggcagacagcttcaaaagcgcgaaaggcgatctgctgataaacggcaagtccgtccataaagatccgtttacatccgttacatacggtccgctcttaactgacggttccatgacagccgccgtggaggctgattttccttggggaaaaatgaaaactgccgatgttccgatcaacggtactgatatggaattaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaagatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcattatgtactctcatatgatacaaaacataaaaaatgggtttttgaaaaagctgatccagcctcagattcttctgggacaaatgtaaaaaaaataaaaaacgaccagccgaaaacctatacatccgcatgggcatcttccaaaggaaatacagcttcaggcagcgtgacaaacgagcaagtcacatcgtttatgactgattacctgacaaatcaatcaagcgccgtcagccttaacaattttgccatcatggcgggcaatttagaagagggaagccctttgtatgctgatcagcagaaactggtcaaaaaactgtacagcgaggggacgactgaagtatttaataaagtgaatgtcaaaagcttttcacagaaaggctctcatctgacgattcatacgtacgaggagttttatattacgaaagccggcggcagtccgaagctcagaacatacaattggacgtatggcggcgttgtcaaagacggaagaatttatttaacatccattcaataaaaaaacccccgcgccaatcaggcggcgggggtttccgtttttaaaagaagaaataattcatgagttctttcatataatgcttgatcgtgaattgaaacgttacgcaaatgatcaaatagatgacgataacagaataaatgatatccgccttagcagtgagctgatgctgatagctcgccagcatgagcggaggcacggcaaacgccgctcctaaaagaccgacagccagaatggtaaagcaaacggttgtatgaagcagcataaaaatgagggcaagaagcaaaatagctgtaaacggaatcaaaaatgctccgaatctggacagcgaatctttaaatgacacctgcgcgccgccggccttcaaagcgataaaaatcaagagatacaggcagaaaacgcataatgcaaaggtaagcgccggtttgatcacaaccgcggtaaaactgacgtcacgaaagccgtctgataagagaatataaaacataatcggcgtcaccaggcagaaaagcaccatgttgatgatgctgctgacaagctgttcgccgcctgtcgttttacatgtttgatacggtctctttaacacatcaagcacgaataaggcaaattgctttgaagcctgcttagccgcggcgccggcctgagcggcctgaccctgtgtttggcctgcgcctccctgcccgggctggggcgcaccgcatttttcacaaaattttccgccatcagtatgatggccgcattgagaacaatacattctaaaactccttttacaagtaatatagggattttgttcaatatttacattataaaagaaaataggacggatgtaacggagttttctaaagatatataaatcaccttctctatgaattgataatagagaaaaagtacccattatggtagaattttattggagctgatagatatcatgtctctcggcgcattgattcagagtgaaaaaggaaattaacgcatgctaaaaaaattgaaaatgctttatcggctgttgaaattcggaaaaggcttatggagatagcaaacagaaaaaaaccgtccttacaaggacggtttttttctgttttccggatcgtccggctgaggttataaaaagcagaccccggggtaaaaatcatgcataagaaacagcggagaacaaaacataactcaataacggcaagtcataaggaggtacgcatgttttcattcatcattcatgtcttcatttcactgtttgcagtctccaatcccatcggaaacgtgccgatttttctttcactgacggaaggatacccggagaaagaacggacagcgatcgcacgcaaggcttccgtgctgtcgtttatcatcttggctgcttttttaattttcggccatctgatctttaaactgttcgacattaacattcatgccttgcgtatcgcgggcggcatttttattttcggcatcgcttataatcttctgaacgcgaagaaatctcatgtacagtctctccatcatgaagagaaaggggagagcaaggagaaagccgatatatccgtgacgcctttgtcgattccgattatcgccggacccggtacgatcgcgacggtgatgagtctgtcggccggccatggcggcatcatccattacatcagcgtgcttatcggcattgcggccgtcatcgcgatgacgttcatcttctttcactattcttctttcatcagcaataagctcgggaaaaccgaaatgaacgtcattacccgactgatggggctgattttggcggtggtggcgatcggcatgatcggcgccggtctgaaaggcatgtttccgatattggtttcctgacttaaaaaagcagcgcccggttatcttcgggggctgcttttttctattttcggcacatgctgaaacacttcttcactctcaaaaaattctatcaaacggctcagccagtcataataatggagccaatccgtcagttcatccaaaagctgacgggctttttcttcaatattgggactgagattttccgattccagaagctcagtcagctcgcggttcagctttttatagagcattttgtttttgctgaccgcctttgtccaatttgccgtaaacagggagataaacgtctggtaataatcacgctccacgtcgtaaaggtctttgcgaacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaacttttttttttacaaatttcatcttataataaagattatacttttcagaaaaataacggaacccttcggaggtgcacggattgctgagattagaaaatgtatcgaaagtctataaaggcggaaaaaaagctgtcaacagcattgatttaaatatcgaaaaaggcgagtttatttgttttatcgggccgagcggctgcggaaaaacgacgacgatgaaaatgattaacagactgattgagccgtcatccggaaagatttttatcgatggcgaaaacattatggagcaggacccggtggagctgagacggaaaatcggctacgtcattcagcagatcggacttttccctcatatgaccattcagcagaacatttctctcgtgccgaaactgctgaaatggccggaacaaaagcggaaggaacgggcgcgggagcttttgaagctcgtcgatatgggcccggaatatttagaccgctatcctcacgagctgagcgggggacagcagcagagaatcggcgtgctgcgcgcccttgcagcggaaccgcctcttattcttatggatgaaccgttcggagcgcttgacccgattacacgggattcccttcaggaagaattcaaaaaactgcaaagaacattgaataaaacgattgtgtttgtaacccacgatatggatgaagcgattaagctggctgaccggatcgtcattttaaaagcgggagagatcgttcaggccggcactcctgatgacattctccggaatccggctaatgagtttgtcgaagaatttatcggcaaagaacggttattgcaatcaagaccggacattgagcgcgtcgagcagatgatgagcaaaaagcctgtcaccgttacggcggacaaaacactttcgcaggcgatccaagtgatgcgggagcaccgtgtcgattccctgcttgtcgttgatgacctgaatgtgctgcaagggtatgtcgatgtcgagatcattgatcagaaccggaaaaaagcgagcctcgtcggcgacgtgctccgctctgatctgtatacggtcgagcagggtacactgctgcgtgataccgtacgcaaaattttaaagcgcggaatgaaatatgtacccgtcgttgatggacaaaggcatttagtcggaattgtcacgcgggcgagccttgtcgacatcgtttacgattcaatctggggcgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgctgacgagaatgaaaaagggcgcaggcgccgtcatcggcgccgtcaacattgtgcagaccttgccgagtctcgcgatactggcgttttttatcccgctgttaggcgtgggaaaggtgcccgcgatcgtcgcgctgtttttctattcggtgctgccgattctccgaaacacgtataccggcattcaaggcgtaaacaaaaatctgctggaatcgggaaaaggcatcgggatgacggtctgggagcagatcaggcttgtggaactgccgcttgcggttccggtgattatggcgggcatccgcacatccaccatttatctgatcggctgggcgacgcttgcttcctttatcgggggcggcgggctcggagactatatttttatcggcctgaatctctatcagcctgaatatattatcggcggcgccgtgcccgtcaccattttagccattatcattgattatctgctggcggcgacggaacggaaggtgacgccgaaagggctgaaaggactgaaggaagtatcataaggagttggctgttttgaaaagaaaccaaaagagatggatgtgcgcactggcgctgtcagctgctctgcttctgggcggctgttcccttcccggcctgagcggggcttccgatgatacgattaaaatcggggcgcaaagcatgacggaatcagaaattatcgccaatatgctcgcacagatgattgagcacaatacagacttgaatacggcattaattaaaaacctcggatcgaactatgtccagcagcaggcgatgctcggcggtgaaatcgatatcgccgcgacgcgctactcgggaacggatttaacgagcaccctcggcatggaagcggaaaaagacccgaaaaaagcattatctatcgtccagaaggaatttgagaaacgcttccattacaaatggtttgattcttacggatttgagaacacatacgcttttaccgtcacgaaagagcttgcggaaaaagatcatttagacaaagtgtccgatattaagaagcatgcggatcaatttaagctcggtgtagacaatgcgtggctgaaaagaaaaggcgacggctataagggcttcaccgacacgtacggttttgaattcggcacaacctatccgatgcagatcggacttgtatacgatgccgtgaaaaacgggaaaatggacgccgtcctcgcttattcaacggacggacggattaaagcgtacgatctgaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttttggagaaacatcattattttgaataagaaatgaggtggggcaaatggaagtgctgcagcagctcggcacttattattctcaaaacggggtctatgtgcttcaggagttttaccgccattttctcatgtcggtatacggcgttttatttgcggcgatcgtaggtgtcccgctcggcatcttcattgccaggtacagaacattaagcggctgggtattcgcggtgacaaacgttattcagaccgtgccggcgcttgcgatgcttgcggtgctgatgctcgtcatggggctcggcgccaatacggtgattttgtcgctgtttttatattcgcttcttccgatcatccggaatacgtacacaggaatcgccagcattgaacacgcttatctagaatcgggaaaagcgatgggcatgaccaaatttcaggtgctccgcatggtggaactgccgcttgcgctttccgtcatcatggcggggctgcggacggcccttgtcatcgcgatcggcattacggcaatcggaacgtttgtcggcgcgggcggactcggtgacatcattgtcaggggctcaaacgccacgaacggaacagcgattattttagccggcgccattccgacagcgctgatggccgttatcgcagatcttgtgatggcatggctggagcgggcgctgagtccggtgagaaagaaaaaacgaaccaaagcgccgaatgcggcatgaaaaaaacgccttgcgggtcagggcgttttttttcttatggcttcggaacatgcttgaatatttcttcgctttcaaaaaactcgatcagacggctgatccagttgtagtaatcaagccaatcctttaattctttcagcagttcgttgattttttcctcagcttcttccggcacgccgttttcaaggacggccgtcagttcgcggttcagttttttatgcatcatcttatttttgctgacgaccttgctccatgtggccgtaaacagcgtaataaaggtttggtaataatcctgctcgacgtcgtataaatctttgcggacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaattcggagcaataagaagaactttgccggtcaatacgggtaaatcagtgcttacacaacctttatatataatatggacaaattgtaaactttttaatttacaaagtttaatttataatgggaaacgttcaattgtctgaaaagttaaatttgaatttaacgatttgaacaaatttaatatcggaggtgtgagtgtttgctgacattagaaaatgtctcgaaaacgtataaaggcgggaaaaaagccgtcaacagcatcaacctgaatatcgacaaaggcgaatttatttgttttatcggaccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacatttctctcgtgccgaaactgctgaaatggccggaacaaaagcggaaggaacgggcgcgggagcttttaaagctcgttgatatggggcctgaatatttagaccgttaccctcatgaactgagcggaggacagcagcagcgaataggtgtattacgggcacttgccgcagagccgccgcttatcttaatggatgaaccgttcggggcgcttgacccgattacgagagattcccttcaggaagaatttaaaaaactgcaaaaaaccttacataaaaccatcgtatttgttacccatgatatggacgaagccatcaagcttgcggacagaatcgtcattctgaaagcgggagaaatcgtccaggccggaacgcctgatgagattctcagatttccggcgaatgaatttgttgaggagtttatcggcaaggaacggctgattcaatcatccagccctgatattgaacgggtggagcagatcatgaatcccgatcccgtgacggtaacacctgagaaaacactgtcagccgccattcagctgatgcatgccgagcgggtggattcgctgctcgtcattgatgaaaagaacgttctccaaggttatgtcgatgtggagatgattgaccgcaaacgaagacaagcggtaaccgtcgcggaagtgcttgaacgggatctgtacacggtcagaagcggcactctgcttcgcgacgccgtccataaaattttaaaaagaggcgtgaaatttgtgccggtccttgatgaggacggccggctaacgggaatcgtgacaagggcaagcctcgttgacatcgtctatgactccatctggggagaagagaatcagctcgcggtgatgtcatgaggaggcttcaattgatatgaatcagaccgtacaatttttacaggcaaatggaggagagatgctttataaaacatgggagcatctgtacatctcattaatcgccgtcatggcgggcattctcgccgccgttccgctcggcgtcctgctgacgaggatgaaaagaggagccggcgccgtcatcggcatcgtcaacatcattcaaaccttgccgagccttgccattcttgcgttttttattccgcttttaggcgtaggaaaggtcccggccgttgcggcgctgtttttctattccatgctgccgattctcagaaacacgtatacggggattctcggcgtcaatcggcatcttctggaatcgggaaaaggaatcggcatgacggcatgggagcagatcaggcttgtagagctcccgcttgccgccccggtcatcatggcgggcatcaggacgtcttcgatttatttaatcggctgggcgacgctcgcctcctttatcggcggaggcgggctgggagattacatttttatcggcttgaacctttatcagccggagtatattatcgcaggcgccattccggtcacgatgctggcggccgccgtcgattacatgctgggggtgacagaacggaaagtcacgtctgacgggctgaaaagcataaaggacgctttataaggaggaggtctcacatggggaatagatgcaaaaaacggctgctcgcaatcgcctgtctcggcatgctgctccttggcggatgctcgctcccgggattgagcgccgcatcggaggacaccattaaaatcggcgcgcaaagcatgaccgaatcggaaatcatcgcaagcatgctcggacagatgatcgaacatcacagcgggttgaaaacatccgttattaaaaatctcggctccaacgccgtacagcagcaatccttgatcaacggtgatattgatatcgccgcgacgcgctatacaggagacgcgctgaccgggacgcttcgcatggagccggaaaaagacccggacaaagcgctgcggctcgttcagcgtgaatttcaaaacagatatgacatgaaatggtttgattcttacggctttgataatacatacgtctttaccgtttccggacagcttgccagcaagtaccatttagaaacggtatccgatgtcaaaaaagaagcatctcatctgaaattcggcgtagataactattggatgaagctgagaggcaacggatatcaggattttatgaaaacatacggaatgtcatttgaaggcacgtatccaatgcagatcggcctcgtatacgacgcgctgaaaagcagaaagatggatatcgcgctcgcttattccaccgacggaagaatcatcgcttacggactgaaaatgctgaaggatgataagcggttctttcctccgtatgactgttcacccgtcgttccggatcatgtattaaaagagcatcccgaactggagggcgtgatcaatcaaatgatcggcgagattgatacaaagatgatgcagaaaatgaattacgaagttgacggccgattaaaagagccgtccgtcgtggccaaggaatatttagaaaaacatcattactttgaataacggaaaggagatgtgcggatggacacgatgaatgagctgtttacgtattacgctcaaaacggcagctatgttctgtatgagtgctggcggcactttctcatgtcggtgtacggcgtcgttttcgccgccgttttcgctattccggccggaattgtgacagccaggcacgggcgtctcgccggctgggtgtttgctgtggcgaacgtgattcaaaccgttccggcgcttgcgatgctcgccgtcctgatgcttgtcatggggctcggcgccaatacggtgattttgtcgctgtttttatattcgcttcttccgatcatccggaatacgtacacaggaatcgccagcattgaacacgcttatctagaatcgggaaaagcgatgggcatgaccaaatttcaggtgctccgcatggtggaactgccgcttgcgctttccgtcattatggcgggtctccgaacggcgctcgtcattgccatcggcatcacggcgatcggcactttcgtcggcgcaggcggtctcggtgatatgatcgtcagaggctcgaacgcgacaaacggaaccgccattattctggcgggcgccattccgaccgcgctgatggcggtggccgcagacctgctgatggcgtggctggaacgagccctcagccctgtgaaaaaacaaaaaagaaagctgatcgtacgctcagcctcatgaaaaaaagcattcttccgcgtgaaggatgctttttttgatttcttgattaaattttgataactgcgctgtaaagtcttacatatcaaataacaaagcagaggggtaatcatatgagcaacatcatagtaacgagacagctgcaaaaatcattcggcagacaacaggcagtggctgatgtgtctctatcggttaaacgcaacagtatatacggcctgctcggtccgaacggcgcgggaaaatcgacgactctcaaaatattgaccggcatgctgcagcaaacatccggcgaggttctgttcgacggacatacatggaagcgcgaagatttgaaaagcatcggttccctgattgaagcaccgccgctttacagcaacctgacagccgctgaaaatctgaaagtccgctgcgtgatgctcggactgcctgattcaagaattgcggaggtgctggaaattacgggattaacgggaaccggaaaaaagcgcgccggacaattttccatgggaatgaaacagcgtctcggcatcgcgttagcattattaaaccgtccgtcgctcttaattcttgatgagccgacaaacggattggacccgatggggattcaggatttgcgggaattcatccgctccctgcccggacagggaatgacggtgattttatcaagccacctgttatcagaagtggagcagatcgcagaccatatcggaatcatcagtgacggcgttttaggatatcagggagaaatcagccgggaagacgatctggagcggctgtttctggaggttgtcaaatcaacacgggagaaagcggggacaggaaaatgattcagtacatgcaggcggaacaccttacatctaatagaacatttatcagaaagctgatcattctgattccgcttctgaacgcggctttttcttttctgctgaatgccgcctattttatgacgggcacgttcaattggtgggcggttattttcatgccgctcatgattgctctaatgtgcggtttatctgttaaaaaagagaaaaaatcagcgaatgaccgcgcggtgtactcattgccggcagatttaaaaagcatatggttctcaaaaataagtttgatcgcgctgtattcactcctgtcgcaaatcgtctttttagtcatcgtgtttttgcttggccttgtgtttccggcaattgctgcggttcagctgaaaggtattgaagcaagctcccttttgtggctgacgacgctttgggaaatcccattgtgcttatggattgccagacagttcggatttacggcagtcattctcatcaatatgatcgccgcctttgttttaggcattgtgccggcgtccggttcattgtggtggctgagtccgtggagctggtcagtccggctgatgtcaccgattctcgggatccacccgaacggaattccgcttcccgcaaacagcggcttattaaacggaaacgtgatctttccggctattattctttctatcctttcttttatcgcaataagtttgatttccgcagtgtctttttcaaaagggggaaaccggtcatgaccgtgcttttacgatatatgtgggccgatgtattaaaaatgaagcgcacgccgctcatatggatgcatgctgcggcgccggttttatgcgcgggatttttcctgttatatatgtatggaagggttcaggagtcttatatgctgtacagcgtctttttcagcgcgattgccgttttataccctctgatcatcagtattgtctgcggcatgtctgcctctgtcgaggaacaggcgggcaattttcagatgatgctggcggttccgtattctaaaatcgtcagttttgcgggcaagctgcttctgctgctcctattgaatgtgttatcggcaggtctcgccatctgtctttatttggcggggttgaaatttgttcttcacatcaatgatctcccgtatcttctctttttaaaaggaggggcgtggctgattgccggcagtattccgctttatatgatgtctttttttgtcggcataaagtacggcatgggaccgtccgggcttttagggggtgcgggattattaatggcagcgctcatgaatacgggacttggcgatatcatctggcgtttttttccgtgggcatggagcgtgaggctttcaggccttgcaggactgctgcattttgacaaagtcaaaaaagagttcctcccttatgtaagatacgatatgagattcggagaaataatgttatatttttctatagtgatattatgtctggccggcctctattggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctcgaaaaagcggaagatcagtcattggatttttttcaaggctatgatttgattcttcttgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtatggatggatgaccggaaactgcctcttacgaaaaacgaatataaaatcgttgaatttctggcacagcataaaaacagaacattctcacgggagcagatttacgaggaagtgtacggcttggacggcgatgcgctctattcaaccattacggagtttatcagaaccatccggaaaaaatgtaaagaacacggggctgatccgatcaaaacggtgtggggtgtcggatacaaatgggaatagcaaaaggaaaatccagcatccgcaaagagcttgtcaaatttaccatcactttgtgtctgagcacgatgggggtggcggcattatgcgtcgccttaaatgccattgccatgaatgccggagcgatcctgcccgcaaactacagcgagcatgaggcggaacagatcaaaccccgcctgaaatcagcggaaaagataacagaagacatgatccccgcaggtatgacatacgccgtttttgataaaaaaacaaagcggatgacaaaaggaacgatgacggaacaagatgcggccaacgccagaaaaaagattcagcatcagccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgactgtttttatcgtgacgacgcgtttcgccaatcagctgagacggcatttcagcacactcagctccattacggcaagcattcaaaaacagaatttaaatatcaatcccaaaaggtcgcgtataaaagaatttgacgatgtcattgactctctgctgaaaatgaaagacgcgcttcaggcatctctggcggcgcagtgggaggcggagcggataaagaaagaacagatcggcgcgcttgcgcatgatattaaaattccggcaacgatcattaaaggaaatgccgagctgctccagttaacagaacctgatgaggagcaggcggaatatgcgcagtatatcctggatgccggaaacaaaatcgagcattatgtcggacagctgatccagctttccaaagcagaggaggcagttgccgttcatgtcgaatataccgacctcaaagagtggattcaaaacatatatcgtgacgcggcggcgcttgcggggccgaagcagattgatctcgtcctcagcgaacggggaattgaccgaatagaagcgccgatcgatcatgagctgctccacagggcgatcatgaatatcgcggcaaatgccgtcgactatacgccggaaggaggggaaatccgtgtggacgtcctgtgcaccgattccgccctccatcttgccgtatccgacagcggaagcgggttctcgccggaggcgctgaaaagagcgacacagcttttttacacggaggataaaagcagacattcggcggggcatcacggcatggggcttacattcgcccatcacgtcgtacatcttcatcacggcgaattaatacttgaaaatcaggagtctggaggagcccgggcggagattcgaattccgctggaaggcgtcagacaaaaacaagccctgcacgcctgagggcttgtttttctgtataagaaaagcaaaaataaaaacggctgtccgtttgagagatcagccgcttatgcggaaaagagtttatcaggaaggatcaatccatgttgaagaccacttggaaatttcctctaaaataggggctaatgcgcagcctttttccgttaaagaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtacgtctggcgcttgttaagttgaggagaggatcaaaaagaggatgaggaatccggggagcgttttttcgcttcagccgcaataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggaggtttcacggatttcctcctgaaatgccttgatgtgtccggcccgcgccattaactcctcgtacgggatttttaatgtgtccgccaattttctgatggtcgcgggtttaggaatgccgcggtgcccgttttcaattctggaaatggtcgcagagctgacgccggaatagacggcaagctgattgacggtaagcttccgggcgcggcgcagctctcttaattgctttccgaatgtgttcaataagatcgcctcacatgtgcaaagtcatgagtcttcatttgttctttttttggcttccgccgataagaacgcaaagtatttatcaagcagaaccaagtcttctttcgacaggtgccgccagttctcccgctccaaaagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcactccgcgtttgccgttttcaatccgcgagattcccgcggcgctgacgcctgaatacgttgccagctgattcactgtcagatgccttttttcccgtaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcgaaggccgggccagctggtcatcggaaaaatgctctattactttgacatgaaatttgaagatcttttttactacgactttgttgacaaaagtcaatgaagatggaagattcaaacgcatttccgtttttctgacatgatgtacaccgatacggcgtgacatgcctttgtttttcatgtaaaatagaagcaatgtaggccagtcagtctggaggtgtatgggatgcacacattattgattaccttattggttatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctagcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagagctggtacatacgggacctgaagattggtggaaagacgtcatggacggttatgagtatttacggtctgaaggctatgaaaacattgcggcgtgcggactgtcgcttggcggggttttttcattgaaattgggttacactgtacccataaagggaattgttcctatgtgtgcgccgatgcacattaaaagtgaagaggttatgtacgaaggagttctctcctacgcgcgcaattataaaaaattcgaaggaaaacagccggagcagattgaaaaggaaatgaaggagtttgaaaaaacgccgatgaatacgctcaaatcgctccaggagctgattgccgatgtgcgcaaaaacgtcgacatgatctattccccgacatttgtggttcaggcacggcatgaccatatgattaatacagaaagtgcgaacatcattttcaacgaggtggaaacggacgacaaacagctgaaatggtatgaagaatcaggccatgtcattacactcgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccattcaggaactcgaggagatgctgaacatcacggaagccgatgaatttaaagagctggtaaaagcgctggtggcgctcgaggagacgggacagatcgtccgcaccagaagcaaccgctacgggcttccggaaaaaatgaatttagtaaaaggaaaaatttccgcgcatgcgaagggcttcgcgtttctgctgccggaggatacctctttaagcgacgtgtttattccgccgaacgagctgaatacggccatgaacggcgatattgtcatggtgcggctcaattcccagtcaagcggatcgagacaggaaggcacggtcatccgcatcctggaaagaagcatcgaccgcgtcgtgggcacatacacagaaacgaaaagcttcggctttgtcatcccggatgataagaaaatcacgagtgatatttttattccgaaacatgccaataacggcgctgcggaaggccataaagtcgtcgtcaaactgacaagctatcctgaaggcagaatgaacgccgaaggggaaatcgttgaaatactcggccataaaaatgatccgggcatcgatattttatccatcatccataagcacggcctgccgggagattttccggctgaagcgatggagcaggcaacaagcacgcccgataccatcgatgaaaaagacatcaaagaccgccgtgatctccgcgatcaggtcattgtcaccattgacggcgccgatgcgaaggatctggatgacgccgtcaccgtgacaaagcttgataacggcagctacaagctcggcgttcatattgccgacgtcagccattacgttacggagaattccccgattgacaaagaagcgctggaaagagggacaagcgtgtacttggttgaccgggtcattccgatgatcccgcacagactgtctaacggaatctgttctttaaatccgaaggtcgaccggctgacgctttcctgcgaaatgacaatcaaccagcagggacaggtgacggagcacgagatcttccaaagcgtcatcaaaacgacggaaagaatgacctattcagatgtcaaccggatccttacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaggtgctcgtcgatgaggaaggcgccgtaaaagacgtcgtcatcagagagcgctcagtagcggaaaagctgatcgaagaattcatgcttgtcgcaaacgaaacggtggccgagcacttccattggatgaacgtgccgtttatttaccggattcacgaagagccgaacgccgaaaaactgcaaaagttcttggagttcgtcacgacattcggttatatcgtcaaggggaaagccggagacattcatccgcgcgcgctgcaaagcattcttgatgaagtgcgggaccgtccggaagaaacggtgatttcaacggtcatgctccgttccatgaagcaggcgaaatacgacccgcaaagcctgggccatttcgggctggcgactgaattttatacgcacttcacatcgccgatccgccgatatcctgacttaatcgttcacaggctgatcagaacgtatttgatcaacggacaatcggacgaagcaactcaggaaaagtgggccgaacgccttccggaaatcgctgaccatacgtcaacgatggaacggcgcgccgttgatgccgagcgggaaacggacgatctgaaaaaagcggaatatatgcttgataaaatcggcgaggaatttgacggcatgatcagttccgtcacgaatttcggaatgttcgtcgagctgccgaatacgattgaagggcttgtgcacgtcagctttatgacggatgattattaccgttttgacgagcagcatttcgccatgatcggtgaacgcacgggcaacgtttaccgcatcggagacgaaatcacggtcaaagtcgtcgacgtcaataaagatgagagaaacatcgactttgaaattgtcggcatgaaaggcacccgccgtccgagagaaacaacaggcgaccgcagaaaacgaggcagaccggcgcggaaacgcgtgttaaacagcaataccccggcttcaccgccgaaatcggaggaaaaaggggaatggtttacaaaaccgaagaagaaaaagaaaaaacgcggcttccaaaacgcgccgaaacaaaaacgcaaaaagaagaagtaaatgcgaaaagcaaatagggcataatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacggagattaagtccatccgcgccggccgcgtaaacatgaaggattcctttgcgaaaatcgagcgcggcgaagtgttcctccacaacatgcacatcagcccgtacgagcagggaaaccgctataaccacgacccgctccggacgagaaagcttttgatgcaccggaaagaaatcaataagctgatcggcctgacgaaagagaaaggctattccctcgtgccgctgaagctgtacttgaaaaacggcttcgccaaagtattaatcggcctcggaaaagggaagaaaacatacgataaacgtgaagatttaaaacgaaaagacgccaaaagagaaatcgaaagagcgttcagagacagacaaaaaggcttctgatgcctgagccttgatgtgatgatatgccctgtgctatactgttcacacatcagattcacaggctgtttattgaagatattcccaattgaatttgcctgtgatcatggtataataacagtacagccagttgagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcatgaagacgagtgaaacacgaaatatgcaggctacgctcgtagacgcttaagtaatcgatgtttctggacgtgggttcgactcccaccgtctccatacataacagaggaaccgcagtgccatcacatgacgcactgcggttttttcatgccgaaaaaaaggagtgaatgtaaatggaaatcgtcatcatagacggaaaagatgttacaagcacagaagctttacaccgaatcttaaaagatcaattagatttcccggacttttatggtgaaaatctgaacgccttatgggattgtctgacaggctggatagaatatccgctgactttggtgtggaagaattttgagatcagtcagaaggaattgggttcggatgctgatgatgtcttggagctgtttcaagaggctcaggcagaattagatggtgaatttttcattcaaattgatcagccgtcagccgggacaacggacaggcactaaaaagtgcgtacttcccctcatccatttttctatccgataatagggacagaaggtttcaggctttcgatttctgtccatatataagaagagacttgcgatagggaggaatggatgatggatttgcagttgaaagggaagacggcgcttgtgacgggatctacgtcaggcatcgggaaagcgattgcggcttcgctgattgcagaaggtgcggccgtgatcattaacggccgccgtgaagaaaaggtaaacgaaacgatccgggaactagagaaacagacgccggatgcccgtctctatccggccgcatttgatttaggcacggcggaagggtgcggcgcgatttttcagcaatatccggatgtggatattctcgtcaacaatttaggaatctttgaacctgcggaatactttgatattcctgacgaagagtggctccggtttttcgaggtgaatatcatgagcggcgtgcggctgacacgccggtatgcaaagcggatgattgagcggaaggaaggacgggtgatctttatcgcgagtgaagcggccgtcatgccttctcaggaaatggctcattacagcgctacgaaaacaacgcagctgtcgctgtcacgcagcctggccgagctcacggaagggacgaatgtgacggtgaatacggtcatgcccggctccacgaaaacagagggcgtcgaaacaatgcttgagtcgctttatcccggtgaaaacttgacagcggctgaagcggagagacgatttatgaaggaaaatcgtccgacgtcgatcattcagcggttgatccgtccggaagagatcgcccactttgtcgcctttttaagcagcccgctgtcgtctgccattaacggatctgcattgcggatcgacggcggcttggtgcggagcattatataagatgaacataaaaaacccccgcaaagtggcgggggtttttttaatgcggatcacgctgaaaccggccgatgatcctgctgattaaatcttttgttgcacagtcaaagtgctcttctttttggtttgtcaaaagcccgacaggcggtgaaattgttaagttatggatcggaatgaccttcgtgccctcgatcggctctgaatgcgctgtcgccgtaaagattgagacgccgatattttccctgacatagtattgatgagccatgctgctggtcagctccatttttcgatagcggctgccgatggcccgctgcaggtgctgttcaatttgaatccggatcgggcaattggcgggcgtaaaaatcaggcattcattttctaaatcttcgagattaacgcttgctttggcggcaaggggatgtctgtctgacacgatgacattgagcgagtcatggaaaaacggatcgaaataattttccagaatcagctccggctcgccgcataccgcaaaatcaatggcgccctccagcagtttgcggctgcatgtattggcatcatccacgctgacatttaccgacatgtccgggtaatcatttaagaaaccccgcagcacggcagggaagatcagacttgccgtcggttcggatatgccgatctgaataaggccggcctggccctgtctgatatcggccagagtatggtcaagcacctcgtattgcgcgagaagctgcccggcccgctcatgaaacagccgccccgcccttgtcagcttcagcttctttccacgttcaaacagctgcgcgcctacatcctgttccagctgtttaatccgcattgaaatcgtcggctgtgagtagttcagaatttctgcggccttataaaagctgcctgactgtacgatggtatgaaacgttttaatggtgcgtaattccaacgaaatcccctcccggctgttcattaattttcttgaacctttcctttactttttttgattagtcaaataaatcagtttgctttatagtataaacaatcaaagcttagtaaacaaattggaattatatattttttgcggggagagtgaccggaatgagtgaagacatatttcgattggctgagaaaaaggatgcgccggagtttttagagctgctgtacagcgcgtttcagccgatccgcaatttggagattgactggccgtcggcgcgggccgacatcgatatggtaacggaaaatattgaaaatcattcagccgtcgtgctcgaacgggacggacggcttctttcaaccattacgatccgttttccgtgggagagtgacacgcctccgtcaaaatatccgtttgtctggtggtttgcgacgcttcctgagctgaaggggcagggcatcggcagcaaacttttgacttatgtggaggaacatgtgctgcgggatacgctgaaggccccggccatcacgctcggcacttcggcgcgcaagcatccctggcttgtagatatgtacagacggaggggatatgaagtgtattttgagcaggagaaagacggagacatcggagtcatgatgagaaaggtgctcataccggagcggtttgacgcgtcgctgttaggcacaccgagctgggcgcaatgatcaaaaaacggatcagagccggctgtctgcttctgctgctcggcgtgctggccgggtgcgggcaaggagcaagcacgaaagcggggagcggcgtgcagaccgtcatcgtcggcacgggaactgattttccgaacattgcttttatggatgaaaaaggcgagctgaccggctatgacattgaagtgatgaaagccattgatgaacagctgccgcaatacaaatttgtctttaagacgatggatttttcgaatctgcttacaagtctcggaaaccggaaaattgacgtgatcgcgcacaatatggcgaaaaacaaggaacgggagaaacgctttttgtatcacaaaatcccgtataactactcgccgatgtacatcacggtgaaggcggataatgacgcggtacgcacgctccgggatttaaaagggaaaaccgtcatcgtcggcgcgacgtcaaacgcggcggattatatgacggcatacaacaaaacccacggcagcccgatacatttgaaatacgccgggcagggcggcaatgatacagcgaaccaaattgagacaggacgcgctgacgccaccgtatccacgccgtttgccgtcgattttcaaaataagacgcacgcgttcaaacaaaagacggtcggtgatgtgctgctcgataccgaggtgtattttatgttcaataaaaacagccaaaccctggcggacgatacggaccgggcgattcaaaagcttgagaaggacggcacattgaaaaggctgagtgaaaaatggctcggcgcggattattcaaaatcaagtttcacgaaataattgaagcagaaaacggggcgatcacatgaaaataagactggcggtcatgtcattaacaattgcggcaacggcggcgttatcagcctgcggcgcgggaggggaggcggcatcaggcaatcagaaaaacgtgaagaacattacgatcggcacggggactcaatttccgaatatttgctttattgatgataaaggcaaattgacgggctacgacgttgagctggtgaaagagcttgacaggcgcctgccggactatcgattcacctttaaaacgatggatttctccaacctgcttgtcagcctcggccagcataaagtcgatatcgtggctcatcaaatggagaaaagcgccgaacgggagaaaaaatttctgttcaatcaagtcgcgtataacaacttcccgctgaaaatcacggtgctccaagataatggggacattcacggcattaatgacttgaaaggaaagcgggtcattacaagtccgacgtcaaacggcgcgcttgtgctgaaaaaatggaatgaaaaacacggcagtccgtttgaaatcgcctatgccggccaaggttcaaacgatgcggccaatcagctgaaatccggccgcgccgatgcaacgatttcaacgccgtttgctgtcgattttcaaaacaaaacgagcgcgatcaaagaaaaaacggtcggcggggtgctgtcaaatgccaaagtgttctttatgtttaacaaaaatgaacaaacgctgagcgatgacattgataaagcgctcaaggaaatcattgatgacggcacgcttaaaaggctgagtgaaaagtggctcggcgcggattattcaaaggagcaatattaagtgaaaaagagagggaccggcaatggaaaaagcgtttgatatcagtatgatcgcgtcctttgtgccgacattgctcgggtatttgcccgtcacgctgtatatattggcggtgtctttgctgttcggctttctattggggctgcttttggcgctgccccgcatctatcgcattcccgttttgaatcagtttgcgaagctgtatatctcttttttcagaggaacgcccatcatggtgcagctgttcattgtattttacggcattccggcgctcacggcgctcgccggaattgatacctctaaaatggaccctttgtatgcggccatcgccacgtatgcgctgagcagcgcggcaagagcggccgaaatcatcaggggaggtgtgaacagcgtcggccgcgggcaggcggaggcggcgttcagcatcgggctgaacagagggcagacattccggcgcatcattctgccgcaggcgctcgtgcaggcctttcccaacatcgggaatatggtgatcggtttcttaaaagatacatcactcgctttttcgatcggggtgatggatatgtcgggcagaggacagaccttgattacatcgagcaatcattctcttgaagtgtatatctcgctgtctgttctgtattacgcggccgcccttttatttgaatgtgtcttcagatgggccgaaaaacgaatcaagaaagatgagacgcgccttgtgacggtttttgacatgagtgcgcacggctgaaaaggagggagaacagtggagctggacattccgtttatcggcactgcgataaaacaaatgttgaaaaccgttccgcttacattggcgatgacgatcattcctattattgccggatttttcatagctctcggcaatatcacggtgcgtatattccgtatcaaatggctgctggcctgctcagcgttttacgtgtcttttttccgcagcaccccggcgattctccatattatgctgatttatttaggggttccgctgattgccgatcaattcagccgcgcgtttcatctcggctggtcggccaatcagattccggtctccgtgtttgtcatcatggcactgtcattaacggcaggcgcttatatgacggaaattctccgatccgggatcatggccgtcgatacggggcaggctgaggcggcatattcaatcggtctgacgcggagccagatgattcggcgcgtaattctgccgcaggcgttcatgatatcgctgccgaacttcaccaatataggcatcggctttttgcataccacttccatcgcggcaattgttgcagtgcctgaaattacaggaacggcgacaattgcggcatccgataactatgcgtttctggaagcatttatcggggcggctgtgatttattggggattaacgctgattctcgaagctgtaaacagtctggcggaaaaaagagcggccagatatcaaggaggcgcattatgatcgaaatccgaaacattcagaaatattttggcagtcatcacgtgctaaaggggatcaatttaagtgtccggaaaggagaagtcgtgaccatcatcggcccgagcggttccgggaaaaccacttttctgcgctgccttaatttgcttgagcggccggatgagggagccatttcactgcacggtgaagtcattaactgcaaaaagcctgccaaaaaagacattctcagattgaggaaacagacagcgatggtttttcagcaatatcatttgttttcgcataaaacggcgattcaaaatgtcatggaaggcctgacggtcgcaaggaaaatgaaaaaaacagatgcgtacgccattgccgagcgggaactggccaaggtggggcttcaggataaactacacgcctatccgaatcaactgtcgggaggacaaaagcagcgggtcggaattgccagggcgcttgccattcatcctgatgtgatgctgtttgatgaaccgaccgccgccctcgatccggagcttgtcggcgaggtgcttgaggtgatgcttaacattgtgcggaccggcgccaccatgatcattgtcacacatgagatggaattcgccagaagagtgtccgaccgaattgtgtttatggatgaaggagcaatcgtggaacaaggaacgcctgaggaagtttttcacaagacgaaaaaagaaagaacgaagaagttcctccgccgcgtgctgcctgattacggttatgacataaaagagcgcataaaggagcctgtcgtatgattcgtttaagcattttagatcaaagtgtcaccgcggaaaaccaaaccgcagaagaagccttgcggcaaacggtgaaattggctcaggaggccgaacaatacggatatgaccgtttctgggcggcggagcatcataacaatgaagagatagcgggatcagcgccggaaattgttctggggtatcttgccgcaagcacgaaaaaaatccgtctcgcatccggcggggtgatgctgcagcattacagtccttataaagtggcggagcagttccgggttctgtccgcccttgctcccggccgtgtggcgctcggtgtcggcaaagcgcccggcggatttcagctgtcaaccgatgcgctgcagcgggagcttatccagcccgcccgtttgtttgaagaaaaacttgaggagctgactcatttcatccgaaatgattttccggactcgcaccgctacgcgtcattgcggccgacgccgcatactgagtatgcgcctgacatctttttgctcggcggcagcgcggaaagcgcgatatccgcggccaaactcggcatttccttcgttttcgcctatttcataaacggtgaagaggctgcgttagaaaaagcgcgccacgcctttgacgagcatttgccgaaaggatcgaaggcggagtttcaccttgcgccgatggtatttaccgcgcatacaaaagcagaagcggaaaaacacgtcgtatcgcgtgagtcggtcaaaatcattctcgaagacggcaaaaaggtgaatgtcggttcccgggaacaagcggaagcgtttctggaacaagtcacgcagccatataagctgatcacacaaaagacgggtgtgattgccgggacaaaagaagagaccgccgccgagctgagacgattatccgttcaatacagcattaccgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacaaggctgctcctattgtgatgaagtgaaaggatatttgcgggaaaaagccgtggcatacgaaacaattgatgtgacagagcgggacgaattgcgtgacgtgctgcagacgaagtacggcatccgtcatgttcccgtcgttgaaatcggcagcggtgacagccgtgtgtatcaggccgttactcaagtcggcattgaacatgtagaacgggcgcttgccgattacgaggggaaaaagggggtgagaaaatgagccggacggatctaattcaattcggagtcatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcatttcttaaatcggtttgagccgatcactattttatcggcgcttgccgcctctacaacccatcttggtttaatcggcacattttccacctcgttcactgagccgtttaccatcgcaagacagctgatgtctcttgaccatatcagcggcggccgggcgggctggaatctcgtcacttctccgcaggcgggagccgcgcgcaatcacagcaaagaaagtcttcccgaccacagccggcgctacgccatcgcccaggaacatgtggacgtggtgcgcggtctgtggaattcctgggaagaagatgccttcgtccgcaacaaagaaaccgggcagttttttgatcctgacaaactgcatcgcctgtatcataaaggcgagtattttcaagtggagggcccgctgaatatcggccggtccaaacagggagagccggtcgttttccaagcggggtcttcagaaaccggccggtcgtttgccgcgcgtaatgccgatgcagtctttacgcactccaattcacttgaggaaacgaaagctttttatgatgatgtgaagaagcgggcggcggattacggccgcgacgcttccaagctgcggatctttcctggaatcagtccgattatagccggttcacaagaagaagcggaagcgaaatatcaggaattcgccgagctgataccgatagagaacgccgttaaatatgtggccagattttttgacgattatgatctgagccgttttccgctggatgagccgtttcctgatttgggcgacgtcgggaaaaacgcgtttcaaagcacgacagaccgtatcaaaagagaggccaaagccaggaatcttacgctgcgtcaagtggcgcgcgaagccgcgtttccgcgaacgaactttatcgggacaccggaacgtgtggcatcattaattgaaacatggtttcagcgggaagcggcggacgggtttatcattcactctgacatcccgggcatgcttgaagcctttgtggatcaagtcataccgatccttcagaaaaaggggctgtaccgaaaaagctatccggcggatacattgcgggggaatctcgggttggatattccgatctgcaaaccaaatccgattttgagcagaaactaaatgtttctgctttttctgctgcttgccattcccgtcattacagccttttttaaaaaatatactgatttcgagatattattgttgcgaaaagaattttttgtaactataattattacagaactgatcagtataaaaaaacattcatatttcataataaatgtgtgtgtaatttgaaaacgaaagggctgtttacaatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgacgcggatgtattcagcggctggggaaaacttcaatccggcacaggatttgaagagctttctgaaaacgaaaaagcgaaagtcggccgtctgaacgagctgagcgatcaattcgcgtcagctgacaaatacgtattcgtcacaccgctttggaacttctcattcccgcctgttatgaaagcgtaccttgattctgtggctgtagccggaaaatcattcaaatatacagagcaaggcccgatcggcctgttgactgacaaaaaagcgctccacattcaggcgcgcggaggctattactctgaaggcccggcggctgacatggaaatgggccaccgttacatcggcatcatgatgaacttcttcggcgttccttcttttgacggtttaatcgttgaaggccataatgctgaaccgaataaagcacagcaaattaaagaagatgcgattgcccgcgcgaaagaagccggaaaatcattctgatcttaaaaaaaacctccccgccgtacggctgggaggttttttatattaaagggcaatcgtccgtttttgctcgctgcttttcatcgccgcttcaatgacacggatgacatcgatgccttcttttgccgtaacgggaagctgttttccgtttaagatgctgtccgccagcagtttgtagtacgtaaggtaagagccgttctcagaggggattgtttctgtatgccttttttcatccgctgcgattgtcagctctccgaagttgtcagggtcatcggcgccccagctgtcgtcaatcggcttttggccggctgaaagcgcctcttcctgtccgtcctttccgtatttgataaagcttgcattccgtccgtgaatctgatagcgcgggccgtttgccgcattcatagagccggattgaagaatgacctgaagtttgccgtaatggagcgcggccagaaaataatcgacggtttcactgttgtcccgctgtttcatcacatgtgccgtgacggattccggcattccgaaaagcaggagtgtctggtcaataatatgtgaaccgagatcatacagcgttcccgtggcgggtccgcttttttcgcgccatctttcttggacaaccggattgtacagatcgtagttgacttgatatgtatgaatgtcttgaagcgccccgtcccgaatcagcttttgtatcgttaaaaagtcattgtcccagcgccggttgtggtacacgctcagtaagacgcctttatcttcagccgttcttctcagttcctccgcttctgctgaagtcgccgtcatcggtttttccacgacggtgtgttttcccgccaggagacatttcatcgctgattcataatgcattccgctcggtgtcgtaacgatgacgagatcaatgtcaggatcaccggtaatgtcttcaatcgcgcgcacggcttcagcccccggcagatcacgtctgacctcctccgttctggaggtcatgacttttttgatctgataatcatcaaggacgtccaaaagcggcgcatgaaagactttacccgacaaaccatatcccaatatgccaacctgtatcgttttcaatgaatttccccctcttgatatgtgataacattatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaggaaaaagaccagattctgaaccggctgaaacggattgaaggccaagtcaggggcattcagaatatggtggagaacgaacgatactgcgtggatattctcgtgcagatttcagccgtgcaggcggccatgcagaaagtcgcgtttcatctgctggaagatcacgcccatcactgcgtagccggcgccattgagagcggaaacggggagcaggcgattgccgagctgcttgatgttgtgaaaaaaatcgcaaaatcgtaaaataaaatgttttgaaataccctacaggggtatggtaacataaaaaagaaaaaacaagacgtggagggaatcatcatggaacaaaaaacactgcaagtggaaggcatgtcctgtcagcactgcgtaaaagcagtagagaccggagtgggagaactgaacggagtgacggcggttcaggtgaaattggaagccggacaggtggatgtgacgtttgatgagcacaaagtctccgtatcagatataaaagacgcaattgaagatcaagggtatgacgtcgtataaggtttatcgcgctgcgggaacgggcgcggttttcttttatcataattatacccccgtggggtttatgaagagagatgaggacattgagtgaaccgaaagaaatgaccattcaagtggggggcatgacatgcgccgcctgcgcttcaagaattgaaaaagggctgaaacggatggacggcgtcaatgacgcttccgtcaatcttgcgcttgagatctcaaatatttcctatcagcctgacaaaatcgaagctggcgccataaaggataaaattgaaaaactcggctatcacgtcgtgacggaaaaagccgattttcagattgaaggcatgacgtgcgccgcttgcgccaaccggattgaaaagcgcctgaacaaaacagagggcgttgtgagcgcaccggtgaatttcgccctggaaacagtcaccgttgaatacaatccgaaagaggtgacgccgaaagagctgaaagagaccgtggcaaaactcggctaccgattagacgggaagaaagcggttgatggagacggcggattatcccaaaaggagaaagagcagcgaaagcagctgatcaggctcatattttctgccgttctctcctttccgcttttatggtcgatggtcagccatttttcttttacttcttttatctggatgccggatatcctgatgaatccgtggctgcaatttgcgcttgccaccccggtgcagctcgtcatcggctggcctttttatacgggagcgtacaaggcgctgagaaacaaaagcgccaatatggatgttctcgttgcgctcggaacgacggccgcttacgcatacagcctgtacatgacgattgcgtctctcgggcgagacggacatgctgaggggctttattatgaaacgagcgccattttgctgactttgatattgcttggaaagcttttagagatgaaagcaaaaggccgctcatcagaagcgattaaaaagctaatgaagcttcaggcgaagacggcggcggttgagcgggacggcaaagtacaggtgattccgattgacgaggtccggacgggggatatcgtatacgtgaaacctggagaacgcgttcctgtcgatggcgaagtgattgaaggccattccgcgattgatgaatcgatgattacgggagagagcatgcctgtcgataagtctcccggaagcaccgtcacaggggcgacgatcaatgcaaacggctttctcaaaatcagagcggtgaatgtcgggaaagataccgcgcttgcacacattattaaaattgtggaagaagcccaaggatcaaaagcccccattcagcggctcgcggatcacatttccggcattttcgtcccgattgtgctggggctggccgtgctgacttttctcatttggtatgtatgggcggcgccgggacagttttctgaagcgatcggcaaattcatcgccgtgcttgtcattgcctgtccgtgcgcactggggctcgccactccgacgagcattatggcgggctccggccgtgcagctgaattcggcattctctttaaaggcggtgagcatttagaaaagacccagcgtctgacgacaatcgtactggataaaacaggaacggtgacaaacggcagaccggttctgacagatgccgtaccggcagagggaatgaacgaagaggaactcctgcggctggcggcggccgccgaaacgggatcagagcacccgctcggagaagccatcgtgtcaggagccgaaaaacgggggatttccatcccgaaactcacccggtttcaagcccggatcggttccggaatctatgcagaggctgacggcagaacgattctagccggatcaagacggctgatggaatcagagcatattgaacatgaagcgctgcttccgcaaatggcccgcttggaggcggaaggaaaaacggtgatgcttattgcggcagacggcaaagcggcggggcttatcgcagtcgctgataccattaaagaaacatctccggccgcggtgaaacgtctgaatgatatggggcttgacgtcatcatgatgaccggtgacaacaaaaagaccgcggaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcaccgatatcgcaatggaagcggcggacattacgctgatccgcggagacctgaacggcattgccgacgccatcggcatgagccggctgaccatgagaaacatcaagcagaatttaggatgggcattgggctacaacagcatcggcattccgattgcggcagccggctttctggctccgtgggtggcaggcgccgccatggcgttcagctcggtatcggtcgtgcttaatgctttgcgtttacagaaggtgaaaaaagacaaaatcggctgatgccggttttgtcttttttattgacactttattcaaagcctgcatataatagagaaaacacatatatgagtatatgttcatatatataaattcgtttacctgtattgatgttatgggaatcctattacggaaagtagggtgagtcgaaaatgaaagcagccaaaggtgaatttgtattagacggacttgattgcagcaactgtgcaaaaaaaatagaaaacggcgtaaaagccattgacggcatagacggctgtgctgtcaattttgcggcaagcaccatcacggtctcagccggcgggaaaaacgagcaatggatgaaagatgaagtcgcgaaaaaagtaaagtccattgatcctcatgtgaccgttcgttcgaagcacgaagacaaacccggtgaggatgaataccgcaaaaagctgcagctgatgttagtgagattggcggcgggcgccgttttggccgtcatcgcttacttcgcgcacacgggcgccgtccttgagtttctgctcttttttgcttcatatttgatcatcggcggcgatatcgtagccagagcgggaaaaaacattgtccgcggccaggtatttgatgagcattttctgatggcgcttgccacgatcggcgcatttgtgattcatcagtatccggaaggcgtcgcggtcatgctgttctaccaaatcggtgaattgtttcagggagcggccgtcagccgatccagaaaatcgatcagcgcgttattggacatccgtcctgagtacgccaatgtgaaaacggaaaacggcatggctgccgttcccccgcaggacgtcaaagtgggacaggtcatcatcgtgaatcccggagaacggattccgctggacggaaaggtgctgagcggttcctcgatggttgatacatccgctttaacgggcgaatccgtgccgagaaaagcggagccggggcaagaggtgatggccggatttatgaatcagaacggcgtgcttcatattgaaacctctaaagggtatgaagactctgccgtgtcaaaaatattggatctggtcgaaaatgcggccggacgcaaagcgaaaacggaaaactttattacgaagtttgccaagtactatacaccggccgttgtcattgttgcggtgcttctcgcctttttaccgccgcttctcgtgccttcagccgcgctatccgactgggtgtaccgcgcgctgattttccttgtgatttcttgcccgtgcgcactcgtcgtctccattccgctcgggtttttcggcggtatcggggctgcgtctaaagcaggggtgctcgtgaaaggcagcaactatttagaagcgctcaatcaggtggcatacgccgtgtttgataaaacgggaaccttaacgaaaggcaatttcgccgttactgatatcaaaccggcggcaggatttacgaatgacagcctgcttcatgcagccgcgcttgcagaagtccattccactcatccgattgcttcttccatccgcgaagcttacaatcaaccgctcgcggctgaggagattgaagaatatgaagaaatactcggacacggcattcgggtgaaaaccggcgggtcaacgattttggccggaaatcaaaaattgatggcaaaagaacaaatcgcttccggcacagctgaaaataacggaaccgtcgtctatgtcgccgttgatcagcagtatgcgggggcgatcgtgatcgccgatgaaatcaaagaggacgccaaacaggccattgccaatttaaaagcgctcggcgtgaagcggacagtgatgctgacgggtgattcaaagcagaccggagaagctgtcggccgagagctcggtattgatgacgtgtacacagagcttttgccgggtgacaaggtagaccgcgtcgaagaacttgaagcggcgctttcaccgaatgaaaaactgatgtttgtcggcgatgggattaatgatacgcctgtgcttgccagagctgacatcggagctgccatgggggctctcggttctgatgccgccgtcgaagcggccgatgtcgtcctgatgacagaccagccgtcaaaagcagccgaagccatccggattgcacgccgcacacgccggatcgtctggcagaacatcggatttgctttaggcgtaaaaatcatttttctcctgcttggcgcattcggatttgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcgcctgttacggtagttgaattcggagattacaaatgtccgtcatgcaaagtatttaacagcgatatctttccgaaaatcaaaaaagattttatcgataaaggcgacgtgaaattttcatttgtgaacgtcatgtaccacggaagcggctcgcgtctggcggctcttgcttcagaagaggtgtggaaagaagacccggcatcattctgggctttccatgaaaagctgtttgaacagcagccgtcaagcgaacaggaatgggtcacgcctgcattgcttgaaaaaacggtcaaaagcaccgcgaaaaaggttgatcctgacaagctgaaggaaaaccttgataaagaaaccttcgcaaaagagctgaaagctgacactgacctgaatgataaattaaatattacggcgacaccgacgatttacgtaaataacaaagtgattaaaaaattctctgattatgaggagatttcaaaaacgattaagaaagagctgaaaaatgaaaaatagaatcgtatttttatatgcttcttgggtgatagctcttgctgccatgctcggcagcctttatttcagcgagatcagaaaattcataccgtgcgagctgtgctggtatcaaagaattctcatgtacccgcttgtcctgattttaggaatcgccaccttccagggtgacacgcgcgtgaaaaaatatgtgctgccgatggccgtcatcggcgcgtttatatcgatcatgcattaccttgagcagaaggtgcccggtttcagcggcatcaagccgtgtgtgtacggcgtgccttgctcatctgaatatattaactggttcggtttcattaccattcctttcttggcattgacggcatttattctcattatgatctgcatgtgttttgtcaaaacggaacgcacggcaaaataaagagcctgctccatgggagcggctctttttctattatctgtaccaagctttgtttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaacttgattttgcggtaaaaccgacgacaaaatgataattttgatttctgaagctgctttggagattcgataaaatctgagaactgtttgagccggaagaattccaagcctgcacggcctgtacgacgaaatcaatgttgtgatcacggttaaaagcgacatccgcctgctccacgatctggacgattcgcgtttgccagtcgctgtatttggcgcggtattcagcgtccgccaccgccagcactctgaccttctgggagcccgtgctggctttagtggaggctttatcctgactgacattggcattgaatcgtttcgtgccggcctgcttgccgttttcatccagaatttttgtgtcaaccgtctgttcaacttggaccgggcctttcagatctttaaaatgatcggctttcggaagcgggtccgtatacaccgttttcgccggctccgcatgagtgtgcgaatgcgtatggctttcggctgacggcaggccgggaattaatccggcggccaataaaacaggaaaaacaagtgaactgattttcatctcataaccccctttttgttagagaaagtattcaatgaaactcctaataaaccttccattaaagtataaaataggaaaatattcttgctttcagccgttgcggatgaggttgtcccggatcaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatatcttggggattgtaacggcgttcggcggcggagccatccgaaacctgctgatcggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggcgctttatatgccgtgaaaatgggccacccgctcagtgcggtgattgcggcagcggtcctgaccggcagcgggggcggcatcatacgggatctgctcgcgggcagaaagccgcttgtgctcaaggcggaaatttatgcagtctgggccgcgctcggagggttaatcgtgggcctcggctgggccggggatgccgccggtttgtatgtgctgtttcttgtgcttgtggcatgccgcatctgcagttatgtgttcaggtggcgcctgccgattcgttcctatcatatagaacagtaaaaaaaccgatttcacaaacgaaatcggtttttttgcataacgacttctgataaaaaaagacgcccgatatgataagaaaaagggtatttgaccataatgctgaataatatgttgcatatatgtttgtatgatgaaagccggacttgtcagcttgatgtcggaggtgccgctgatggcaaaacgtgataaagaatggaaagaagagcaggaaagaatcaattttgtcatgaaggaattggaacagaaacaaactcatcttgaagcctcatcgggcggattgaagcaggatattgtcggcctgagaaaaacgttttgggatgatgtcaccgtgaatatggatgacgcccatgaagcggctgagacattttcaagcattaaacagcaggcggaaatgctttcagaacgtgaacggacgcatcggcttcaataccggcagcttcaaaaaatccaaaagctgaaaacctctccttacttcggccgtgtcgattttacggaaaaaggggagtcctcttccgagcggatttatatcgggctgacttctttaatggatgaaaacaacgagcaatttctcatttatgattggcgcgcgcccatctcatctctttactatcaatactccccgggaaaagcccgctatgaagttccggaagaaacgatagagggagacatcacactgaagcggcagtttatcattaaaaacgggacgcttaaagcgatgtttaacacggatatgacgattggtgacgaaatgctgcaagaggtgctgagcggccattccggacagcatatgaaaaacatcgtgtcaaccatccaaaaagaacagaacgaaatcatccgggatgaaaaaagcaaatatctcatcgttcagggagccgccggaagcgggaaaacatccgcggcgcttcagcgggccgcttacttgctgtaccgcgggcgcggggtgcttgatgcccgtcagattgtattgttttccccgaacattttgttcaacagttatgtgtccgccgtattgccggaattgggagaagagaatatggagcaggccacctttcaggaatatatcatccgccggctcggacgaaagtttgattgtgaaagcccgtacgagcagcttgaatattgcctgactgaacaaaataaggacgcactttccgtaaggctcgcagccattgcttacaaagcgtcatcagcttttcaggccatgattgaccgctatgccgggtcgctttcggtctccggcctgatatgtaaacagatcagctttcggggagacatcctgatttcaaaagagcggattgaagcctatttttattcgcttgatcagcagctgccgattccgaacagagcggagctgacggcggaatggcttctcgcggaaatcagcgttctcgaaaaaaaggagcgtaagaaggaatgggtcttgcaggagagcgagctgcttgataaggaagactacgctgaggtttatcaaacactcaagaagcaggcggcagatgatgaacctgcatttgacgaccatcagcgcgaacagcgcctgcttggcgccattattgtcggcaaagcctttaaaccgattaagcaggccgtcagacggctcggctttctcgatataaaacggatgtatctccggctgttttcagactggggagctgatgaaaagcccgatcattgggagagcatcggcgctttgaccggaaacgcatttgcagaacggtcgcttccgtatgaagatgccgctccgtatctgtatttgcaggatctgttagaaggaaagagaaaaaacacacaaatgaagcacgtcttcattgatgaagcgcaggattattccccatttcagctcacgtatattcaaaccatcttcccggcggcaaagatgacggtgctcggtgatgtcagccagtcgatttatgcccataccattacaggcccttcttccctcgccggctgctttcgcaatggtgcagaaaagtatgtcagcctgaagcggacttacagatcgacgcggcagattgttgaatttacgaaagcgctgctggctgacggcgatgacattgagccttttaaccggaacggggaaaaaccgcgtgttttgcggacggatacagaaaatgcgcggcgggaacaattggcggatacaatccgggagctcagacaaaaaggctgggagacggtcgctgtcatctgcaaaacggccgcggaagccaaaaaagtgtttcaggcggtcagcgccgagagcggtgtccgtttaatcaataaagaaaaccagccttttcaaaaaggggtatgcgtcattcccgtttatttggcaaaaggcattgagtttgacgccgtcattgccgctgatgcctctgctgcccagtacaatagcgaacatgaccgtaagctgttatatacggcctgtacgcgggcgatgcatcatttgaccgtattgtctccgggagaaccctctccttttataaaagaagtgcccgccggcttattcgtataagccctttgccgagtgcaaagggctttttatcattagtaatcttaatcgttgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggttatttggctgcggcccggtccgaatccggtgaaacagccgcgcccgctgctcaggctcctgcagaaagcccggcagtctcgaaagaagtgaccgtattatacggatcgcaaacgggaaatgcggaaggtcttgcgaaacagacggtaaagacgcttgaggaacggggattccaggtcaccgtcgcgtcgatgaacgattttaagccgaataatctgaaaaaagtaaacaatttactgatcgtggtgagcacgcacggagaaggcgatccgccggataacgcgctggcctttcatgaatttcttcacggcagacgcgcgccgaagcttgaagcgctccgttactccgttttggcgctcggggacagctcgtatgaatttttctgccagaccggcaaagagtttgacgagcgtcttcaagagctcggcggcacccagcttgcgccgcgggttgattgcgatcttgattatgatgagccgttttcggaatggcttgaagcggtcatcggcggtttgaacgaaggagcgggaaatcaaacagccgaagcgcctgccgagacgcccgctctcggtgaatccgtttattccagaacgaacccgtttcgggcggaggttcttgagaacatcaatctgaacggacgcggttcaaataaagaaacacgtcatctcgagctttcgcttgaagggtcgggcctcgcgtatcagcccggagacagcctcggcatctatccggaaaatgatccggcgctcgttgatgagctgatcaatgagctgaaatggaatccggaacaggaagtggcggtgaataaacaaggagagcgtcgtccgctgaaagacgcgcttacttctcattttgaaattaccgtcttaacaaagccgcttttgcaaaaggccgcacagtttacggctgatcaaaagctgagtgaacttctggccgaaggaaacgaagagcagctgaaagcatacaccaacggccgtgatctgcttgatctcgtccgggatttcggtccgtgggaagcttccgcggaagactttctttccatcctgcgtaaaatgccggcccggctctattcgatcgcaagcagtttagaagcgaatccggaagaggtgcatctgacaatcggagcggtcagatatgacgcgcacggcagagaacgcaaaggcgtctgcagcattttgtgtgcggaaagactccagccgggagatacgcttccgatttacattcagcacaaccaaaacttcaagctgccggaaaatccggatacaccgatcattatggtcgggccggggacaggcatcgcaccgttccgttcctttatgcaggagcgtgaagaaaccggagctgaagggaaaacatggctgtttttcggggatcagcactttgtcactgattttctgtaccagacggaatggcaaaaatggctgcaaaacggtgttcttacaaaaatggacgtcgctttttcccgggattcggaggaaaaagtatatgtgcagcaccgcatgaaagaacaaagcaaagagctgtatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagcgattatttgcgcggcacattgaaagaagtcatgctcgaccggatttcagccggcatcccggacgatgacaaccggctgatgaagcatcacggaagctacttgcaggatgaccgcgatctccgtaatgaacgtcaaaaacaaaagcttgaaccggcttatcagttcatgctgcgcgtccggatgccaggcggcgtgtcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgctcgataccattgcggcctgcggagatgtcaaccgaaacgtcatgtgcgcttcaaatccgcaccagtctgaaattcatgcggaagtatacgaatggtcgaagaaattgagcgatgaccttcttccgcgcacgagagcctatcatgaaatctggcttgatgaggaacgtgtggcgggaactcctgacacggaaacggaaccgatgtacgggccgctgtatttgccgaggaaattcaaaatcggaatcgccgtgcctccgtccaatgatatcgatgttttttctcaagatctcggcttcattgccatcgtggaggaaggccgtcttatcgggttcaacgtggcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcaaaaccttatcattttgaccataacggcgaccgttacggatgggtgaagggcgtaaaagggaaatggcactttacgatgttcatcgaaggcggccgcgtcacggactatgagaattataagctgatgacgggattgcgtgaaatcgccaaagtccatacgggagatttccgtctcacctctaatcaaaacctgattatcggcaatgtctcgagccagaaaaagaaacaaatcagcgcattaatcgaacaatacggtctgacagacggccggcagcattccgccctccgccgcagttcaatggcttgcgtcgcgcttccgacatgcgggctcgccatggccgaagccgagcggtatctgccgaagctgattgataagattgaagacattgttgacgaaaacgggctccgggatgaagaaatcaccatccgtatgaccgggtgcccgaatggctgcgcccgccatgcgctcggcgaaatcggatttatcggaaaggcgcccggaaaatataatatgtatttaggagcggcgtttgacggcagccgtttgagcaaaatgtaccgggaaaatatcggtgaagaggaaattctgaatgagcttcgcaccattctcccgcgctacgcgaaagagcgtgaggaaggtgaacacttcggggatttcgtcatccgcgcgggcatcattaaagcgacgacagacggcacgaattttcacgaataagatgactcttaaaaccaaggatagagacacactgacggtgcgttctctatcctttactaagcagcataaacgctgcaccgcgtcatgaaacagatgacgcagcttgcgaaaaagcctgttttcagagaaaacaggctttttctttttccggaaaaaatgtagctgaaggcaaaaaaagttcgccgtgagcgcgttatgagaaattttaaataaaaacgggtaaaataaaagaagaatggttgcgtgcggaaaatatattgaatctgcccgatcatcggctccggcctttgacaagggcagagaacaggcaataatgatatgatgcagcagatgaaggaggtcagctttggacatatttttagtcgtactcgtacttttaaccattatcgcgatctcaaatatcgtaaatcggtttgtcccttttatcccggtgcctctgattcaggtggcgctcggtatcattgcggcgtcatttccgcaggggcttcattttgaactgaatactgaattgttttttgttttgtttatcgcgccgctgctttttaacgatggaaaacggacgccgcgtgcggaactttggaatttaagagcgccgattctgctgcttgcgctcgggcttgtgtttgccacggtgattgtcggcggttacacgattcattggatgattccgagcattccgctggccgccgcgttcgggctggcggcgattctgtcaccgactgatgttgtcgcggtcagcgcactgtcagggcgtgtgaagatgccaaaaggcattctgcgtctccttgaaggagaagggctgatgaatgacgcatccggcctggtcgcttttaaatttgcgattgcggctgctgtgacgggcgcattttcgctggcgcaagccgcgttcagtttcgttctgatttcagccggcggtttactcagcggtgtcgtcatttcttttttgattatccgtttccggctgtttatgcggcgcctcggcatgcaggatgtcacgatgcatatgctgattcaaattctgacgccgttcgtcatctatctcgcggctgaagaaatcggcgtttccggcattttagcggttgtggccggcggcatcacgcatgcggtggagcaggaccgtcttgaatcaacgatggtcaaactgcaaatcgtctcttcaagtacgtggaatattattttgttcattctgaacggtcttgttttcgttattttaggtgcgcaaataccggatgtggtttccgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggtcacgcttgcgggttccttttccattccttacgtgctctctgacggctcaccgtttcctgaacggaatttgattctctttttagccgcgggcgttattttgtgcacattggtgctggcgacaatcgttctgccgattttgacagataagccggaagacaatgtgaaagaaaagaaagtcaaattgctgacagcgagacggaagctgataaaggctgccttaaccgccattaaagaaaatatgaatgagtcaaacaaaacggcttcttttgcggtcattgctgaatacaatgagaaaatgaaaaatctcaggtttcagcagttcaccgtcaaaaaccgcacgaaaaaagatgagcggaaagtccgcgcccaagggattcaggcagaacaggaagaattgctgcggctgattgagcggggcgacataccggaagaaacggctgacagccttcaggaacggtttgatgaactggaagtgctttatacgaacccgtttaaagtcggcttatctaagaaaaagctgaaacgcctgatgtactggatctttttcggcgaacataaaaagccggaaatgtcgattttaaatgaagaaggcctcattcgctccacaagggttaaaacggcaaaagcggccattgaaagcctgaaaaaacacatgactgaagaaaataaagatgtgacgcttgccgtcatttccttttacaatcacttgattttcaggctggggcactcgtatcacgaacagagtccgagccgccgttttgaaaatcaaaaactcgaaatcaaactgcgggccgtgcaggccatccgcaacgaaatccaaacattattcgaagagcgggaaatttcccgcgacatgtcgcatgaacttcgccaatacatcaatgatgtggaagcggccatgcttgacggggatgaataaaaaaagtccggcatctgttcgccggacttttttagattacggacgatggaattcgacgtgatcgccgtcgcggtcaaaccagcctctgaaggcccagttgatccagccgccatctcctttgttggtgaagcttccgtcttcaaacacccaaatgccgtacgtgatgccgtcataaacggcggaaccgtaaaactgaacgccgttaaaatgatcttcatattcctggcttaaattaaacaccatgacattatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgtttgctgagccatgttttgaggggccgggttttcttttgcggatacaaaggacagaggagtcagagacaaagcggcgccaagggcaacggacatcgggatacgcatacgtttcatatgatttcctccttcaattgtgtggtggctacagtagcgatttacccggacagttacctgattaaccgtaatttttgaaaaataggaaaataataacgtcagtggtgcttgggcactaaagatggtttttgtgataacgatgagcgtataattggtttcttacggcggaaatgtgagataataataaccgtttacataatgactagaaaggatggttcaacgtggcaaaaagcttaaaagatactgtgaagcttcataatggcgttgaaatgccgtggttcggccttggcgtcttcaaggtggaaaacggaagcgtagcggcggactccgtcgaagcggcaatcagaaacggctaccgcagcattgatacggcggctatttataaaaatgaagagggtgtcggcgaaggcatcagagctgcgggcgttgccagagaagagctgttcatcacgtcaaaagtgtggaatgaagatcaaggatacgaaacgacacttgacgcgtttgagaaaagccttgagcgcctcggcctcgattacctcgacctttacctgattcactggccgggcaaggataaatataaagacacatggcgcgctcttgaaaagctgtacaaagacggaaaaatccgcgccatcggcgtcagcaacttccaagtgcatcatttagaagaactgctgaaagatgctgaaatcaagccgatggtcaaccagattgaattccacccgcgcctgactcaaaaagaagtaagagatttctgcaaagcgcagggcattcaagtggaagcgtggtctccattgatgcagggacagctcctcgataacgaagtgctggcacaaattgcggaaaaacataacaaatcggttgctcaagtgattttgcgctgggatcttcagaacgaagtcgttaccattccgaaatcgattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcgtcaggctttggagcgtgcggccgtgctgcaattgatcgaccgtatcaagcacccagcgctgaggcagaaattcggcgattgtctgcactgttttcggcataatattgcccggaaaaaagcagccggcgagcaagcatgtcggtacaacgatcaagttcaaaagcgccgatgccgaagagctgctgttggaaaaaccgacggcaataaaggcgatcccgattgcgcttaatgcaaacagcatcatcaggacgaacagctgccacagcgggaatgacggatgaatatgaaaagcggcgcccataaagagaacggcgaatataatttggacggccatgataatgatattcactgccgcattcgccaatacatactgctttgacgtgatcggcgttgacagaagcctgtagtacgtcctgttttctctctctttaatcatcagttccgtcaggttgccggcggaatagagcataatgataatgagatacccgatgactgagtaagtcatttctttatggttcgaagtatctttcaaaacagcggactccgtttgaatcggagaatgcttgaaatcggcgtacatcgcctgaaaggctttctcgtctccgccggaagatttgccgattgaggcggcgctgttcatataattgtacaaataagagctgacatatccggtgacctgggcgcccttcagcgaggtcatgccgatgtgagacggtttcccgtcttttacgctttgggagaagcctttttcaaacgtaatgagcgcctccatttttcctgaagcgatctttgatgaggcggacgcatccgtttcctccgaaatcttcacatgatccagtccttttaaaaacgtgaccgtatcctgtgccacttctccgccgtcctgatcgagaatgccgatattgagcgtttcggctccgccgttggcattggtcatgaaggagaggaagacgccgatcagcggagccccgatataaagaatgagctgttttttgctttttgtaattcctttgagagtgtgtgcaaacagccaccagaagtttttcatattacagtccctcccgtctttgaaacgtaaatgcggcgatcagcaaaaagagtgccgccaatgctgtatttaaaccgagtgcaggccatgccgctgatacatcatttgcgtaaatgatgttgttaatcgccttattgatccaggataagggcgacagggcggaaatcccccctccttcatatttgtaataggcgccgccgataatggacatcacctgcacgatgatgacggtgattaatctggcgctttcgggttttctggtcaaatagctcaggctgagcccgaagctgacggccaaaagaatttcagaaacgagaatcaacagcacaagtcccatgtggctgccccagttcgctttcaagataaatttgctgaaggcgacaacggcaagaatcgtcagaacattcacagccaaaatgccgagcatctttccgagaaagatatcgcttttccggagcggggcggcgatcaggcgatccgcggtgtgccgtattctttccccgcggaataaggagcttgcaaaaatcgaggcgtacagcccgatcatcgtcgtcatggatatcgcgtaaaaatctttcgccttcggttcttttgctttgtgtaaagacgtctgcttcatataatcgcttttgatttgtccggcggaaggtggcttatgcgccttgtaagcggcggcgcctgctttgtattgattggtaaaagcggtcagcatgccttggacgatcgtaccgttgatgccgctccggtcatttgtatagacttgaaaaccggtgttttttacagtgacgaaagcatccgcctgattttcacgaacctcgtttttgccttttgcctccgtgtccgctttttgaaaatagacatgctcttttttggcgtttttcataaactcagtaaagtaatgagaaagtgtgccgtttgattgatccgtatatacgaccttgatgttcccgaccgtcacctctgaatcaaaggcgtttgataatgccgcggtaaaaatcagcatgaagacgatcggaaaagcaagcatgaaaataaaagtccgtctgtcgcggaaactgattttgatttctttcccggcgatgtgcagaatattcatttgcaatcctcctttcaatagggtcagtcgcgcaggcttctgcctgtcagcgtgagaaataccgtttctaagtcaggtgcctgttcctgcaaggagcggatttcaatgcctttgtccatgaagtaccggatcaggcggtttaaattgttgacccctgtgtcagagctgattttcacgctgttttcttccagtgcggcggctctgacgccgggcagctcctgaatatcgccgaggctgatgccgtttccggatgacagctcaatcacgacgtccttcgtgtcggtaatgatggaagtcagctgttcttttgtgccttctgcgatgacttttccgtggtcgatgatggcgatgcgcgtgcatatttcttccacttcctccatgtagtggctcgtgtaaatgatcgtgcagcccatttcattgagctttttcactgattgcagaatataatttcttgattgcgggtcaatgccgaccgtcggttcatccatgatgatcagtttcggccggtgggcaagggcgcaggcgatattaagccggcgtttcattccgccggaaaaatgcttcggcaaatatttgtgtttatcgctcaagccgacgaatgtcagggcttcctcgacccgttctttcagagccgcccctctcaggccgtacagacctgcgaagaacttcacattttcataggcgtttaattcctcgtaaattgcgaggtcctgagggacgatgccgatattcattttcgttgctttgctatatttgaaaatatcttttccgagaaacagaatgtctccgcctgaaggttttaaaagacctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaggacggccgcccgttcttccataccgagcatgccgaggccttttttaaagcggacggcgccgtttccgttatctttcacttccgctttcacggctttattcagcacatggatatcaatgaaaatctgcgtggcatcggcgtatttcatcgcattggtcaaggcttcggttacgttttcctgaatgactctccaatgcatttgcgtcagcctgtccaaatcgccttgatgcgtaaacggaaccggcatcccgtttttggccgaaaattcatcaataaacgttcttaatctgtgaatgcccatttgttcagcgggcggtttcatatttttcagcgttatgcggatatcctctatgccctctttggaaatggtaatggcgttttggagcagttcagccgctttgtccggatgggagccgagcatccgcttcgccgcttccatctgaatgagcgcgccggtcatggaatggccgattttgtcatggatggcttgggacaatctgtttctttcctcgagtttgccggtgtactccgattgtttgatatattctgtgctgctgtgcagctgtttcgtcagtttttcaatgcttgagcgcatgctgtccgactgttcttcatatttcttcagccgattgccggaccgggcggccaaaacgaaaatcgccagacagaacaaggttatgacgatataagtcggaaggtcgccgtacgggataaataaaaacggcaaaaacacgagcaggcagaacacatagcggtgaaccggatattcggcaagaaccgcaaaaatggcgggcggcaaaagaaacagaaacgccggatggcctaaggcggaaagccaagcggtcaatgccagcgtcatgagggtgatcccgcgcctccaagcgggcggcctgaccatgcagaccgcgatgcccaaagacagataaagcagcagaaataagacggcgtacggcgtgtaagggcggtctgccgatacgaacaaaaaagccgtataaaaaatagcgatcagtctgctcatcagcatccaaaaatccataccgttcaacgcccgttatccaccttcccggtgatataaaaaatggcgatctgcgttctgtgctcaagccccgttttccctaaaatagatgaaatataattggccgtcgtcccttcagaaatgaaaagctgttttgaaatttccctgttcgagaatcctttcgcaataagcgacatgatgctgagctctctttcagtaaactggctttcatcaatctgatgcgcggcttccgccggccggaaaaggctgtcttttattttgtccagcacggtgtcctgaagaatgctgtgcccgttgaaaacgcttttgatcgcatcgcggatccgttccggttcggtgttttttaataaatatcctttcgcgccgtttttaactgcttctaaaatatactcatcgtcgtcaaatgtcgtcaggatcatcggcttcgtatccgtttcctcagcgatccgttttgcggcttcgacgccgttcatcaccggcatgcggacgtccagcaaggcgatatcgacggggttgtgcttacaatactctgccgcctcgagtccgttttccaacgttgccgatacagtaaattcctcatatgtatgcaaaatgattttcattccttctctgatgaaagaattatcatccgcgataatgacattaatcttcatagccgcaccctttgtgtgtttttgtttcattatataccatccgattttaaatcaaaaagcctcccggcgaaaggtgcgcgaaaggcagatcggtcaagcgggctttttcaattggatgaaaaacagcatcagaaaagaaatgatcacaatacagatcacccacacccaggcgagtgtttcattgccggagtccatcgcgacgtaaatcgccgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccacctgccggctccgtctactttcgccgctccctcgatgtcagcatcaaccgcggcgaagccggttttagcggactgatacataagcgggaaggcgacaatggccgaagcgatcaccgcggccgaccacgtgaaaatgacgggctggtgaaaaatccgctcaatcgcccggccgataaagctgtgtttcccgaaaatgataatgagaatgaagccgacaacggtaggcggaagaacgagcgggagcataaacagggtctccacagccgtttttccgggaaatcgcgctttcgccatccaggcgccggcaagcgttccgagaatgatgacggcgatgcccgacgccaaagccacctcaaatgacagtacgacgggagtgaaaaactccgaagccgtaatgttacttggcagtaaatccatatttcttaaacactttcatcgcttcatctgactgcagatactgataaaacgcttctgcttctttacggtgctttgtatccttgacgatgccgacaggatacacgatcggatcgtgcgttttcgccggtgcttcatcggtgattttcacctttttcgaaatcagcgcgtctgttttatagacaagcccggcatcgacatttccggtttcaacataagaaagcacctggcggacgtcttttgcatagacggctttatcttttaccttgtcccacagggataatgccgtcagtgactgtttggcgtattgtccggccggaacggattcaggcgtgccgagcgcgattttttccgtgctgtcttttttcaggtcattcagatgtgtcaggtgtgcgctgtttttctcaggcacgatcatgacgagatcatttttcaaaagatccgtgctgtcctttttgtcgatatctccgtcatgaacgagcttttcgaatttatcttcggctgccgagaagaataaatcagctcccgcgccttgtgaaatttgtttttgcaatgtgcctgatgatccgaagttgtcttgaatggttacgtttgaatgtgatttttcgtagttggtctggatttcttcaagtgcatcctgagcgctggctgctgcagaaacggtcagcgtgacgttttcgttttgtccgcctttggacgattgtccggatgagcagcccgcagttgcgaggaaaacggccatagccgcagttgtgagtagtgtcgctttctttttcaacattgtgcaccccttatagctaaatatcattagatcaaactaattataacgcaattgtacgtgatggtgcggttttttttcaatatctgaacagttataataaaaacggagcgtgataatatgacagaagccacttcctatacaatagaagaagttgcgggccttttgaaggtctccaaactgacagtatatgatttgataaaaaaaggactcattccggcgtacagggtcggaagacagatgagggtcgatgaagaggacttaaaacaatataaagcaaacatgagaatgtcaaaaaagccatccgcagcagaagcgcctgacccgtcacgcgggcgggagccggaaaaaaggcagtctgttatcatcagcgggcaggatgtgtcgatggacctcctcagcaaacagctggaacaaacaatacaggcggctccgctccgcaagtacagcggcagtttgaacagcctgatcgagatgtaccgcggggcttgtgacatcgtcagtctgcatttatacgatggggagacggggcagtataacatcccgtatgtgaagcgcattctttcaggggagccgtttgcgctttttcatgtcgtgctgcggcaggccggattatatgtgaaaaagggcaatccgctgaacattcagggctttcaggacatgagccgaaaggatgtccgcatcgtcaatcgcgaaaaaggatcaggcgcgagggtgctgctggatgaacagctcagatcattcggcatcacgccgtctgatgtcgccggatatcatgacattgtcacggatcatctgtcagcggcttcacaagtatcaagcggaaaggcggatatcggagtcgggtcgctgcatgcggcgcatatggcaggcacggactttatcccggtgatcagtgagcagtacgatgtggtcgtcttaaaacaaaaccgggagcttgttcaaagcgtgcgggacattcttaattctgaggaattcaagtctcagctttctcaattatccggatatgatacgaaaatgacaggacggctcatatatgaaacatgaaaaatccctccatataacggagggatttttttattgcttataaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatggtcattcgtgataaagctgccgtttctcagcaccgcaaacggagtccgctctccggaaaacagatcattgccgaactgaatgctgcctttcgtttcaatgccgagcaggtgaagcagcgtcggccttacatcaacctgtcccgcggcggaagcaatcgtttcgggcgcacggtcggtcaccccgggaatatgaatgataaacggcacgcgctgaagctgaaccgtatcaaacggagtgatttcctcttttcctaagaattcggcaagtccttgattatgggcttcggatataccgtaatgatctcccatcaggacgatcatcgcgttgtcatacagcccttcttttttcagcttcttgaaaaagtgtttcagagcctcatcttcatagcggaccgtcgtcacatagcggtttaataactcgctgcttgtgtccggttcctcaatgagctgatcctgttgatcaatttcaaaagggaaatggttggtcaaagtcagcagacttgcgtaaaacggctgcggaagcttctttaatttttccgctgactgttcgagaaactccttatccttcaggccccagcctgttgaattttcctgtgtcaccttaaattcatccgcgtcgaaaaaacggtcgattccgaatgccccgtacatctcatcccggttccaaaaggctttatgattggcatgcagaacggctgagtagtattgatgatcttttaacatatggtacatcgtattgaaccggtggccgctttttgtgaaaaaaacggcgccgcttgaagacggatacagcgaattcgcagtaatgaattctgaatctgatgtttttccctgttcagtctgctgataaaaatgagtgaagtcataacttttttttcgcagtttgtttaaaaacggggtaatctcccgtccgctgacccgctcatccattacaaaacgctgtgttgattcgagcgtaacaaaaatcacattgcgcccctttgcaagcccgaattttgaatcggacggcctgctgtagccggcttgagtgtaattcgcgaccgccgcaaggctgtcttcatcggcaaacgctttagcccctgcattcagcgtctgcgaaatggtgtcatacaaatgaaagtggaacaggccgattccttttacgagcgcttcacgatcaaaagggtgcttgaacagcttcggctgctcggcctcagacagcgcaaggttgcacagcatgaggccggctgatgcccacgcatacgctttaacggtacgggcgcccgcttttcctttatcggctttatgcctttttccaagataaaacaaaatcgcaatatccaaaaataaagcgatataaagcgggtgaaacagctcttggacgctgcttcccatatcacccatattgcttgcctgaaacaaaaccggtatggtgataaaatcaatataaaacccgtaaaacaccgtattcgcgattaaaattcccgtcagcatcacatttgccgaaagcagaaagatccgctgttttttttccgtcagcaagagggcgatgccgaacagcggcacaatgaagctcagcggattaataaggagcagacattcctcaagaaccgaattgttctgcagaccgaaaccgagcttatacacggcataggttttcatccacatgaacaggatggacaggcataaaaaccgatgattgctgaaaaaggttttcttcatatgtatgactcctcaccctaaaagcgaaaagacgctttttgtttaagagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagtacaagatggcttgccattccgatcatcagtccggcggaaatgctcggattcggaatatacgaggccgtaatgaaaaacataataagcataaacagcaggctgtgtgtaaacgttctgtgcccgaacaccgtgcttacgactttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtacctatatttgataaagaggtgatacagatggctttctttaacaaagaaaaaggaaaaaacagcgataaaaacaaaaacgtcattcaaggcgcgcttgacgacgccagtgcagctctgaaagacgatccgcttcaagaagctgttcaaaagaaaaaaaacaaccgctgaccatataagacgggtagggcgaacgctctatccgttttccatctaatatttccctttgacagatctttttatctctgataacctctgagtagaattgaatgataaaaatcctcactctttctcggtgaggtagaggttgcgcttgatgatgagtcgcacatgccaggctgataaggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggctttttttgcgtgtaaatatggtctcggggtctggtccgtacgaatgaacaaccaggaggtacaggaatggaacagacgaaaaaatggggtttttggttattaacggcgtttgtcgtaggaaatatggtaggctcgggcatcttttcgctcccgagtacgctcgcaaaaatcgcgagcccgttcggcgccacatcggcatggcttttaacgggagccggtgtgttaatgatcgcgctggtcttcggccacttatccatccgcaagcctgagctgacggcggggccgcaaagctatgcgcgtgcgctgttcagcgatcggaaaaaagggaatgctgcgggcttcacgatggtgtggggctactgggtggcgagctggatcagcaacgtggcgatcatcacgagccttgccggatatttaacatcatttttcccgattttaacggataagcgtgaaatgttttcgatcggcggtcaggcggttacgctcggccagctgctgacgtttgccgtatgtacggttttattatggggcactcacacaatcctcgtcaccagcattaacggtgcgagtaaattaaatttcgtcacgacgttttcaaaagtattaggatttatcttctttatcattgcaggtttgtttgtatttcaaacgtcgtttttcgatcatttttattttcctgttcaaacaggtcctcacacggttgagggaatcggcggacagatccacaatgcggcgatttcaacattatgggcgttcgtcggaattgaatcggcagtcattttatccgggcgcgcccgttcgcagcgcgacgtgaaacgcgccaccattaccggattattgatcgcgcttggcatctatatcatcgtgacattgattacgatgggcgtgcttccgcatggtaagcttgtcggctcggaaaaaccgtttgttgacgtattgtacgcgatcgtcggcagcgcgggaagcgtcatcatggcgattctggcgattttgtgtctgttcggaacgatgctcggctggattcttctcggttctgaagttccgtatcaagcggcgaaatcaggagactttcccgctgcttttgcaaaaacgaataaacagggaagcccggttgtgtcgttaatcgtaacgaacgtaatgtcacagatctttatcttttcggttatttcccggacgatcagtgacgcgtttacgtttttaacgacggcggcgacgctcgcttatctgattccgtatctcgtgtcagcgttttacagcctgaagctcatttttacgggtgaaacgtatgacgagataaagggttcaagagtaagagacggtatcatcgccatccttgcctgcatttattctttttacgtcattattaccggaacggccgatttaacgacctttattctcggtatcgggctgtttttcgtcggtttgctgttatatcctttcgtctcaaagaaatttgcaaacaacagaccatcggtatgacaaaaagacatctcacgtctgtgagatgtctttttttgtttgcggcagcggattactttttgacggcgtgtatataatgaatggtctcaaatgcggttaaatggtcagtgcgtccgctgaaaaaacggtcattgacgtccgccggagatacatgttcataaataagcagacctgatgattctaatattttttcgatttctttataactgaaacacgataacatcggttctccgcctgctgcagccattttcaccatgttttccactctgtttgacagtcctctttcttcaaagagcgactcatctgcataatcaaacacgatagagcttcccggcgggacttcggcaaataattgtgtgagcaggcgggcgagatgctctttcgtaaggtagtatgacacaccgagcaggctgaaaaaggttttttggcgtgaaaaaccttcctgatacagacggctgaaagaaagcgaagcggcgaagtccatcggtacaaaatgaagatgatgggaaatgtcgagattcagatgtttcaatctgtttattttgtcttcctgtgaagcgggatgatcaatttcaaatatgtctaagacgtttgtcatctcaggatgcctgaaacagaaagtatcgagccccgcgccaaggataacatactgtttggccccgagcttcacttcattcaaaagcacttcttcacaatatgcggcacgggctaacggtgtaggagacagctgtacttgagtcacccattttaagatgtcatccggttggccttgaagcctctgtgccatgtctttactgaaaaatgatataccttgaatcagatgatcgcggatgtccgaatgctctttttcggaaatcagatcttgtgccataaaatcatcaaatatcaccggggtgtcgtatttactgtggtacgcccttccgaaagcggacagcagggaagtcatactcgccttgttttctttcatataaagatcctccgttatttacatcaatctccggccgggagaatcttattatacatgttaatccaaaaatgtaaattataacataaataaatttttttgtcaagttttaagcgtaataaaaagccgctgtgacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggcccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgagccgaccgctttttgaacctttgttttagcggcaacggtttttttatcccattcagccagccatttgtctgctttatcttcagtgcctgtcattttcgcaaactctttgaattgatcaatgttgctgagcttgtcatatttaatggcgattgtcggcgcgattttttccagtttttcaatatcggcgccttgtgtcgtccagacaacgattaaatccggctttaagtcaatgattttttcaacggacgcgccgtcgccgatgtttgtgacaccttttgttttccctttgtaataagggtttttaaatacgttttgcggcgcgccgacaacattgatgccgagctgtttaaagtcgccgtagtagccgtcagccatgacgacgacccgtttcgggtgcttcgggattttaatattgccgttttcggctttatacgtgatggtttcttctttttcagaagaacctttcgtgtctgaagaattgccgcatgcggccaaagcggcgatgagcagcacggcaatcagcgctgcgccgattttcttgtatgtatggaacatctgacattccttctttcataaaaattagtgataaagagaatcattatcagtgtgattatatcactgctttcatagagaagcacgctcttttttaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctcaaggggcatcggggagtgaaatccagtggacggcgcgttcattcagagcggctgtgctgctgtgtgccggtattgcggttttattgatcggcgccgctctgtctgtttccatcggagctgccgatattcatctgcggacggtgtgggatgctctctttcactttcagccgcaaaatacatctcatcaaatcatacgcgatctgaggctgccgagaaccgccgccgccgcgctcgtcggggcttttttagctgtgtccggagcgattatgcaggggctgacgcggaacccgcttgctgagccttccattatgggcgtgacgtcggggtcaggatttgcgatcgcattggcatttgctttttttccgggtctgtctgcggcgggacttgttttgtggtcctttgcgggagcgggaatcggagcgcttattgtgtttggcatcggcctgttttcaaaaggcgggctgacaccggtgaagctcgcgctggccggtacggcagtcggctatttcttaacggggctttcaagcgcgattgcgatccgttttgatgtcgcccaggatgtgaagttctggtatgccggaggagttgcttctgtgaaatgggaaggcgtgcagctgctgttggcggccggtgttatcggactattgctggcatttctgattgcgcgctcagtgacggtgctgagcttgggtgaggaactggccaaagggctcgggcagtacacatcgcttgtgaaagtaatcggaatgtttgtcgttgtcctcttgacgggggcttcagtctcagtcgccggagccatttcttttatcggcttggtgattccgcatatcacccgatttttagtcggggcagattacaggtggatcattccctgttcggcggtattcggcgccgttctgttagttttcagtgatattgccgcaagactcgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttgtgctcatatgcatcgtcttttttatcagcttaaacatgggtgtgatccggattgcgccacttgatacgatgcgtgtctttttcggacagggggatgcccgggatcagctcgttttatttgaattcagactgccgcgcatggtgctgtcattgcttgtcggcgcaggaatcgcggtttcaggcgcgatttttcaaagcgtgtctcaaaatgacttggcggagccgggcattctcggtattaacgccggggcgtctttggcggtcgttctgtttatcttctttttccaagggtcagctgttgatctaagcatggccagtacatggctgcttccggtgagcgctttggcgggggcttttctggctgcgctgctcatctatgtgctggcttggaaaaaaggcgtttcacctgtccggctcgttttggtcgggatcggcgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgctccagctcggtgatcagctggcggcggggcttggcaccaaggttgaaaaggagcggcgcgttctgctgatgtccgccgttgccctgaccgcgtcatgtgttgcggcagccggcggaatcgcttttctcggactcattgcgccgcatttggccagaaggcttaccgggccgcgccaccagacgcttatcccggtttcagctttgatcggagcatttttatttctgcttgccgatacgctggcgagaaatgtgcttgcaccgtccgaagttcccgtcggcctggtgatttccgtgctcggagcgccgtattttgtatatttgctgatgaaaacgaaatagaggaaggagactgccgcgatgaactcattatcggcggaacagcttactgtcggttatggcgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaggacatcgccaaggaaatggcaattcttccgcagacgcctgaagcgccgagcgggctgacggtgtacgaacttgtttcttacggcaggtttccgcatcagtccggaatgggccgcttgagtgataaagaccgtgacatgatcaaatgggcgcttgaagagacggggatggccgaattttacgaccggccgatcgaagcgctttccggggggcagcggcagcgtgtgtggatcgccatggcgctcgctcaagaaacggagctgctgcttcttgatgaaccgaccacttatttagatctcgcccatcagcttgaaattttgcagctgctggacaaattaaacaaggagcagggccgcaccattttaatggtcattcatgatctgaaccatgccgcccgtttttcccattacatgatcgcgctgaaaaaagggcgcgtcatcaaggaaggaacggcggaggaagtcatgactcccggtatattggaagacgtgtttcaaattgacgcacagattgtaaaagatccgcgcacgaacaaaccggtctgcttaacctacgatttaatccggcatgaaaacgcaactgtaagatgaaaaaaaacgcagagccattccggcctgcgtttttttagtgcgcccggggctgcttttgtccggagacgcatttatccaaaacgaaaaaaacccccgccacaatcagctcctccgtcgttgacagccaaatcttttcaatcagtttatccgtcgtatacgcagtcatccagaggaacagcagctgaacggtgccggctaaaaggagaaaaggcagcctgcccgtcccaaaaaaggtaaagctatgtatcatcagccgttcaagcggttcaaaacataaaccgagaagaataaaaagcacggaaaaaagcaggacgtacgccatcgatccgtagctcgtcccggctaatgaaaatacggccatcatcacgatgaaatacccgaataatacggcagcggctgccagggcataccggagcacctgaagaaaaaacattttcgtcccgttttgattgatcatctgttcagctccttttcacacagaggagacttgcagagacggaactctgcaagtcgggtgtgtatcttcagcatttctttttgacgacagggtgtttctctttcgaaagaatatccgtaaagtctttgcccagatccagatgctgctggacgaatttctcaggaagcatggcaagccattggttcagggacacatcggcatagtggtcatccttgaagatttccaggaagacgagcggctcatcccccaaattctccacatagtggcccattgcgaacgggacgtaaccgacatccccggcctgatagttaaatgttcttgcatggccgtccgatgcaaaaaccgtcatccgtcctttaccggaaatataatactgccattcatgcgtattcggatgccagtgcagctctctcattgcgcccggttcgaccacgacaagcgctgaagcgatcgttttggacactttgaagtttgtggaatccgcgatatatactttgccgccttccgtctcagcagtcggaccttcatcgagcaggcggtaagtgaacggataaggcacttcgccgttcgggccttccacaatgtcgtctttcagcttcccgggaaccggctcttcaaagatgtatttttctttccgaggcaggccggcgaggtctttttctgaaaccccgaaattgttggcgatgacatcaagcggcgtgtgggcaagccagtcagtcacttggaatgtgctgttttctgagaaggaaccgtcatcaaaaaccaagaggaattcacagccttctttcagcgcctgaatggagtgcggcaggcctgacgggaagtaccacagatctccttccttcacgtcatcgataaaactgcgtccctgttcatcaacgatcgtgacccgcgctttgcccgtcagcatatatgcccattcggcttctttatgccagtgcagttcacggatggcgcccggttttaaacgcatgttgacagatgccagattttcagaaatcggcagctcgcgaacggtcacctcacgcgcgtacccgcccttttccagccggttatgcacatctgagaaagagaatttcatattatccactgtgccgtgatccgtttccggcggcgtcagcatatccggattttggcggtctctttcaagattgcgcggaatcgtgacggtcgctcctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgtgtgaaaattaatttttcattttctgatctttcagttccgtcatcagttcgatcagggcgtcaaacttcttctcaaaccgtgtgagaagatacatagcaatcagagccggaaagccgagattgccgatctgtctgaccgcttcttctataaaaacctgatccattgtcagccacctcctgacttgacctgcagtcatgtatataagtgaaagaaagagcggctcctgtaaacctgatatcccggttgagggtcttttttttgttccggcaaatccgggacataaggaatgcggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcattggacgaccattttaaacagttttataaggaaatccggatcatcaaatatatgaactctatgatccggattttctccatcgattttgacaagcgcatccgtaaaaatcagaatcgctatccgctgacggtggatcagccggagggaggtgaagcgcttccctatgaaatgggaaaagacgcgtatgaagagtttctgcggaagcagggagatttgagccagcatgtccaaaaccgtgatttatacgaagcgcttcagacgttaaccgataaacaaaaaagcgtgctgacgaatatttatcttcacggagcgacgatgaaagagattgccgagtcgctgggtgaatcacggcagaacatttccaatattcataaaaaagggctcgacaatctcagaaagcagctggacaagcaaaaaaagggggaaaataagcagtgaacgggccatttgacttcaacaaagagaacacagataccgacgaaatggaacttttgatttcacgtttttcgccaatgataaaaaaaaaactgagcaatacatcataccaggaaagagaagaccttgaacaagaattgaagattaaaatagttgaaaaagcggacatgctgttatgccaggaagtgccgggtttttgggaatttattcttcatcttataaatgaaagctcctgacaaaagcggcggaatgatggatattccgctctgacaacgtgagaaaaacgagaagagatgtccgtctcgtttttcttttctgtttccccgcaagacctccgcactaaaaaggtaccaaatcttatccatataatgatatgatgaaaaaaacaaagagaaaggaacgtccaaggtggaaaatgcgtcaattttaattgtagacgatgagaaggcgatcgttgatatggtcaaacgcgttctcgtcaaagaaggctatcacaacattaagacagccggaagcgctgaggaagcgattgagtttgttaaacatgaaaccgcggatctgctcgtgctggatgtgatgatggaaggcatgtccggttttgaagcatgcaccgaaatccggaattataccgacgctccgatcttttttctgactgcccgttcttctgatgcggataagctgtcaggatttgcattgggagctgacgattatataacaaagccgtttaatccgctcgaattggcggcgcggatcagagcgacgttaaaaagaacctataagcgcgaagagaaaacggcggtaaaaacgtattcatacagccatttttcctattcgccgcaaaacgccgagctgatcgtcgggggcgagcccgtcagctgctccgcacagcttctgcaattgcttcaatatttctgtgaacaccctgatgtggtgctctcaaaagatcagatctatgaaaaagtgtggggatatccgtcttacggcgataacaacaccgtcatggtgcatatccgcaagctcagagaaaagattgaaaaagaccccagcaatccgtcttatattgtaacggtgcgcggcctcggctatcggtttattcccgatcaaggagaaaaaggaatccgctcatgagaatgcgcggaaaatttctgctccactttttcggacagcttctgcttgtcatcctgctgatgtccgttttggccgtcgcttctttcttctatttggattggcgtttcagcgaagcggaagccaatgcgggactgaccaaagcgacggcagactcgtttgaagcgtggcttgataaaaacgaagacggcacatgggatgtcgatgaatttttaaagatgtcggtcagaaagcagaagggctggctgcagatcattaatgacaaagaaaaaacggactacgcatacagagtgccgaaagacgtcccgagccattacagcagaaaagacctcttatccatttaccagtaccggaattttgacaactacaagctgaattactggacggtcacgataaatgatgagacctatttgattctgttcggctggaaatccgccagtgagcagcttctcacttacatcgaatcacaggagccatccctcgcttccctttctcaatataaaaaaagcacggttgattatattaaacgggaaaaaggggcggtctaccttctcgaaaacagcggcagactgctcggggatatcaacagcacgaaaaaagaacggaacaccgtcaatgagcttgaattgctgaaatacagttccaagccgtggaattacaaacgggaaatttcttttaaaagactcgataaaacgaaatggatggtcgcgtcggtgccgaaccccgtgtacatccccgatcacgagtttaacaaatcatttttgagaaatgtgatgaaaaccctcttcctcttgatcggaatcttagtatttatgatctgcatcctgaccatctggtactctttccgtttcggctggccgctgtttcataccatcaaatggcttgtcaatttatcaaagggccggcttgaagagccgaagaaccgcaaaggacagccggtcagcaaaaacaaaaaaggcaaaacaaaacagccgttccgctttttcgccgagattttcgaatcgatggatcagctgaccgacacgctgaagcgggataagaaaaacagagaaaaaatccaggcgacaagggaagaatggatcgccgggctgagccatgacttaaaaaccccgctgagcacgatttacggctacagcatgatgcttgaatcgaagcaatacgactggacaccggaagaagtcaaagaaatggggcagatcgtccgggaaaaatcagaatatatgtctaagctgattgaggacttaaacttaacataccgcctcaaaaacgcggccctcccgatcgaacggcggctgatcaacgtcgtgccgtttatcagaaacgtcacgaacgattttacgaaaaacacgttctcggaaggctatgacatcgcctttgaaaccaaaaaggaagacattcttttcgccattgatgaagcgtggttccgccgtattctggagaatctgctggcaaacgcggttaagcataataagaaggggaccgccattcgggtggtgcttgaggaatcagccgaacagctcattctgaaggtgaaagataacggaagaggaatggacgatgaaacgattcaccagctgtttaaccgttattaccggggaacgaatacgaaggggccgtcagaaggaacgggactcgggctcgccattgccaaagagctggttcaccttcataacggaaccatccatgtcaacagcagaatcagcgccggaacggtgattacgattctttttaaaaaagattgagtttggacgccgctttgtcgggaataacaatagaagactgacaagcaaaagaggtgttcacacatggaagcagcattacgagcagatacgagagcagttatcggagaaggccctttatgggacaaggataaggaatgcctgtactgggtggatatactgggcagccagctccatatcttcactccggctgacggaatcaaccgttccgttaaattcaaatcatttgtcacggctctggccttgtattcaaaggaagagctggtgatgacgatgaaagacgggttttacctgtacaatctgcgggaagacacattgacgaagatgaagcagccgaaagacatgcgggaagatatccgtttcaatgacgcaaaatgcgacccgtccggcagattatgggcgggaacgacgagcatggaaggcaaagaagaggaggcttcgctgtaccgtctgaatacggacggcagccttgccaaaataaaagaccaggtctccacctcgaacggtttggattgggatcgggaccgaaacctgatgtactatattgatactccgacgcaggaaatcgtctgttatgcatatgatcctgaaaccggagccgtatcagatccgaaaacggtctaccgctttccggagtcgcaaggatctcccgacggaatgaccattgaccgtgacggaatgctgtgggtggctctgttcggaggcggccgcgccgtccggattgacccgtttttgcataaggaaattgcatctatcgaagttccggcgaaatacgtcacctgctgcgcgttcggaggcagcaatttgaacacgttatacattacgaccgcgacggaaaaattgacggaagccgaaagacttgagcagccgcatgcgggcggcctgttttcagcagagcttgagacgggcggctgggagccggttccgtttgcaggcatgatgtaaaaaaaagccctggcatatggggaagttccccttgtgccgggcttttttgtgttaaatggagcggatgatgccgccttcaacccgctgtgcggtgccgttaatggcagaagcagctgatgaagcgagaaatacaatcgtattggcgacttcttccggggttgcatagcgctgaatcaaagatgtcggttcattcactttaaaataatcccggacgaagctgtccgtgtcttctccggcagcctttgcggctccttccatgtaagaagcgacgccttcggtccatgtcggtcccggcagcacggagttgaccgtgacattcgtgcctttcgtcatttccgccattccccgggacaagctgattaacgccgttttcgtcattgaatacggaatcatttgcgcaagcggtttgactccggcttcactggagatgttcaaaatccgtccgctgtttctttcaagcatttgcggcagaaaacgccggcacaggcgcacggcgctcataacattcacttcaaaataccgagtccattcgtcatcagacacctcagcgaagtcctttacttcaaaaaaaccgagattattgacgagaatatcgacttccccgattccgccggcgcgcttgatcaggtcatccgcctcatcctgacgcgataaatccgcagcgatgccgtgaaccgttccgtaagcggaaagctcctcaaccgtccgttccacggtttctttttttcttccgtttacaatcacctcggcgccttcggctaaaaagctttttgccgcggcttttccgatccctgaagttgatcctgtaatcaacacgagctttcgttcaagctgtaattccatgataatcctccttattacaccattgtgtaacagtatacatgatgaattttagtgtgtacgaacaatttgctttcatgcaaaaaggccggatatacaagccttaaagacttatagtataattactgcgaaaaaaggatacgaatgtcaaagagacaatcgtttaccataatcagggggagttaaaagaatgaagaagatcactgccgtctgggcggcgctcttggtcaccgcctttgtgatcgccggctgttccggcgcacaggaagaaggaagcgcggccaaacaaaaagccgtctcaaccgaagcattcccggtaaccattaaggatgccgcgaacgaaaaagtaaccataaagcaggcaccggaaaaaatcgtttccctcatgccgagcaatacggaaattacatacgcgctcggactgggagataaggtcgcaggcgtcacgacaaatgatacatatccgaaagaagccgtaaaaaaaccgaaagtcggagatatgaatgtgaacgctgaaaaagtcatcgcgctgaagccggatctcgtgcttgcccacgcgtcctctatgtccgcttccgccgatgcgatgaagcagctgaaagatgcgggcatcaccgtcttaacggtcaatgatgcgcaatcgttccaagatgtgtacaaatcaatcagcatgatcggaaaagcggccggcaaagaaaagcaggcggatcagctgatccaatcgatgaaatccgacctttccggcatagaaaagaaagcggcggccatttctgaaaaagacgaaaagaaagtattcgtcgaagtgtctcctgacggctacacgacggggaaagacacgtttatgaacgaaatgcttgaagatatacatgcgaaaaacgccgccggcagccagaccggctgggtgcagctgacggatgaagcgattgtcaaaatgaatccggacgttatcatcacgacagacggcgtaaaggccgctgaagtggaaaaacgcgccggctggggtgccgtcaatgcggtcaaacaccacaatgtctattctgttgatcctgaccttgtcacacgctcaggcccgcgccttgtcaaaggggtcgagaagcttgcagaaagcgtttatcctgaaacgtttaaaaagtaaccgcccgctggcctacacggtcagcctgctgtttttagccgtttgtacggcactcggcatttcaatcggcagtctgcatattcctttatccgacgttttttggatcgggatcggccggacatcctctgttgatcccatgaatgtaaatattatgatcaatatccgcctgccgagagtcgttctggccgctcttgtcggagccgcgctatccattgcgggggcggcgtttcagggacttctgaaaaatccgctcgccgacccttatacactcggggtatcttcgggagcctcggcgggagccgttatcaccttgtttttcggcattcagattcccgtcatcggccggttcacacttccggttgtcagcatcgccgctgccattgcggttatggcggcggttctgtttttcagccgcctcgttcatgcgtcgatgtcggtttcgacgctcattttgacaggcatcattatgaattcttttctcggggctctcatttcgcttgtgattgctttaacgggaaatgatctgctcccgattgtccgctggctgttgggaagcgtgtcaatgaggggctggggctatgtcgcgctgtttctgcctttttttctggccgggacggcgcttctgcttatcaatggcagagaattaaacattatgacttatggagaagaaaaggcaaagctgttaggcgtcagtacgggaaaaagaaaactgctgatgatcgccgccggatctctgttgacgggaggagcggttgccgtctcggggacgatcgggtttgtcggccttgtcattccccacgtgacacggcttttgtgggggacggatcatcgccatttactgccgctgtcagcattgacgggcgccgggtttctcattttggcggatttgttttcccgcaccgttattgagcctgtcgaattgccgatcggcattatgacggctttggcgggagcgcctgtgtttgccttgattctgcttcgccagcatcatggagggaaacgcttatgatcagggtgagcagcctgtccggcgggtacggaggccggatgattgtagaagatgtcagttttaccgccggaaaaggtgaatttgtcggcatactcggtccgaacggctcgggaaaaacaacgctgatgaaattgctgacgggaatgctctctccgtcaaagggcgaggtgctcgtcgcaggcaggcccgcgggcagatacaagccgcgggagcttgcgaaaattatggccgttttgccgcagcatacggagcaagcttttacatttaccgttaaggaaacggtgtccttcggcagatacccgtatcaaaaaggactcttcagacagatggatcaacatgacgaagacattgtccgggaagcaatggaaatgacgggcatcgaccgatatgcacagcaatccgtccgcaatctgagcggaggggagcggcagcgcgtctatctggcgcaggcgctggctcagcagcctgaggtgctgtgtctggatgagccgacgacctttcttgatctcaaatatcaaaaagacctgcttgatacggtgaagcggctgacgagagaaagaggcctgacggtcatcagtatttttcacgacctcaacgtcgcaagccaatattgtgatcagctcctgatgatgaaagacggacgcgcttttccgaagcagccaccggatcaggctttgaaaaaagagacgattgaagacatttacggcattaccgtcagcgctgttgcccggcaatcgtcgccgaaaccgctgatcgctttcatgccggaagcgcgggaggaaagagagcccgccggcgttccgttcgcctctctgataaacaaaagcggaaataccgtaacgcttcatacagaacggccgtttagaatgctgtcaaccgcatctgacggcccgggcttttcgtggagccgccggctttccggctcggcggcagctggtttgatctgccgtacgtttgattcggttacgatagccgtgactgcgcagtataccgtttgggtgctgatcagcggacgtttatcggaacagggatttgttcggctgttaacggcagcggctgaagcgagaatgcaggctctttccggcagactggcaaaaggcgacattgccatttgtgccttgcagacaggagaggcaatggacgtccctcacgcggaaagagccgtcagaagaggaaccgcggtatgtgtaaaagcggcggaagaaggaggaatacaacaatgaagctgtatacgaaaaccggcgatcaaggacagacaagcctgatcggcggcagaacggataaagacagtctgcgggttgaaagctacgggacgatcgatgagctgaacagctttatcgggcttgcgcttgcggagctagccgattgtgagaattgcggtgatgtgaaagccgaactccgaaacattcagcatgagctgtttgactgcggcggcgacttggcgacggtcactgaacatagaagctatacattaagagagacatctatttccgcattggaagactgcatagaccgttacacggctgaagcgcccccgcttgagaaatttattcttccgggcgggcataaggcggctgctcagcttcatatcgcgcggaccgtcacaagacgggctgagcgtctcgtcgtgaaactgggcaaaacagaagagataaacgatacggtgatgcgttacttgaaccgcctgtctgattattttttcgcggcggcaagagcagttaacgcaagacagggcgttcaggatatagagtatgaaagaagcgccgcggtattccgtgatgatgaataacgttttgttcagccggcagcagcaagccggctgtttttttatagagatatccatcaattgaacctttattgacagaaggaaaatgtatcttatgcattattgactgaaaaattaaaaaatgagatattataagaaacattgtaaaataatgggggatttgatagatggatacatataataagagcgagagcatctggaataaaaacttcacccttctgtttatctcgaggcttgttaaattgtcgggcgacggttttgcctttaattccattctgtggtttttgatttttgacggggaaggcgcgatcggcacgtccctgcttattgcggtcacgttccttccggaggcgatgctggcgccgattaccgggccttttatgaagcagcatacgctgaagttctggatgtatttctccgatctcacgcgcgcggcggtcgtgttgatcattccggtctgttactttaacggtttttctcctttatggtttgtcatgcttctcatgattttgcattcagccacgggagccgcttataatcctgcatctatctcattgatccccaatattgtcggagaaaacagcctgcagaaagcgaatgcggtcatccagtcatcaggccagatcgtcagacttgccgccattacgctgagcggggtgttcttaacatttatcagtcccgcttattctttgtttatcgctcttatattctatcttctatcaggttttctcgtactctttatgtcataccaagtccagcatgccaaagaggataccgtcgccgtcagacagcgcgggacgtatttcggaaggctcaaacggggtttcgttcttgtcaggaaacaccagattttatacccgctcgccatctattgtatcttcatgaattttgcggccgctccgtgggaggcgctctctgccgtttatgtcgccgaagatttaaacatgccgccgatcatctactcgcttttgaaagcgacaggcacgggcggagcctttttaatgggttttattttggctaaggtgaaggtgaacaaatacggtctcctgtttgtgtcagcgggaatcatagaaggggcggcatttttcatcaccggcctcaacacttttctgccgctcgtcttcctcgccgcgtttgcgttcggatctgccgtcagcgcgattaatgtgccggaatatacgattattcagacgtctgtggaccatgatgatcagccgcaagtctatgccgtcatccatatgatctcaaacatatccattccgctcggcgcggttctttgcggatacgcggctaacgccttcggtcccggaaaagtcattgccgccggcggtctcgttgaagtcctgtccggtctcggaatattgctctttacgaagctggccaaagctgaacgctcagatctcatcagggaaaaagaagcgagcatcagaatatagatttttcgtgaaacgccctgcgccgtccggtgcagcggcgtttttttatgcgaaggtccggggggttatacgactccggtctgatatgaaaatcaatctctgactcgttttgccggccgcgggatttgtttatagtaaagacaaggaaaacgaaaggaggatctgcatgaatataaatgtaaaaacggcaggcggctttctgctgattgtgttcggactttctgtctttttcggaggaggccatttcgcatttatcatcccgctggcgatcggaggcctgatgctttactggggaatcaaacgtttttcaaaaggccgggcggtatcgggtatcatcgcgggcttcatcggagccatgattctcgtcggttctcttccatttatcgttgccatcggactggccggcgccatggtgtatttcgggtggaagatgatgaagcagggcggctcagacaccgcttcccgccagtatgaaccggaagcggcatcaccgggctatcaatccggatttgacactgaatgggaagaatttctgaagaaaaaataaggaggaagacaaaatggtcttaaaaagaataagaaatatgttcgtcgcatctgttaacgaagggcttgataaattagaaaatccgaaagtcatgctgaatcaatatgtgcgtgatatggaaaatgacatcgctaaggcgaaacaaacgattgtcaaacagcacacgatcgtccatcagtttaagaaaaaacaggaagacgcctccgaaacggcggcaaaacggaaaaaccaggctcagcttgcttttgacgccggggaagaggagcttgcgaaaaaggcgctgactgaaatgaaataccttgagggaaaagcggccgaacatgaaaaagcgtatgagcaggcgaaaacacagctggcagagctgaaagagcagctggaaactttagaaacgcgcctccgcgacgtaaaggataaaaaacaggcgctcatcgcccgcgccaacgcggcaaaagcgaaggaacatatgaacgcttctttcgacaaaattgacagtgaaagcgcctacagagagtttcttcgaatggaaagccgcattgaagaaatggaagtccgcgtcaaatacggcacttcagctgaggcgaacacagaatacagccgctcccaatattcagacgaggtggaagctgagattgaaaaaatgcgctcgctttctctggagaaaacagagcatcaaaaagcggctcatgaataatgtgcacaagggaagatcggcgcttttacgcctcttccctatacgcacgtatcaattctccggcttttcctttataataaaatgaatgaaaaaggatggaacgtaatgaagcgtaagattgccaaaggactgatggcggcgtccgttctgatctgctgtctgtttttggtgaaagaagtgtttgccgggcgtttttttccgctgtacgaaacagaagcggaatcggcaagcataccgccgcgtgccgtcaacagcctgtcggtttcatcggaacagacggatgtaaaaatcatcgcggaagcgcggaatgatatcgcggcaaacatggcgggaccggcggggaaaatgtttgtccaaagcaggggaaaaaccctcaatctcaaagcgaaggagaaagggttccaatttctgaatctctttcagcgtcccctgctgattgtccgcattccgtatgattatcaccgggacatcaccgtccatacgtcaagcggcaccattgccgttgacggaaacaaggggctgtctcttgcgcacctcggcgtccgttctgtaagcgggaatatgtcgctgaagcacgtgaagacggatgtgtttgaagcgaaggggctgtcgggcaacctcacagcatcaggccttgcggcgaaaacgggggatatccgcttatcctccggacatgtcgggcttcaacatgcggcgggcgcccttgacgtgcgggtcgcttccggcagtgtcgacgcctcgcttgagacggcggatgctcccgtatccgtcaggcttgcgagcggcagcgcagcgatcagcctgccgaaagacggaagttttacggtgaacgccgagacggcaagcggaaggattcagccgtcttattcctttgagaaaacgagtaaggacggcggggcattcaccggtatgaagggcagcggcgccaggccgattgatataaaagtgacgagcggcaatattgcactgcaatagtcaaggaaaggaggggcaggcagctgatggcaaaaaaacagattctcggacttatcatcgccttattaggcgtcagcatgtttttgcgtattatcggcatcggcgacttcttgttttggccgctcttttttctgatcacaggctatatttttaataaatattcccgcggctggctcggatccgtcctgtatatcttcgccgcttttttatttttgaggaacctgttcagcgccacctttaacctgttcggctatgccttcgccgcctttctcatatacgcgggctacaggctcctgaaaggaaagcgcgtgtatgaacataaagagaagaaaatcaatcttgaaaaagaagagcagccaaagccttccgcccagacggaaagcagacagccggacctccgcagcttttttatcggcgagctccggatgatgaaggacccgtttgagctgaatgatttaaatgtttccggattcatcggcgatgtgaaaattgatttgtcaaaagcgatgattcccgaaggagaaagcacgatgaccatcagcggtgtcatcggcaatgtcgatgtgtacgtcccgccggatatcgaggtgtccgtcagttcatcggcttttatcggcgatatgaacctgctcggatctaagaaaagcggcatgagcccgaatctttataaagtatcgtctgagtacggcgactcgccgcggcggattaaaatttcaatttctttattcatcggcgatgtggatgtgaagtatttatgaggaaaaaattactcgccaatattcagtggcgcgccatgcggatgactgcggggctcagtctgctcctttgtgcggtgtttattacgctgatgctgctgtattacgggcttgacccgatgctgctgttttcttccggctggttcggtattccgtttgtggtcatcctgcttctggcgtctctttcggccggattgatttccggttatgtatacggcggccgcctgaaaacaagaatggatacactgattgaagcggttttgaaatttgaaaacggcaatttcgcttatcgggtgccgccgctcggcgatgatgaaatcggcctggcggcagatcagcttaacgaaatggccaagcgggtcgagctccaggtcacatcgctgcaaaagctctccaacgagcgggcggaatggcaggatcaaatgaaaaaatcggtcatcactgaagaacgccagcggctggcgcgcgatctgcacgatgccgtcagccagcagctctttgccatttctatgatgacatccgccgtcttagagcaggtgaaagatgcggatgacaaaatcgtcaaacggattcgcatggttgaacatatggcgggggaagcgcaaaacgagatgagagcgctgctattgcatctgcggcccgtcactttagaaggaaaaggcttaaaagaagggctgattgagctgttaaaagagttcaaagcgaagcagccgctggatattgagtgggacatcagcgatacgggtgtgtcaaaaggtgttgaagaccatctgttccgcatcgtgcaggaggcgctttccaacgttttcagacattcaaaggcgaccaaggtcaccgtcaggctcggcgcgaaacatcaaaagctgcagcttaaagtcattgataacggggcgggttttacgatggatcaagtgaaagcatcctcatacgggctgcattccatcaaggaaagagcgagtgaaatcggcggcatagcggaaattatctccgtgaagggaaaaggcacgcagatcgacgtgaaagtcccgatttatcagaaaacaaaaggagagaacgacagtgattcgagtgttactgattgatgatcatgagatggtcaggatgggtctggccgcatttttagaagcacagccggacattgaagtcgccggtgaagcatcagacgggcagcagggcgtcgatctggccgcagagcttttgccggatgtgattttaatggaccttgtcatggacggcatggacggcatcgaagcgacaaaacagatctgcgcgaaactcaatgacccgaaaatcatcgtgctgacgagctttattgatgacgacaaagtgtatccggtgatcgaagcgggagcgctcagctatttgctgaaaacgtccaaggcggcagaaatagcagaagccatcagagcggctgccaagggtgaaccgaagcttgagtcgaaagtggcgggaaaagtgctgtcaaggctgcgccattcagagaatcagcttccgcatgaaacgctgacgaaaagagaactggaaatcctctgtctcgtcgcggaaggcaagacgaataaagagattggtgaagagttgttcattacgattaaaacggtgaaaacccacattacgaatatattgtcaaagcttgatgtcagtgaccgcacgcaggcagccgtatatgcccaccgcaatcatctcgtgacataaaaaaaggagagcggcgccggcacactctcccgagggacggggtcattgggacattccctttgttccgaaatccctgatggcgactttgactttgtattcaatatccgattcactgaagtgatgatcccagtcagaggatatctttttccatttatcaggataatgaatccggacttgatcgcctaacccggtaatatccactttcaactcatgctgcatgtaatcaatgaatgccataacatctgaatgaatgctgcgttttaccgcgtttttgatttcatttatataggactccttgaaagaatcttctttcggattccaatcctcagacagacggccttcaacaaaccgggtgacgataaacttgaattttccgtttttatattgtgtttttacattatatttgctggaaaatacctcgaaagataaataataattgtcatgctttgcaaacgtgacgcctccctttaccgtgcctgtgaacaggttcatattctggacttgtaaaggcgttaaatttgcataccagaatttatttttaataatggtagcgccccagatttccagtctgctgcccactttgcgcacttgaggaagggcaaaggtttcgcccttggcgattttctctgatatttcccccaatgtcacgggctccatcatccggatggtgaccgaattattctccgttaagtcatagatcgtatttgacgcaggttctccctggtcactgatattgaaaatatctttcgttttatccggcaccgtcatcacattgcagcttcttctcgtaccgttgtctctgataaattggttcatcaatgcgtcaagcggaatgtcatcctttaacagcgcttcggaaaacagcatgatacgcaagtgctgggagaaggcggggtgattttttaacgatgccgttcttaatgcttgatggacggtttcccctggagtggaagtcacctttgtcgtgtcacctgacgacgactgctgggcacttgctttttgcggaaccagaatctgctgtgtcacttccacattttcttccgcgggtttatcgagcccgactccgataacgaggctcaaatcttctaaattgcggctgtcccagcacccggccaaaagcaatgtgcaaaatatgattacgatgtatttcttcattgcgcttttttcaccttccttttcacagcgacgactgcaaacatcagtaaaggcagcaaaaagaaaaccaagaagatatagccgagaatatcactgaacagcatcagcttgtttccgtcttttggcaacaatgatccgaagaatgtcgcgatgcctacgaagatgatgccttttttctgtttcagcccgaaaattttatgaagagctgatgtcgcgaaatatccgtatgatacataggtggcgaaaaactggatgatccagacaacaagcaaaaaggactcgaacctttcaataaaaagccctttgatttcaaatgattgaaagagcgcgatcgttggccagatcattgttttgacatcctgggtggttaaggcgccgacgacgagaacgtaggtaatgatgtataaaataatcgggatgccaaagcctatggccgacatgcggaatgtgtgctttttatttttgaggtactcggggagaaacagcataatctcaattcccaagaaggaaacagaaacgacggtcaaggaagccataacgggagaaaatccctgcccgagcaccggccgcaggttgtccagatcaaatattttaaagctgaaagaaaacaccaccagcaaaataatgatcgtaatcgttaaatagaaaggaaagagcctgccgatatcgctcatgccgccgataattaaataaacggaacaggcgataaagataaacagtgtgaccggcacgggcgttctttccaataaaaagaacttgaccatttccgccatcgcccgggcttcgaagctggcgactcctataaaatagagacagatcatcagattgacaatatttcccgcccatttgccgagtccttcattcatataatcaaataatgatccgtactgatgctttttcataatgagcgtattgagataaatcaaaaagataaagatgacgccttccagacataacgcgatccagccgtccggcgaatttgccctggatgacagcgcccgcggcatggtgaggagccccgcgccgagcatcgtgtttgcaatcaatgctgtcccttgatagcttgtaagcttattgtgagttgttttctggctcatttacgtttttcgcctcttttggttgatttttaatagggagacggagaatagagtcgtttgcgttttttaagctgaaaaatccattcggcgagaaatacggagaaccgaagcttcgctgtctcgataaatgagtgtagatcgccagcataaataaaatcatgccgtacagcccgaaagctgccgcggtaaacatcgaaataaaacggagcacacggaacgacagacccatcccgtattgcggcaccgtaaatgaagcgagcgcgacaatgctgactacgatgaccatgatggagctgacaatattcgcttcaacggccgcctggccgatgacgactccgcccaccaatccgatcgtctggccgagcgggctgggaagcctcaagcccgcttccctcagcagctcgattgtaatttccattaccatcgcttcaatgataggcgggaaggggacgttttctctgttcgccgcgatggtgactgcaagcgacgtcggcagcagcccttggtgaaacgaaacgagggcgatataaatggacgaaaaaaacagcgtgataaaaatagacgtaaacctgagcgcccggatgagcgaggcggaaatccaccgttcataataatcatcgggagactgcattaaaattcctaaagaagccggaaccaccagcgcaaacggcgagttgtcgacaaggatggcgacgcggccgttgaacaaggcggaagacactttatcaggccgttccgtattttgtatttgcggaaagggcgaatacttattatcctcaataagctcctcaagcgttccggaatcctggatgtcatccatcttcactttgctgaggcgctttacaacatcgctgacgacagacgggtccgccttatcatctatgtacatgaccgtggcgtattttaacttattttctccgatcggaacctttttcgttttcagcttcggatggttcgtgcgctgcctgatcatggcgatgtttgtatcagaatcttctatgaaggcgattttcggacctcttacgaccttttcggatgtgggttcatttacgcttcttttttctctttttcccgtggacaaaatgtatacgctgtcaagtccgttaataaacacggcgcattttccccgcagaatggagatgacggcttccttcgacgtaaagacgggacgggcgtcgatcttatcaagacgtttcgtcaccgtatccagcgtcagagtgtcttcctcccgaagcagcgtttccatcgcctcttttattttgtcttcgtcgttcatttcactcagatacatataataaaaaacaagcccgttcggaagcatctttttattttgaaccaggtcatcattctgctctacgtggggaagcaccagtgccaggttaatgtgtatgtattccttgaattccgattgcgccatcgacagtcacccgccttccaatccttaattgaggttatcttttcctgttaaaaaaatgatatactatgataaagtatttaatggtacaagtttttttatgaaagcggaggagagatgtggcacaagtcagactggcagggaatgccgaagaaattgaacagctcatcaaatcatttgaagcgcattacgaagtggcttacacgtcgaaagaataccgtaaaacaaatccgaagtataaatactctaaggattcgcgcgtctatcttgagctgaaattaaaaacggccaaggccgaaaaataaaaagggtttcatctgttactggcgaataatactcagggtgaagcaactgttatggagggatacataaatggactacagaattgaaaaagacaccatgggagaagttaaagttccggcagataaattttggggcgctcagacacagcgcagcaaggagaacttcaaaatcggttcagaaaaaatgcctcagcgtgttgtgaaggcgtttgcaatattgaaaagaagcacagcgatcgccaacgaacgcctcggcaacttagagtctgaaaaagcccaggcgattgccgctgtatgtgacgatgttttaaacggcaaatacgacgataactttccgctcgttgtctggcagacgggaagcggcacgcaaagcaacatgaacatgaatgaagtggtggccaaccgcgcgactgctttattgaaagaaaaaaattccgagctgaagattcatccgaatgatgacgttaaccgcagccaaagctcaaacgatacattcccgacggcgatgcacgttgcggcggttcttgccgtatatgagcagctcgttccggcgcttgatcagctgcgcgcgacgcttgatgaaaaagcgaaagcttatcaggatattgtaaaaatcggacgcacgcatttgcaggacgccactccgctgacgctcggacaggaaatcagcggctgggtatacatgcttgaccgttcgaaagaaatgattcttgagtcaacggaaaaaatccgcgcgcttgccatcggaggcacggcagtcggcacgggaatcaacgcccatccgcagttcggtgaattcgtcgcggaagaaatcacaaaagtaacggggcagacattcaagagttcgcctaacaaattccatgcgctcacaagccatgatgaaatcacttacgttcacggcgcgttaaaagcattggctgccgacctgatgaagattgccaacgatgtcagatggctggccagcggcccgcgctgcggaatcggcgaaatcgtcattcctgaaaatgagccgggaagctctatcatgccgggcaaagtcaacccgacgcaaagtgaggcgctgacaatgatcgccgcgcaagtgatgggaaatgacgcgacaatcggatttgcggccagccaaggaaacttcgagctgaatgtcttcaaaccggttattatttataacttcctgcagaccgtgcagctgctcagtgacggaatgaattccttccatgacaaatgcgctgtcggtattgagccgaaccaagagacgattcaggaaaatctctctaactcattaatgcttgttacggcgcttaacccgcacatcggttatgaaaacgccgcgaaaatcgccaagcttgcccacaaagaaggcctgacactgaaagaagcggcattacagctgaaccttctgacagaagaacaatttaatgaaatggtgcgtccggaagatatggtgcacccgaaagcataaaaagaaagaacggctgcagtcattgcggccgttcttctaaataaactgctgtttcagtaaaaatctgagctgttctgcatcttcagccagcaggtcggattccttcaaattcaaaatcattcctttgatgattgccggtttcggcgactttttcttcatttccgcttccagaatatccaagctctcggtgaattcagatgcttgcgccttgtccatcgtgccgatgcgcgtgcggagtgtctgcaagatcgattgacttaaaggatcgggctgcccgttatgaaggggcccaaacagtgagcttgcctcatcaagagaaataaacgcttcatcatgtctgtccgccattccgtttacgatgtcatcaattctgtgaatcacggtatttgccaaaagcgaaggctgtacggaccggccggtcagaatgagatattcaagatacatctgactgattccttctattaaaaaacaaagctcggctgtgtatggttcagctttttctccgtaaacagcaagaagactgtcgatatgaaactgcaggatcgaccggcggattctctttccgcactgcgccgcttcttcggtataaggaagtgaaccgtctttcatctgcatggtaataaaatcctgatgggcgagaatcgattcgtaaaacaccgcaagctgtttttgataagcggctctcggactgtcaccctccgtttggatcgtcgtgattcgggtaaacgttttatcatagtagtaattcagcatggataggagcagtgcttctttggaaggaaagtaaagataaaaagcgccttttgagattttgcattcatcggcgatttcctgaaccgatgtagatttgtacccttttcgggcaaacagtttgattgctgcttcaatgatcagcttttctttttccttcaatggttccaccctttcggagccaggaggctggcttgtgcttctcatgtatgactatatggtcatattgatattccgtaaatttaacctgattgtaacttgtttttttgttttgttttatttatattataaagtgagctgaccgaatggtcaaagttctggcgaaagggtgaatctgaaaatgaaagaattagatgaaatgatcagccgcttgcgaaacagaggaattaaagtcgaaaaggtgaaatatccgaaaaagacaatttgtgaaaagaaatgggttcatcaatgccaaaaaccgctgaaagcaaactacagagattttaacggctattccttcacataaaaaaagactgcaatgaaacactacagtctactttggtatgataattcggtagattacacccgattggtcattttcaattgaaattgatgctttatgcagggttaaaatccgttttacgatgctgagtcctatgccgaactcgcctttcttccctttattaaaaggctcgtacaagctggatagcatctcatcctcaatcggaggcccgtcatttttaaccgtcatgacaatctgctgctgattttggctgatccgaatgtgaatcgccgtttctgcatagcggatttgattttcaagaatgttttcaagaagtttgctccattgttccggatcaccgggcatcattaatgcatcttctgtatcaacgctccacaataattccttccgggcccatttgagccgttcaatgacttcttccgtgaccttcacaatgtcaaatgtctcatggtgcacccgctgcttcattaaataatcaagcttcgttaaatataataaatccttaattttcttctcaagtttttctgcttcgccttcaatgacatcaattgtggtttccagatcccccttaggaaaaatcccgtcctttattgattgagtatagccccttatcaccatgacaggcgtttttaaatcatgagagatattttgcaggagcgttctttccgtttcatccttttgcaccagcttgctccgcatgtcttcaatggtatggcctaattttccgatttcgtcttttctgtcgacgatgaccggatcatcccagtcctgttcggaaatccgtttgacatgcttctctaaggaaacgagcgggcgtgagagatatttggcaagccaaatcgccggaatccagcttaacaaaatcacgccggcaatgataaaaagcagctgcttgaacagggtgaatgccagatcatcacgataagaatcaagggcgtaagacagcatcatcgcatcctggccgttaatggtgaggccttttttaatgacgaaaaaaactttttcaccgctgatgtccgcgctgtatcgtttcgtgacgctgtgctggcggcccgcgagcttgtacaccttatggataaaggaagaagaaaaatagttcaagtctttgtcactggccgattcctcccgctccggcagaagaacgtgctgaacggatcggaaagtcgtcggagcggtcgcatcctcgctgtaatatccccgctcgatcgatccgggcagccggtactccgtcagtacatgctgttcattttcaatggtcgtatacgtttcatccgtgaaaaaattacgcagcgtatttgagaacagcacgagaagcagaatcgagatggctaagaggatgcctgagatgaccacccatatttgaaaagcaagcggcttatttttcatgacgtcatcatcctgtagccgaatccgtaaatggtctcaacctttaacccgggcattttttttctcagcctccgcacaaggtcatcgaccacccggtcagtgccgaaataatcatggccccatattttcagcaggatatcttctctggaaaaggggtgtcctttatggtgaagaaataaaagcagcagatcaaattccttagacgtcaaattgaccaggctgccggtttcatcataaacctcccgggcatcttcgatcacattgtaggaagaaacggtgatgccggttttctttgcggcgggctgttctttatacacgagctcgagcagtttctggacccgtataataagctctctcggcaaaaaaggcttggcgatataatcattgcttccaagctctaacccgaggactctgtcaatatcggcatcccgcgcggaaatgaaaatgaccggcacatcgggatctttttcttttatttcttttatcaatgtatagccgtccgtatccggaagcatgatgtcaagaatccacaagtggggagacggctgcatctgctttctggcatcttcgccttttgtgaaagatgtaatgttccagccttcattctctaaatattttgtgagcagttcattcaggttatcctcatcttcaactagataaatggtgtatgacaaggcatttcacatcctttcaacgtcattatactagttttaacatactcaagccgcattttcataatttcacatattcttttcatttttatcccacaatgtttgtttatgatgtgtataagggaagaaaggaagaaaaaaagcggggaagataacatgttcaaacacattttgttttggagctttgcttttctccttattattgggacaatagaacttgtacatgcgatgaatatgtaatcgatagaatgaaaacatgctgaaggagtgtgcgtgaatatgaacgatcatcgagatgacggcagaagccgcgatcagtcagatctttcacatacggaacaaaacagaaatgaacagcagcagatcagccatcaggagcccgagctgcttgaagggaccgtctcgaaagaaccggaaaacgagacggctgccggtacggaatttgaaaaaacggctgccgtgaaaaaagaaaaaaaacggagagccgcttggctgagcccgattttaggcggcattatcggcggaggcctcgtgcttggcattgtgccgaacctgccgggtgagcagcataagacagaagccgtttctgatacgaaacaagttcagtcttcgaattttacgtcaacgcctttgaaaaatacctcaagcgtagcggatatggtggaagaattggagcccgcgattgtcggagtgtccaactaccaagcttcgcaaagcagccagttcggacttgacggcggttcaagctctgaaacggaaagcggcacggggtcaggcgtcatcttcaaaaaagacggcgaaaaagcgtacatcattacaaacaatcatgtcgtagaaggggcgaacaaactgtcggtcactctttacaatgggaaaaccgaaacggcaaagcttgtcggaaaggatgccatcagtgacttggctgtattggaaatcagctcgtccaatgtcaaaaaagcggccagcttcggggattcctccaagctccgcattgccgataaagtgattgccatcggcaacccgctcggccagcagttttccggcaccgtcacacaaggtgtcatcagcgggctgaacagaacggtggacgccgatacatcccaaggcacggtggaaatgaacgtgattcagacggatgcggcgattaaccccggaaacagcggcggcccgttaatcaactcaagcggccaggtcatcgggatcaacagcatgaaagtcagtgaaaacggcgtggagtcgctcggctttgccattccgagcaatgatgtagaaccgatagtcgaccagctgcttgcaaaaggaaaagtcgagcgcccgtttttaggtgtgcagatgattgacatggcgcaagttccggaaacctatcaggaaaacacgctcggactgttcggcgaccagctgtctaagggtgtttacgtaaaagaagtgcaatccggctcaccggctgcgaaagcgggcatcaaatcaaatgacgtcattgtacaactgaacggcaaagatgtcgacagcagcgccgatatcagacagatcttatataaccagctgaaaatcggcgataaaacgactgttcaagtgctcagaagcggaagcaaaaagacgctgaacgtcacattaacgaaacaaactgaaagcgcaagctgagcgcataaaaaaagctgaaccttcaactgaggttcagcttttttcgtcattctcccaagtaggctgacagcatccacacatgcttgtccgcttcttcaactaatccgacaaacaggtcggcagttgacgggtcattttgttcctctgcgatgccgatgacaaattttgattcgcggctgatttgtttatagtcttgaaccagtgatttcaccatttcagaagccgttttttcctgaccttcatccgtaatggaagcttgttcaaggtaagtgtgcaaagtcgccgcaggctgtccgccgatggccagaagacgctctgcgatggcgtccgccgtttccgctgcttcgttatacagttcttcaaatttttcatgaagcgtaaagaagtgagggccttttacataccaatggaagcggtgcagtttagagtaaaggataaaccagtttgataattgtgtgttcattgatttctcaacaagagtttcagtttttttcgcgttttgtgtattcatattcatcgtcctccctgtgatctgttaatttaattatatcacgcatcaaataaaaatcaatactaaattataattattataatttagtttaagtgaacagctttttctttataatcgattcccaagcggaccacggaaagagtgagcggaaagccaatgtcagcttaacgcccctgccgatcggataccgcagtttcttcagccgtttcctttgtgccaattgataaatcagctccgctacgtcatcaggatcgccgcttttggatgcgttggctttgaagtaagcttcaaggggctgataaaagcgataataaggcgagtctttgccgggcgccgtaatatggctggagagagacgtctcccaaatagacgttttataggagcccggttctattaaagcggcatcaattcctataggcagaagctcgaggcgcagacactctgtaaacccttcaaccgcgaacttggaagagacatacggagatagagccgggaaaccggtcagtccgctgatactgctgatattgaagattttcgccccgccatgtttccgcatataaggcagcacggtttttgtgacgtgaatcagaccgaatacatttgtttcatactgctgtctgtaatgttccatcagcacatcttcaataaaccctccgtacgcagtgccggcgttattgacaagcaggtcaatcggtccgaaaccgctgatggtgttcccgaagtcagacaccgactgctcatttgtcacatctaaagaaacgaccgtaatatgttcggatgcacccgcttgagcggcggcctctttcagtattacagctttctccggctgtctggctgttgcgatgacgtgataagaccgggcgagcttcagcgctgtcagcatcccgaatccgctcgtcgcaccggttacaatggcaacttttctgttcatcttataatcctccccgtttgttcttatctcatagtgtataacatctcgcggaaagaaggagaaatcgttcggaaatatgtcagaattgttttataatggagtcagcttcggatagaaaggggtaaagaaaagatggcattagagggattgaaggaaacatgggatttaaactccatttttgagggcgggagccggtcggaagagtttcagcaatacatacaagagctcaaaaagcatctaagcgcttttcaacatgcggttgaagcatttacagttccgacgcacgcggatgaaagccgggagctgatcaatctgattgataggtttgaacggtcagcgatcatgatcaggcaggcgggagcgttcgtcggctgtcttcaggctcagaacactcatgatcagaaagcgaatgaatggagagcgcggatcaatcagctgagcagtgattttaaatccgctctggtcacccttgacgatacacttgcccggattgacgagcgggtctgggaggagctcctgcaaaaaccggaacttcaggatctcacatatgttttaaatgagagaagagaccgggtcagagagaagctcagcgcttcagaagaaaggctgattgaaggcctggccgttgacggctatcacgcatggggcgacctgtataatgcggctgtcggcagaatgaagattccgtttgaggataaagagctgtcggtcggccaagcggaaaatatgatggcgcacccggatcgccgcatcagacgtcaagtgttcaaagagcttaatgaagcctggaaaggagaagaggagcttttcagcagcacgctgaaccatctggccggcttccgcacggaaatctataaagcgcggggctggaaaagcgctttggaagagccgcttgcgatcaatcggatgaaaaaagaaacgctggatgtcatgtggcaggtcattaccgatcataaaaagccttttgccgaatacctgaatcgaaaggcgtctcttttagggcttgagcggctgaactggtatgatgtgggcgcgccgatcggcgaggcttcgaaagaatacacatatgatgaagcggctaatctgatcgtcagccaattttcgacgtttggcaaaaagctgtccgcattcacggaaaaagcgttccgcgatcggtggatagaagcggaagaccgcagcggcaaacgggtcggcggtttctgcaccagctttcccgacagcggagaatcccggatttttatgacgttttccggaagcgcttcgaacgtatcgacgctggcgcatgagctcggtcacgcgtttcatcaggaggccatgctccaagtgcggcagctgaacagagcctacgccatgaatgtggctgaaacagcctcgacctttgcggaaatgatcgtcgccgacgccgctttgaaacaagcggagacaaaggatgaaaagctgttcttgcttgaagataaaattcaaagaagcgtagccatgtttatgaatatacatgcgagatttttatttgaaacgcgtttttatgaagagcggaagcagggcgtcgttccggctgagaaactgaatgaactgatggaagcggcgcagaaagaagcattttgcgattcattaggggaataccaccctcatttctgggcatcaaaactgcattttcatcttacgggagtgccgttctacaattttccgtacacgttcggttatttattttcgcttggaatatatgcaagagctcttcgggaaaaagcggattttgaagaaaaatatatcgcgcttttgtgtgacacggcttcgatgaccgttgaggatttggcgatgaagcaccttggagcggatctcacggaacggtcgttttgggaagacgcggtcagccttgccgtacaggatgtgcaggaatttttagagctgactgaatgataatctggagatgaaccggccggagctgttaccgctccggttcttttttgttccgtgaatgacagccgcctcccttggaaatacctaaaaacgatcggaatggaatgggagtgaatcgcatgaaatggatcagaacggcgggcgttttatgtcttacgctgatgctgattgccggctgccgattgaatgaagaaaaacgggaagcggaacaagacagcacacctgtgtcatccgagaagccggttccttacagcagcttttccctgcgcgtcagctacggagccggagagcataaccgctatgaaggtttgtatgaaagaaaaagcggtcatgaaaaggcggacatccgggacaagctctcaggggttcacagagagggcgaggaagcgcttgatgaaatgaagatgatcctcggagaacttgccgtaaacggccggatgcaggaaagcgaggtcgtccggcaggtgctttcggcttttaatttggacagccgctatgatcatttttatctgaaactgaaaaagaacgatggagaaatgacggaaataaaaaaataaccgccgcccgctgcttttttgcccaaaactaattgataatgatattcagagtcattaatttctgttacaatataatcatgatctcacgttgaatgtttaggcaatttgtttatatacatagtgttgggaaactcaaaaaaggagcggttagcggtatgagtgcaatttctacagagacgctgagcttagggtacggagagactgttatcattgacgaattggatgtcgcgattccaaaaggcgaaatcactgtattgatcggaagcaacggctgcggaaaatcgacgcttttacgttcattggcccggctgatgaaaccgaggggcggttctgtgcttttagaaggaaaagccatcgctaagcttccgacgaaggaagtggcaagagagctcgctattttgccgcagagtccgtcagctcccgaaggcctgacggtgcatcagcttgtgaagcagggaagatacccttatcaaagctggctgaagcaatggtccaaagaggacgaagacgcagtcacaaaagcgctaaaagcgacgaagcttgaggaaatggccgaccgtcctgtggattccttgtcaggcggacagcgccagcgtgcatggattgcgatgacactcgctcaggatacggatatcattctgcttgacgagccgacaacttatctcgacatgacgcatcaaattgaaattcttgatttgctgtttgaattaaatgaaaaagaaaaacgcacaatcgtcatggtgctgcacgatctcaatctggcatgccgttatgcccattatctggtcgccattaaggataaacagatttacgcagagggccgtcccgaagaagtcatcacttgcgagcttgtacagcaggtctttgcaatgaactgtcaggtaacgcaagatccgctgttcggcacgccgctttgcattccgcacggacgcggcagatgtatcgtgcaggaagcggccctcaccgcccgattgtcataatcatgaaaaagggaaggaaacggtatggaagaaaaactgcagcagcagctggacggcctgcttgagaaatacactgaactattgcttggcgaaacaaacccggatgtaaaggaagaagtcaggcagtggattttgtatacacatatcgcaaaaagcatgccgccgctcgtcaaacattggaatcaatcctacccggacgccaaagagggcatcaaagctgcgatacagcacattaaacagctcaatgaagctcacagaaaaaaacaataaaaagctttcggcatcaaagagaggtgccggaagcttttttgctgaaacggaatcaataaaggcgccgttcaatccatagcgaagaactttaatgtaactaacacacccgtttgtttacttgctgaaccaagaaaaaaggaccgccgcagcaatcccttactctttcctatatgtcacatttcctttcggatacgtaataactcttcaaatgcttttatatttgtatcaaaattgggcactgtttgagattcctcggcacatttgacttgtgctacaactaaatcattaaaaggtgttgaaattccagtaccttctgccattttgggaataactccattaatataatcaatttcagtttttcgttttttctcaagatcctgaagcatacttgctcttaaaagcctggatggttccatggctgccctaaatgtttgaatacgttcaggaatctcattttcacttcttaattccaaagattctaaatcaaggccgcccattttcgcaaatgtgacaccattggcgtgtccaaccttaatcgtctcatctgcgatatgaactgcgctgacaatgccgatttcatggtcaagaatatcaccgtattctccgtttaatgctgccgataaaccactgaatgcattattgataagtaattttgaccacttcgttccaactaaattatcggaaatatgtgttccgccgataaggtctaaaaccgatttaatacgctggattctttctgttgtttcaccatttaattctccaatttgaaaagcgtactctttaaattgagtatactcagttgtaagtctggatacgcctggttcaataaacgtagcaccaaattcaacagaacctgcaataacacgttcaccaccaacgatcgaagcaactttctgttcaggtataccgttttgcaaggaacatactacactatcatcctttaaaaaaggcagtaactctttaagaatggagtcattatataattgttttgtcaggagcaatatgaaatcatacttgcctgatttgttttcaggggtaatggctttcacctttgcctgaaatgccgttgtaccaactactttagcacctatttgatttaaagtatctacatgttctttgtatgaatcaattaattcgacatccattccgccagcagacagatatgctccaactatggttcctaaagaacctgctcctaaaattgcaattctcattgtaaacgtctccttatttttcctctaagtagttataaaccggctgtgctgcatttaaggttaaatccgtaataatatgagatgctgaaacgacttctaatacaggcaaatctgcaagaggcgccagagcatgttcaaataattgaagccgcgccggtccagaccaggcacctttaacttctatattcgttatttgcgtccgcaccaaatcgcaaacccttaaatcaccattgtaatcagtagcaatcttaaccataaaattaggtcggcaaatttcccttttcgctttttccttgtccatttcgaaatgtttatatcccatagtcgcagctgccacacgaagactgccataatctaatgtgccaacgagagtatcagagtctatatacagcttaggggcgcccaatttctttggatatgcagtaagttcccgtccgcttgcaatagccgggaaattgtctacatacatagagtgtacataatctccttcttcaccattaaagctgacagggatgacttgtcccgcctctgtataggcaccaagtccggaaacatcgggcatccgcatcacttcgaatttcactaaaggttcagtaatttcaagaggttccggcactgccgcacgcaaagctttttcatccgttcggtaaataatatttaaatattcacggttaacaaatttataatttgggataggataagcaggagccgttagtggcgtatttaaattttttgctatatctttcacatcaattttcattgcatgacaccctttccttttctttaactatgctattatcttacatccgcatttacatttaatctaatacataataaggtatatatatatttattgaaataaataagggggatgcagacagatggaattgctgcagctaaaatactttcagacagttgcctatactgagcatatttctaaagcagcagaacaattaaagattgcccagccttctttaagtctcactataaaaagacttgagaatgaactgggaacagctttgtttgagagaaaaggcagaaatattaagctgagttcatcagggaaaattcttttaaaacatgtaaacaggatttttactgagattgaaaatgcacaaacggaaattcaattggaggaacatcaaatgtctgacaccatcagaatatctatttctaatccgagattccttgcaggactgatgagtgaatatatcaaccgctcccctcaatcaaaaattctccaagccatcggagttaaaagcgggatcctaacaagtttaaaaaaaggggacattgatttaggaataacaggtcatccgattcaagatgaagagatagaaagttgtatgctggtaaatgaagatattgttctggctttgccctcaaaccaccgatttacgggtaaaaccgaaatttctttacgtcttgtcgccgatgaaccatttattacccttgctaataatgaagagtatagcggttttacagcctcgctttgtgaaaaagccggtttcaccccaaatattgcatttgaggcggattctcatttactggccgagattataaagctggatcagggggtggcgttgcttcctatttcggtttgcagaacattggggctgaattttataaaagtgactgatcactctgcttcatatccagtcggcttatcttggatgaaacataagctgttatcttcttcggtaagaaattttcgtgactttattttgtcgtactataaagataactatgaaatgtttaaggtttattaaataattttcacccccgatttccaatgaggcggaagactggtcattcggaaacggagaggcccagatgatataaaaaaatcccgcggcatccgcgggatttttctttgttaaacggctttcgccttttcttcttgtttgcctgtctttttgtttgtcagcttaattgatttaacaaacagcgtgaggatcaatccggcagcgataaaggccaggcctgtgaaaaacacgctgtgaagcgaatccatcagtgacgttttcaaaaccggcacgatatgggaagaaaatgcggccggaatctgcttaatcgattcctgactgaacaaggattgaagcagcccttcaggattcttgtcaatcatacctttaaactgggcggcaaaggcacttgcctgtttcgggagtgagtctaagtaaggcaccagtctgtcggttaaaaggcttcctgatctggcattcatgacagcgccgagcaccgtaatgccgaacgttcccccgatcatccggaaaaattggcttgaagaggtcacaacgcccagctcttcttttgaaaacgtttcttgcagagcgagtgtgagaagcggcatgacgagccccattcccagaccgatcacggccatatagcacgtagccgcgagcttgcttgtatccagctgtaaggtcgttaataagaagaagccgacggccatgatcagcatgccgatcatgatttgcggtttaataccgatcttataaaccagctggcctccgataatacttgtgataatcatagataccatcatcggcgtcataatcgtgcctgacgcggtggcgctgactccgataattccctgcataaagaaaggaacgaacgtaacggcgccgaacatgccgatactcatgaaaaacccgatcagattcagtacggtaaacgttctgtttttaaacaggtacatcggcagaatcggttcttttgctttgatttcagcgaaaatgaatccgacaatcccggcaagcgcaagcgcaaagagaccgagaatctgccaagagccccatgcgtaatcctttcctccgaagctgagcgcgagaaggaggctgacgattccgacgatcattgtgaaaatgccggcaatgtcaaagttaatcggcccagtctgttttctgccctgaagtcctcttgcgataaagatcacggctaagattccgacaggcaggttgatatagaaaacccatttccaatttaatgagtcaacaatccagcccccgatttgcgggccgataacggaagcaagcccgtaaatcgccccgaaaagcccttggaacttggcacgctgtttccctgtgaacaaatccccgatgacgatcatggccatcggcatcatgacaccgccgccgattccctgaagtccgcggaaaataatcagttccgtcatgttgctggccattccgcacagtgcggaagcccccataaaaatcaataaacctgacacatagacgacgcggcgccccaataaatctgcaagtttccccgcaatcggaacgatcgtcgtcgaagttaaaagatatgccgtggtcagccaggtcatcatgcttaatcccccgaggtcacccacgattttaggaatcgccgttcctacgatggtgccgtcaagggctgagaaaaacatggcgatgattaagcctgttattaataatgtgcgttttggatctttcttttcaatgctcatgtttcggcagctcctctttctattcgttttctttttgatcagccgcgtatttctcggcggcttccgctactttgcggatgatgttcacagactgaatcagttcatcgtcagtcagaacggacaggtttcgcgccagtatcgctttccgtccttccacaatatcttcgaattttgtttcgccttttttggtcaggctgatgtcgatgacgcgtctgtcctgctggttatgtttgcggacgataagtcctttttgttcgaggcggtcggccatcagcgtaaccgcgctcggctttacctccatgcgttccgcaatttcggaaactttgcagctcccgtgttttttcaggctggctaaaacaaataattgggcaggcgtcacctcgtgttttgccatgctttccaccatttcaggctgtatgttttgcagcagcgtctgaagagatttctggatgtcagacacatattgatccgcgtttttcataactcctcctcatcttgttcctcgagaaaataattaacattagttaaatataaataaggattaatgataagtcaatctttttgtgcaaaaataaaaaaaggactgatgcttggcgaaaacatcaaatcctttttcattttactgctggtagggagactgctgctgaatggtctgccggaacttctgatacgattgctgaagcttttgggtatcggcggcttcaatggaataccagccattttgaaacatcacatcgtataatcttctttgcgctttttgtgactcatcgaaaatcgcctgaatatcttgataaagagactcgtggctgaactcgtgcagggctgtgcaatatgaagccgtgatgtatttttccgtcgtcagcagctcattgaccaagtctctgtcattcatttgcgccgtattgggcacgggcgtttgcggattcgtgattttttgattttgctgttccatgtattgtcctcctattgcatgtagcctgttgttgtctgtccgccttgatcggggttcaagcggcccaatatgtgctgataatgcttctcatgcatccggccgatctgatcaagctcttgttttaacgtctgattctggcagtgttccgccataaaatgcgcttttttcatggcaagcagattccagttcagcatgtcctcaagatacaaatggtctttcgttgagatgacggcaggcggcaagtttccgtgctgctcttggttgttcatataaacgcctccttcaattctgttctttttagctttctctgcgaccgggatttcatacagataaattaaaataaccacgatttgcaggagagacatcaatatttacaataaaaaaagacactatcagaagaaaaaaccttcggataatgtctgttcatgttaacagttcgatatatgcgaaagtcagcagcggcactaggattggacttcagctgccggtttattgtctagatcagtgccggcttttctttcagttatttttatttttggtaaaagaaaagcagaaaatactccggcaattaatagtataagccctgcgaaaaatacactgcgaagagagtccattaacgctgtcttcattatcggtatgatgtgctttgctatagaatgcggaaattgttcgaatgaaccagaactgaatagcctctgtagcaggacttgaggattgctgctgatcaagtctttgagatgagctgctaatgcgttttcttgttttggaaaattgtctaaaaaaggaactaatttatcggttaatatatttcctgacttggcattcatcactgctcccagaatcgtaattccaaacgtacctccgatagagcggaaaaattggcttgacgaagtaaccacgccgagcgtttctttagagaaactctcttgaagtgccagagtaataatgggcataacaaggcccataccgaagccgatgatagctacataagtagttgcagttaatttgctggtgtcagcttctaatgtggataataaaaaataggcaaaggatatgattgccatccccgtgataatctgcgctttaatgccgattttaaagaccagctgcccgcctataatactggagataatcattgcgaccatcatcggcatcatgattgtcccggactctgatgcactcatgccgattattccttgcatgaagaaagggacgaaggtgattgctgcaaacatcccaatactcataaagaaccctattaaatttaagaagataaaagttctgctttttagaagatgtataggcagaattggttctgcagcttttttttctgcaaatacaaaactaataatacttatagtggccaaagctaacagacaaaatgtctgccatgataaccagtcaaattcttttccgccgaaactgagtgtaagcagcaaacagattacacccgtaatcattgtaaacatcccgatgaaatcaaaatgaatcggacccgtgtattttctggcctgcaatcccatcgcaataaagaacacagctaccattcccacgggtaaattgataaaaaatacccaatgccagctgaaagaatctacaatccatcccccaatttgcggaccgattacagaagcaagagcgtaaataccgccaaatacgccttgaaatctggcacgctgtttgcctgtgaataaatctccaatgacaatcatagccatcggcatcataatgcctccgccaagaccttgtaaacctcgaaacacaattaattctttcatgttatcagccaggccgcacagtgaagagccaatcatgaatataatcagcccggccacatatactgcccggcgccctaatagatctgcaagttttccagcgatcggaacgatggaggtagatgttaataggtaggccgtagtcagccaagtcatcatgctcaggccgccgagatctcctacaatcttaggcataaccgttcctacgattgttccgtccagagcagaaaaaaacatagctataataagtccaattaataaaagtgtacgtttagattttcctgttgaatccaattgaaggttccctcttttcatatgtttcgagcttagtgattcttcaaaataaggtgaatggataactcaggcaggtcccttctttaaattccgttagggaagagatctttaaagatgaaggatcgtaaagctattagaaagaaataataatgctttggaggtatgtttgtgaggcaaagataaattcagcagaattatcattttgaaattctgcttttccttcttaatagatacgttcaataaactgaattatcaattttaaatataagccattgtaaattataaatcaattatcttttaaggaatattttcaaattataaggggataaagaaatataaattaaaagtttttttgggcgaaatgtaacgaagaagcggaattatagctcgaaaactcaattgaagaagtagtgatttttattgatcctttttgtgactcattaaaaccgtttgaatatcttgataatataatacattgctttgacatcagagtctgtatggatatatgaatgatatcttggcaatctgcatggcttttgtgttttagctttctctgcgaccggaaattcatacacgaataaaagaaaaaggagggagttcatccttgctgcggagcatatgtttatttttgtcgaaaaataaaatgcttacaaaattcgcccaggcttacggaatccgcttcggcgcgggaaggttcgttgcaggggaaacgctcacggaagctgtgaaaacggtaaagcggctgaaccaaaaagggctgtcggcttcgattgattatctaggtgaatatgcgggttcagagaaggatgcgaaaaggacggcggaagaatgtaaaaaagcaatcagggcgattgccgagaatcaactggattgtgagctgtcgctgaaattaacatccatcggtctggatatttccgaggaactcgcggaacagcatgtcagagacatattgacggaggcaaaagaacgcggcgtgcctgtaacgattgatatggaggactattcaagatgcggccgtacgcttgagctgtataagcggtgcaagccggattttccgatgctcggcaccgtcattcaggcttatttataccgcgcagctgaagacatcagcggtctgatgccatataagccgcggctcaggcttgtaaaaggcgcttataaagaatcggcggccgttgcgttccctgataaaaaagcaaccgatcttcatttccagcagctgattaagctgcagcttttgagcggctatgaaacggcggtggcgacacatgatgacgacattatttcgtatacgaaaacactcatcagcgagcatcagattccccgggagcagtttgaattccaaatgctgtacggcatcagaacggagcgccagaaggagcttgccgaagaaggatacaggatgagggtgtatgtcccgtacggaaccgattggtacgggtacctgatgagaagaattgccgagcgcccggcaaatgcggcgtttgtgctgaaaggaatcttcaaaaaataacggctgctccaaaaagcagccgcagtatgttattccatgttgtcttttttatattgctgattttggctcgtccgtttgccgccgccgtatttttgcttcggtcccgcatttcctttcatgctggccgcgctcactgcggcagaagacggatcttttctccctcgcaccattcccttcacctccgggtttaagtttcccgcccgcgccatggaacatgcggaagccgaaaaatttaaaaaaattccatatttgctattgaagtcatcctgaaaatcttttaagatgaaagaagaaaagggtttcattttttttgccgaaaaaatgaatgactattcattcaaagttcaagggggatgactcatgcacaagtttataaagaaagcagccgttctcggatcaggcgtcatggggtccggaattgccgcgcacttggctaacatcggaattcccgtcctgctgcttgatattgtgccaaacgagctgacaaaggatgagatgaaaaaagggctgacattagaaagcccggaggtccgcagcagactgagccgatcggctatgcaaaagctgctgaagcaaaaaccggcgccgctgacttcggctgccaatctcgactatataacggcggggaatttggaagatgacgcagctcaattgaaggatgctgattggattattgaagtcgtcgtcgaaaaccttgacgtaaaaaaacagattttctcactcgttgatgaataccggaaaccgggaagcatcgtgtcgagcaatacgtccggtatctccgtcacaaaaatggcggaaggccgatctgccgattttaaggctcatttcttaggaacccatttctttaatccggcccgctacttgaagcttctggaaatcattccgattcaggaaacagatcctgacgtgctggagtttatgacttcatttgcagaaaacacgcttgggaaaggtgtcgtcatcgcaaaagacacgccaaactttatcgccaaccgcatcggtacgtacggcctgctggtcacggtaagagaaatgctttcttccggctgccgcatcggcgaggtggacacggtgaccggacctttgatcggcagaccgaaaagtgcgaccttcagaacccttgacgttgtggggcttgatactttcgctcatgtggcaaaaaacgtatatgataaagccgacggcgctgaaaaagacatgtttaagcttcctgaatttatgaatgacatgctgaaaaacaattggctgggcagcaaatccggccaaggtttttacaaaaaagaaggtaaaacaatatatgaactcgatccgctgaccatgacatacggtgagcgctcgaaaatgaagacgcccgctttagaagccgccaaacaggcaaagggtgccaaaggcaaaatgaaagcgcttgtatattccgatgaccgcgccggacgcctgctttggaatatcacatcgcaaacactcttatactcagcccggcttttaggtgagatcgctgatgatataaaagcgattgacgacgccatgaaatggggcttcggatgggagctcggaccgtttgagatgtgggatgccatcggcgtcagaaaatcagcggagcggctcgaagaagaaggcgcagcactccccggctgggtgaaagaaatgcttgatcagggtcatgaaacattttatatgaaggaaaacggaacacaattttattattcagacggccaatacagggctgtgaaagaaaatccgaaacggatcagcctgcagacgttaaaagaaacaaaaggcgttatcactaaaaacagcggcgcaagtctgattgatctcggcgatgatgtcgcgctgctggaatttcatacgaaaagcaacgcgatcggcttagacattattcagatgattgacaatgcgcttgaggaaacggagcggaattataaaggtcttgtcatcggaaaccaaggcagacatttctgcgcgggagcaaaccttgcgatgattttaatggaagcccaggatgataacttcatggaagtcgattttgtcatccgccgttttcagcagacgatgctgaacatcaaatacagcgctaaacccgttgtagcggcgccattcgggatgacactcggcggcggcacggaagtctgtctcccggcggcacgcgttcaggcggcgagcgaatcgtatatgggtctcgttgaaaccggcgtcggtcttattccgggcggcggaggaaacaaagagctgtacatgaattatttggacggcggaagtgaactcatggacgcagcgattaaaaccttcgaaacaatcgcgcttgccaaggtgtccggttcggcacacgaagcccgtgacatgaagattttgtccgcggcagaccgtatcagcatgaatcaggatcacctgctgcacgatgcgaaacagctggctgcttccttatatgacagcggataccgtccgcctgcccgcaaaaaagtgaaagttaccggagaaaccggctgtgcggcattactgctcggagcagatcaaatgagacggtcgggttatttatccgatcacgatatgaagattgcgaagaagctggcccatgtcattgccggcggaagagtcccgttcggcacggaggtttcagaagaatatttactcgagattgaaagagaagcctttttaagcctcgctggcgaggcgaaatctcaagcgagaatgcagcatatgctcgtcaaaggcaaacctttacggaactaggagggtgtttatgagagaagcagtcattgtggccggtgcgagaaccccggtcggtaaagcgaaaaaaggatcgcttgcagccgttcgtcctgatgatttaggcgcgctttgtgtaaaagaaacgctgaaacgggcaggcggctatgaaggaaatatcgatgacttaattatcggatgtgcaacacctgaagccgaacaaggattaaatatggcgcggaatatcggtgcgctggcggggcttcctcatacggtgccggccattacggtgaatcgctactgctcttccgggctccaatccatcgcttacggtgctgaaaaaattatgatcggcgcgggtgataccgtcattgcgggcggtgcggaatccatgtcgcaagttccgatgatggggcatgtgacacggccgaatatcgctttggcggagcatgcgcctgagtattacatgagcatggggcatacggcggagcaggtcgccgaaacgtacggggtatccagagaagaccaggatgcatttgcagtccgcagccatcagaatgccgcaaaagcccttaaggaagggaaattcaatgacgaaatcgtgccggttgaagtatcgctgacagaagtcggtgatgaccataagccgcggaaaaaacaatttaccttttctcaggatgaaggcgttcgtcccggcacgtcggctgacgtcttggcgaagctccgcccggctttttctaaaacgggaaccgtgacggccgggaactcttcacaaacaagtgacggcgcggcggctgtcatgctgatggatcgcgaaaaagcatcgtcgctcggattggccccgcttgtcaaattccgttcctttgccgtaggcggcgttccgcctgaggtaatgggaatcggtccgattgaagccattccgcgggcgctcaagcttgccggactcgaattacaggatatcgggctttttgaattgaatgaggcctttgcttcacaggccattcaagtcatcagatcgctcgggatagatgaagaaaaggtgaacgtcaacggaggcgccatcgcgctcggacatccgctcggctgcacggggacgaagctgaccctgtcactcattcatgaaatgaaacggagaaacgagcaattcggcgttgtgacgatgtgcatcggaggcggcatgggcgctgccggcgtatttgaactcatttaaaaaaagggggaaatgaacatgaaacaggaaacggtcaacgtcaaaaaaggcggcagctttctgattgaagagacgggatatgatcaaatattcactccggaggactttacagacgaacataaaatgatcggcaaaacgacagaagactatgtcgtcaacgatgtgcttccttatatcgatgaaattgaaaaccatcagtttgagcattcggtcagactgctgagaaaagccggagatctcggcctcctcggagcagacgtgcctgaagagtacggcggtatcggcctggataaaatcagttcagccttcatcacggaaaagttttcacgtgccggcagcttttcgctatcttacggcgctcacgtcgggatcggttcattgccgatcgtgttcttcggaacggaagaacagaaaaaaacctatttgccggacttggcttcaggacaaagaatcgcggcatacgccttaactgagcccggttcaggttcagatgccctcggcgcgaaaacgacggctgttttgaatgaagcgggcacacactatattcttaacggagaaaagcaatggattacaaactccgcctttgcagatgtctttgtcgtctacgctaaagtggacggagataagttttccgcatttatcgtagaaaagaactatccgggcgtatcaacgggaccggaagagaaaaaaatggggattaagggttcatcgacaagaacgctgattttagatcaggcggaagtcccgaaagaaaatcttctcggcgaaatcggaaaaggccatgtcatcgcctttaatatcctgaatatcgggcgctacaagcttgccgtcggcacaatcggcgcttcaaaacgggtgattgagctgtctgccgcttatgcaaaccagcgccggcaatttaaaacgccgatctcaagcttcacgctcactcaggaaaagcttgcgacgatgtcagcgcggctttacgccatggagagctctgtatacagaacagtgggcttattcgaagataatatgagcagactgacggaagaggagcaaaaagacggacgcgaagtcgcgaagtccatcgccgagtacgcgattgaatgctcgctcaacaaaatgtgcggttctgaaacgcttgattacattgccgacgaaggggttcaaattcacggcggttacggatttatgcaggaatatgaagtggagcgcgcctatcgcgactcaagaatcaacaggatttttgaaggcacaaatgaaatcaaccgcctgatcgtaacgagcacgtttctgaaaaaagccgtaaaaggtcagctgccgctctttgaaaaagcaaaagcgctccaagaagaactcatgatgctgatgcctgaagagccgggctcagaacctcttgaacaggaaaaatacattgtcagacaggcgaaaaagatcgccctcttgacagcgggtctcgcggcgcagaaatacggcaaagagattgaaggcgagcaggaaatcatggtgaacattgccgatattgtcagcgcgctgtatgctttggaatctgccgtcctcagaacggaaaaagcaattgcggcggacggtgccgaaaaagccgcgcagaagctgttatatacggaaatctttgcccaggaagcccttcagaacattgaagcgcacgccaaagaatcactgatcgccatggaggaaggagattccctccgcatgatgctttccgtgctgcgcaaactgacgcgcctgacgccgaaaaacctcattcagaaaaaacgtgaagcggcagcagccgtcttccgtgaagaaaaatatacagtctgatcacatgctgaaagcgctccttcatcaggggcgctttttcatgaagcaacgttataggtttttacaagtgattgtgttaaaataacgacgatcatttacaaggggtgaagaagatgtcgttaaatttttactggtaccctaaatgcggaacgtgccgtaatgcgaaaaaatggctggaagaccgcggtaaggaaataaacgaaatacatatcgcggaggaaactccgtcgaaagaagaaattaaagacctctatgaaaagagcggtcttgagctcaaaaagtttttcaacacgagcggaatgaaataccgcgagctgaacttaaaggaaaaactgtaccatatgtcagaggataaacagctcgaacttctggcatcagacggtatgctcctgaaacgcccgattacgacagacggcgaaaaagtcactgtcggctttaaagaagaccaattcgaaaaatattggatgtaatgccaggttcaaagaattatggtatcttcttattataagaaaaaaatggagggatttagatgagcacaccgaaagatatgcgttattccaaagagcacgaatgggtcaaagttgaggacggaaaagcccgtatcgggattacacatttcgcgcaagccgaacttggcgacatcgtatttgtcgagcttccggaagtcggcgccgaaattaaagcggacgagccattcggcagcgtggaatccgtcaaaaccgtatccgaactgtacgcaccgattaacggaacggtgacggaagtgaacgaagaccttgatgacagtcctgaattcgtaaacgagtctccgtatgaaaaagcgtggatgatcgtcgtggaaccggctgatgctgaagaaatcgaaaacctcatgacttctgagcaatatgacgaaatgacacaggaagactgatcggatagcaaaggggccatttggacactctatctgtaacgggaggtgtctaaaatggcttttgataaacaaaaggtcgatgtgacggagaacgtcacgggccgctttcaaaacggccggttttccttgtttcatgaaaatgaagccatcggcgagatgacaggcatggaccagtacgagctcaaacagggcttttcatttgaaaatcaaaaattttataaaacagccgatgtcataaacggcagcgatccgaaatatgtcgattgcgattatgagaatggctggtgttaacagttggcggtgaatttcactgccttctttttcaatctgacgctaaaacaatcggcaggtgacgcgcttatgtacaacggagatgaaaaggtcattatcgtagaaggaaaatctgataaaatcaaagtcagggaagtgctcatcgaacccgcggaaatcgtctgtacaaacgggacgatcggccaaaccgaactggaagagttggcggaccgcctgtgtgacagagacgtctatattttaacggacgcagatgactccggagaaaaattaagaaaacagctgaaacgggagcttcccgaagcgcgccatatttatatagacagaacatacaggcaagtcgagtcgtgcccgggccatcatctcgcatctgtgctgatcagagccggctttgatgctgacactgtatttttgaaaaagaacgacctgaggtggtaatcatgaaagaactccaagaaaatgaactcgaatcgattcaggatgacgtttatctcctgtatttgtacaccccgttttgcggcacatgccagctggcgtccaaaatgcttactgtcgtcgaagaaatgctgcccggtgccgccttctataaaaacaacgtgaattattcccccgcattcgccaaagcctatcagattgaaagcgttccgtgctttttgctgtttaaaggcggagagcttgttgagaaaggatacgccttccgctccgtttcctatttatatgagctgattaaacaaaaaacatcgcaaacgttcccgatgtgacaatatttacaggaaaatgtcgtgcggtttataaagggttctgtccgttaaaaagagaaagtgtatgtatggccattaaaacgggaggttatacgagtggagaaaatagaagtttcagagaatgacggacagcatctgtttttgaaaccgctattaaacgcctcaacgctgctgattacattccaaggagaaacagaagccttaacggtctcaattaacggacagggagaaatgagaaaaacgtcggcttcaaaggagaaatctaatttgaccttttacggaaaccagacggaaatcatccatctcctgcatggtgatgtctctttgcaaaagcttatccaaagcggaaaactcaaagtgaaaggatcattcagagccctgctgaagctggaggccatcctctggctgacaaacggattttttcaggcgatcagtaaacggccgtaactgccaatctactatgtgacaatagcttccaatatttattttattgactttttatcattcgccgtgctattctacagtaagaatttccggacgaaaatacgatatgttttctcttatcaagagaggtggagggaagtgccctatgaagcccggcaaccatcaacaatgttgaaatggtgccaattcactcaaagcggtctgctttgaaagatgagagaaaggcctttttcaataagcctttctgctcatttttgcagaaaggcttttcttttgcggagaaacccggaagatttcttagaatagtgtaaggcgggtgattgctttgatccatcttcaaaatgtttcaaaaatttacaaagcgaagcatggggatgtcaatgctgtccaagatgtcactcttgatatcaaaaagggcgaaatatttggaattataggatatagcggagctggtaaaagttccttaatccgtctcctgaacggccttgaaaagccgacgtcgggaaccgtggaagtcgcggggacggaattaaataaagtaagcagccgcgggctgagaaaagcgcgccaggaaatcagcatgatcttccagcattttaaccttttgtggtcgcgcaccgtccgggagaacattatgttcccgctggaaatcgccggcgtgaaaaaaagcgaacgggtccgccgcgctgatgaattgattaaactggtcggattagaggggaaagaaaaatcttatccgtcgcagctgagcggcggtcaaaagcagcgtgtcggcatcgcccgggcgctcgccaataatccgaaagtccttctgtgcgatgaagcgacatcagcgctcgatccgcagacgaccgattcaattttggatcttttatccgatataaatgacagactcggtctgacgatcgtgctcattacccatgaaatgcacgtcatccgaaaaatctgcaacagagtcgccgtcatggaaaacgggaaagtcgttgaagaaggcgaagtactccaagttttcagaaacccgcgcgaaccgatgaccaagcgtttcgttcagcaggtgacagaaccggaggagacgaaagaaaccatccagcattttctgcaggaaacagcgacagggaaaacgattcagctttcatttgtcgggcaggccgccgagcagcccctcattacggaaatgatccgaaactttgatgtggacgtcaatattctgcaggggaaaatttcacagacgaaggacggagcttacggttcattattcattcatattgacggtcaggaaaaagaagtagaaaacgtgatccggttcatcaaagacaaacaggtagaagcagaggtgatcacaaatgtttgaaaaatggttcccgaacgttgatataaccgagctgtggacggccacatatgagaccctttatatgacggtcatcgctttagttttttcatttatcatcggagcgattctcggtcttctgctctttttaacgggcaagggaagcttatgggaaaataaaatcattaacaccgtgattgcggcggtcgttaatattttcaggtctattccgtttcttattttaattattctgcttctcggctttactaagattctggtcggatcgattttaggaccgaatgccgcattgccggcgctgattatcggctccgcgccgttttacgcccgtcttgcggaaattgcgctccgggaagtcgataaaggagtcatcgaagctgccagatcaatgggagcaaagacatcgacgattatcttcaaagtgctgattcctgaatcaatgcctgcgttaatttcaggcatcaccgtgacggccatcgccctgatcggatctaccgccattgccggcgccatcggttcaggcggactcggaaaccttgcatatgtagaaggctaccagtccaataatacggatgtaacgtttgtagcgacagtatttatactcatcatcgtctttatcattcagattatcggtgatgtaattacaaatataatagacaaaagataagggaggatttacattgaaaaagattgtattaagtgcgctgctgcttgtgttcgcgggagttttagccgcctgcggatcaaacggctcgaataaaaaggaaatcgttgtcgccgcgacaaaaacaccgcatgctgaaatcttaaaagaagcggaaccgctcttgaaggaaaaaggctacacattaaaagtaaaagtgctgaacgattacaaaatgtacaacaaagcgttagctgataatgaagtggatgcgaactacttccagcacgttccttaccttgaacaggaaatgaaagaaaataaagattacaaactcgtgaatgccggagccgttcaccttgagccattcggagtttacacgaaaaaatacaaatcactgaaagacctgcctaaaggcgcgaccatcatcatgactaacaatgtcgctgaacaaggccgtatgctggcgatgcttgaaaaagccggactgatcacacttgatccgaaggtaaaaacgattgaagcgactacgaaaaacattacgaaaaacccgaaaaacctgacattcaaaaaaatcgcccctgaattaacggcgaaagcatataatgaagaagaaggcgatgcagtcttcattaacgtcaactatgcgattcaaaacaaactgaatccgttaaaagatgcgattcaagtggaatcaacgaaaaacaacccgtacgcaaacatcatcgccgtacgcaaaggtgacgaaaaatcagagaaaatcaaagcgcttatggaagtgcttcactctaagaaaatcaaagactttattgagaaaaaatacgacggagccgtgcttcccgtatctgaataaagcgaaaaccccggatgaatcatccggggtttttttcgggtattaatcggagaactgtccataataaaaaggaaggttaacgattggagggaatggcagtggctcaataccaggataacggaaaaagcgtgcatgacgcattgaaacaatataaagaaggtttaggcatattcgagcaaaaaatgccgatgatggggcggaagtttaatgaatttactgagcagtgtttctcagcggattcattaactgaaaaagagaaacaattaatcgctctgggcatcagcatcagcgctcaagatgaattttgcatgatttatcatacgaagggctgccttgaccaaggggccacagaagaaaacatccttgaggtcatcagcgtcgcggcggcattcgggggcggcgcggctctcagtcagggagtgaccctcgtgcagcagtgtattcaggaattcggacatacgacgcattagaatgagcaatcgtgtgaataccgtttttcagataaagcgagcgccggtttccggcacattcgaaaggattcaggggcacaccctctttggccggagcagcggatcattgttacaatagaaacaaatatatgaagggattgattcattatctgcaccagccacgagagactggaccttgactatacgcctgaaatggaaaaagcgatgcagaagtcacacggcatcggctacgaggaatacggacggcgtctttcaaaaaggatggaagtcgaacggcagagggagcttgaatatcaaaaaagcaagttcctcgcagcgcagcttaatgagaaaatcggtcagtaaaaaagggtggatttccgccctttttctgtttcaaacagctttaattacgccttgatctttgataaactttaggaatgttccgggtaatataaaaagttgtatttacttttcatttgttataaaattagaatgagaataaattgagaataatgattatatattttggaggtatagatatggctgcttcaacattaacgatcaaggatcttcacgttgaaatcgaaggaaaagagatcttaaaaggtgtaaaccttgaaataaaaggcggcgaattccacgctgtcatggggccgaacggtaccggtaaatccacgctctcagcagcgattatgggacacccgaaatacgaagttacaaaaggcagcatcacgcttgacggcaaagatgtactggaaatggaagtggacgagcgcgctcaggcgggtcttttccttgcgatgcagtacccaagcgaaatcagcggtgtgacaaatgccgatttccttcgctctgcgattaacgcacgccgtgaagaaggcgatgaaatttctcttatgaaattcatccgcaaaatggatgaaaacatggagttccttgaaatggaccctgaaatggcgcagcgttacctgaacgaaggtttctcaggcggggagaaaaaacgcaacgaaatccttcagcttatgatgatcgagccgaaaatcgccattcttgacgagatcgattcaggtcttgatatcgatgcgcttaaagtcgtttctaaaggaatcaacaaaatgcgcagcgaaaacttcggctgcttaatgatcactcactaccagcgccttctgaactacatcacgcctgatgtcgttcacgttatgatgcagggacgcgtagtgaaatccggcggcgcggagcttgcacagcgccttgaagcggaaggttatgactggattaaacaggaactaggcattgaagacgaaactgtaggccaagaagcgtaagcgttagggggataatcatgacattggaaacgaaactatccgtagatcaggaatatgtcaaaggcttttccgaaaagcatcaagaacctgcctggctgaaaaacctgcgcttacaggctcttgaaaaagctgaagatctgccgctgcctaagcctgataaaacaaaaatcacaaattggaactttacaaagttcaacaagcatacagtagaaaacgcgccgcttgcttctttagaagatttagctgatgaagcaaaagcgctgatcgatatcgaaaacgaagacaaaacgttatatgtgcagcgtgatcaaacgcctgctttcctttctctttccaaagaactgaaagacaaaggcgttattttcacggacatcttaacggctgcccgtgagcacagcgacctcgttgagaaatactttatgaaagacggcgtaaaggtcgacgagcataaactgactgcgcttcatgcggcattaatgaacggcggggcattcctttatgttcctaaaaacgttcaggtggagacgcctgttcaggccgtttacgttcatgaaagcaatgacacggcattgttcaaccacgtgctgatcgtcgctgaagaccacagctccgtcacttacgttgagaactacatcagcacggtgaatccgaaagaagcggtattcaacattatcagtgaagtggtcacaggtgataatgccagcgtgacgtacggcgccgttgacaacctgtcagcaggtgtcacaacatacgtcaaccgccgcggagccgcgcgcggacgagacagcaaaatcgagtgggcgctcggactgatgaacgacggcgacacgatttctgaaaacacgacaaacctctacggagacggcacatacggcgatacgaaaaccgtagttgtcggaagaggagaacagacggaaaactttacgacgcagatcatccacttcggtaaggcttctgaaggctatatcctgaagcacggagtcatgaaagatgccgcatcttccatctttaacggaatcggcaaaatcgaacacggcgcgtctaaagcaaatgctgaacaggaatcccgcgttctgatgctgagtgaaaaagcacgcggagatgcaaacccgattctcttaattgatgaagacgatgtaactgcaggacatgcggcatctgtcggccgtgtggatccgatccagctttactacttaatgagccgcggaattccgaaagaagaagcggagcgcttagtcatttacggattccttgctccggtggtaaaagagcttccgattgaaggagttaagaaacagctcgtctccgtcatcgaaaggaaagtaaaataatgaatatcaccgatattcgtgaacagttcccgatccttcatcagcaagtgaacggacatgacctcgtgtaccttgacagcgcggcgacttcccagaagccgcgtgctgtcattgaagcagtggatcagtattacagcaaatacaattccaatgtccacagaggcgttcatactcttggcacgagagcgacagacggctatgaaggtgcgcgtgaaaaagtccgtaagtttatcaatgcgaagtcaatggctgaggtcattttcacaaaaggcacgacaacttcactgaatatggtggcgctgagctatgcccgcgccagcttaaaacccggtgatgaagtggtcatcacccaaatggagcatcatgcgaatatcattccgtggcagcaggcagtaaaagcaaccggcgcgactttaaaatatatcccgatgcaggaagacggcacgctttcgctggacgacgtccggcagactgtcacaagccatacgaagatcgtggcagtcgctcatgtgtcaaacgtgctcggcacgattaacccgattaaagagatcgccaaaatcgctcatgacaatggcgctgtcatcgtggtggacggggcgcagagcacaccgcacatgaaaattgacgttcaggacctggattgcgacttcttcgcgctttcttcccataaaatgtgcggcccgacgggaatcggcgtgctgtacggcaagaaagaactgcttgagaatatggaaccggccgaatttggcggcgaaatgatcgactttgtagggctttatgaatcaacttggaaagagcttccgtggaaatttgaagcaggcacgccgattatcgcaggcgcgatcggattgggagccgcgattgattttcttgaagagatcggactcgacgagatttcccggcatgagcataagcttgcagcctatgcgcttgaccgtttcgagcagctggacggcgtgacggtatacggtccgaaagagcgggcgggacttgtgacatttaatcttgatgaggttcaccctcatgatgtcgcgactgtcctcgatgctgagggcattgcggtcagagccggccatcattgcgcccagccgctcatgaaatggctggatgtatctgctactgcgagagcgagtttttatctgtataatacagaggaagagatcgataagctcgcggaagccctccaaaagacaaaggagtactttacaaatgtcttttaatgcaaatttagatacattatacagacaagtgatcatggatcattacaaaaatccgcgcaacaaaggggttttggatgacagcatcgtcgtcgatatgaacaacccgacttgcggcgaccggatcagactgacaatgaagcttgacggcgataccgttcaggaagcgaagtttgaaggggaaggctgttccatctccatggcttcagcttccatgatgacgcaggccattaaaggaaaagatattgataccgccctttccatgtctaagattttctcagacatgatgcaagggaaagagtatgacgactcaatagatctcggggatattgaagcccttcaaggcgtttcgaaattcccggcccggattaaatgtgccaccctttcatggaaagcacttgaaaaaggagtcgctggcgaaaaaggcggcaattaaaagattggagtgaaaatggatggctaaaaaaatgcctgaaattggtgaatacaagtacggttttcacgataaggacgtttccattttccgttcagagcgcggattgacaaaagaaatcgtagaagaaatttcacgcatgaaagaagagcctcaatggatgcttgatttccgcctgaaatctcttgagcatttctacaacatgccgatgccgcagtggggcggggatttaaactctttaaactttgacgaaattacgtattacgtaaagccgtctgagcgttcagagcgttcttgggatgaagtgcctgaggaaattaaacagacattcgacaaactcggtattcctgaagctgagcaaaaataccttgccggtgtttctgcacagtacgaatccgaagttgtgtaccacaatatgaaagaagatcttgaagcgcaaggcattgtcttcaaagacacagacagcgcgctgaaagaaaatgaagacattttccgcgagcactgggcgaaagtcattccgccgactgataacaagtttgcggcgctgaactcagctgtttggtccggcggatctttcatctacgtgcctaaaggcgtgaaggttgaaacaccgcttcaagcttacttccgcatcaactcagaaaacatgggtcagttcgaacgtacgctgatcatcgttgacgaagaagcaagcgttcattacgtagagggctgtacggctcctgtgtatacaacaaactcgcttcacagcgcggttgttgaaatcattgtcaaaaaaggcggctactgccgttatacaacaattcaaaactgggcgaacaacgtttacaacttagtaacgaaacgtacggtttgtgaagaaaacgcgacaatggaatgggttgacggaaacatcggttctaaattgacgatgaaatatccggctgtcattctgaaaggtgaaggcgcgcgcggcatgacgctttctatcgctcttgcgggcaaaggacagcatcaggacgcaggtgcgaaaatgattcaccttgcaccgaatacgtcatccacaatcgtatcaaaatcgatttcgaaacagggcggaaaagtaacataccgcggtatcgtccacttcggacgaaaagcggacggcgcccgttcaaacatcgagtgtgatacgctcattatggataataaatcaacttctgatacaatcccttacaatgaaatcctgaacgacaacatttcattggagcacgaagcgaaagtatcaaaagtttctgaagaacagcttttctacttgatgagccgcggtatttctgaagaagaagcaacagaaatgatcgttatgggcttcatcgagccattcacaaaagaacttccgatggaatacgcagttgaaatgaaccgtttgattaagttcgaaatggaaggctccatcggttaatagtaaaaccccgccatatggcggggtttttttgtttattgaatagtgaaatttccgtattcgcttgaccggacatgaatcggcccgtttaaattgtagttcttctctttgacaatatcgcggaaaacgtcgacacgggcaaccgattctctccattcatcctgggtgtcctcatctgacggattcatcagatcgtcatagcgtacatccaagaatttattgagccatttcttctcgtccgttccgtctttcggtgacccgcccatttttttgttcgtgcgtttaatcagggcataaaaggagtctggatcatcaccgtcaccatgctgaatcaccgtatcgtacatcaccgctttggccaaggccgttttcagtccggcattttctgaacgtttcatcgccggctgataatacaagctgtcgtttaccttatcctgggcagcgcggaaggctttatcattgccaagtgagcgccaggcagaagcgaatcctttcagattgctgatgtcatcgctttcgtccttcgcaagacggcgcaattcaggcaaatactttttcaatttgttattcggcaccgctttcgtatatacttcgactacttccagcgcatctccggtagccgtcgtaaagccggcccgcccgcaagtgtaacctcttccgtcatccaacgcttcaacatatccgtattggatttccgtctttccgttctcaaaaatgctggtcagctgttccgcccggcgcttctgatccttattcagcccggccgcaaaaaccgtaccgctcatcatcagggtaaaaaacatggtgaaaataagagatgaaaccgccgtcttcttccaaaaacctgcttttttcttcaaactgattttcattgccatacccctttcatatgtaagttacgcactcagtatacatgagggggtgatttttttgttgaaaacacacgaatttgtgaatattttgaatcctaagccctatccggcgcttcataaaaagaacgcaccaccttcaccagacagacaatcccgttctcgcatcattctcatctgtaacatagtcaacgcggtgaaacccgcattgtacagcctgctgaaaaagggcttctagcatgtccggatctttgcaatataacgttacatacgagcaatctgcgatgagaagcacaagttcacaggaactatccaaatattcctcatacgtactgatttccgtaccatcccgctcgggaaagctttcaattcagcacacaacatttcaggcagaaaagagagggaacgggcgatcacggaaatggtgagggtgctgaagcctggcggcacattggccgtgtcagatataaaaaatacatcacaatacagagcaattcttgaggaaaacggctttcagacaagaacgtattccttttattatacgtttccgttttcgaaacttatcattgccgtcaggactccggtaggaaccgggcgctctatttgttaaaataaataagacaaaacagatagaaaaggtgttacacatgaagtcttatatgattatcggagccggcattctcggtgcgtccgcggcttatcatctcgcaaaggcaggtgcggatgtaacggtctttgacaggaaacacccggggcaggcgactgacgccgcggcagggatcgtctgcccgtggctgtcgcagcgccgcaatcaggcatggtatgcgatcgcaaaaggcggagcccgctattataaccaattgatacagcagcttgaagctgatggagaaacggacaccggctatcaaaaggtcggtgccgtcagtctccatacggatgaaaaaaagctcagccaaatggaggaaagagcttataaaagaagagaggacgctcctgaaatcggtgacattacgagactgactccggcagaaacgaaggcactgttccccgcgctgtcggaggaatacggggcggttcatgtcagcggcgcggcccgggtgaacgggagggcgcttcgtaaggcgctgttaaacgcggccgttaagcacggcgcggctgtttacaatgaagaagcgtcaatattgacagaggacggtgccgttatcggtgtgaaaaccgcagaacgcacgcttactgccggccaggttctcgtaacggccggcgcttgggcgagagagctgcttgaaccgctcggcatccgtttttcagtatcataccaaaaggcacagatcgttcatttagagcttcagggagaggatacgggcggctggcccgtcgtcatgcccccaaacgatcaatacattctcgcgtttgcaaacggtcggattgtagcgggcgcgactcatgaaaacgataccggcatggatttgcgggtgacggccggcggcctccgtgagatttttgacaaagcattaaccgtggcgccgggcctttcagacagtactgtgatagagacaagagtcggtttcaggccgtttactcccggttttcttcccgtcatcggcaaagtgccgaatatcagcggactcctcgttgccaacgggctgggcgcctcagggctgacgagcgggccgtatctgggggcggaactggcgaaactcgcactcggccagcagacggaaattgatttgagcctttatgatccggccggggcgcttgaataaaaaatagcttttggcgcattcttatgataggatggagctttaatgaataagaggacgtgacccattttgataaaaataaaccttcctgctcctgatgtaaccattacggaacggcagcagtcaccgtcggaaaatgaaccggcgattaaagcgatttacggtttcattgattttcaccgcattccgagagacaaaggcggcatctttatgttttataacattcatgatgaactgctgtttgtcgggaaagcccgtaaattaagacaaagaatcaaaaagcattttgaagacaatgtgtcgcctgttaaacatcacagggacgaagtgtataaaattgaagtatgtgtcgtcaatgatccgatggaaagggagatttacgaaacgtacgcgatcaatacccttcagtcgaaatacaacattgagaaagtattttataaataagaaaaaccggagcttaagggctccggttttctttatgtttacagtgccagccacatcactgcaatatgcacgatcagcagacagtaaacgacgaggaacagctgaacgaccttttttctgaataacatgcagatcatcatgagcacaggaaaaatcaggacgccggccgttttattgattgatgtattcggacggttcgacacgtcatagtgaatggccatatcagcaggaagaaacggataaaacacaatcgacagaataaaggcgagaaccacagctccccacagcaccttatcattcatcaaaaacatatgaacactccctttttacatataatagtattttagtgtgaaaaagttcatttttcagtatttatttgatggctgtgtgctgtataggtatttttaaacgcggcggccgccattgagacgatcgctcttgcggtagcggccatcattttgacagtagcaaacgttgacgaagattccgatttaggaaaagagcagctcatcgctaatgtcgttgaccgcattaacgcacagcactgaggatgaagaaagaaaacgctaaggagacgaaccttagcgtttttttgattgaagcatctgttttaaatatgcttcagaatcaaagccgagttcctcgtcggcttcttttttcagttcaagctgaagtcgcacatacgtgtcatatttcgggctgagcttttgaagtagattgctgaaaggcgatccttccttcagcgcgggcagatcagaagcggattctccgatcttgatcaggctttctctgtactcttcatctgtctccactcttttcacaagctgaatgatgatgtttttatgagtgtcccaagtggcggggtctctctccaaaatccgctcgataaattggtcatgctggactttgtgctgctggagctgagccgggtcctccttaccgaccagctgcatcatcgggtgtgcagccggaacttcttccatatcatccaatactttaataagctttgcccatatcgtttttttctcatctgtatcaatagaaaagtcgaggaacggttcaaacagcgcggcgataaattctccgaaatctcccgggaacagttttttcagctgaagtcccatatacttcggttcatctattttgacctcgccgatatcatgcagaattgaatcgacattttccgcatcttccacgcgcttgatcagcatttcagtcagtttccgttcctgctcaagctcttcaatctgccggctgagcttttgatgctgctggcgcagtatatcatgcagactgctgccctctaagaggaacgctttaatatcgcttacagacagtgccagcattcggagggcggcaatcattttcagcgtattcacgttctgagcggaatactcacggtatccgttatcagggtttttgctgacggtgattaaaccttcctgctcataatatttgatggcttttttcgtgagacccgtctgcctggcggcttcttttatattcattctgaatcactccctgctttgcattctaaacgtgtctctaagggccaggtcaagaaagggcgggaaattagacgggtttattctatattttagaaatttcagaaaatatgattgacaacgcacctttgttgcgattaatataacgttatataatgttatataacattatataataaaacactgaggagtgaaggatttgagtcaaactgccgcacaagtgaatcacaaggttcaggctttcttggatgatctgaaaggaaaaacgattgaccacgtctttttcgtcgcttgcgggggttcttcagccattatgtatccgagcaagtacgtgtttgacagagaggcgaaagccatcagctctgatctctacagttcaaatgaatttattcagcgcaatcccattcagctcggagagaactctctggtgattttatgttctcagtcaggcaatacgccggaaacggtgaaagccgccggtttcgccagaaaaaaaggcgcgcttacgattgcaatgacctttgagcctgattcgccgttagcgaaagaagccgaatatgtcgcggtgtatgactggggtgagaacgcacaggcgataaatacgaattacggggttctgtatcaaatcgtgttcggcgctttacacgtgctggaaaaccatcccgcgtttgagcaggcgatcgacggactcaataaactccagaccgtatatgacaaagcgcttaaacaagaagcggatcacgcaaaggcattcgcgaaagcccacgaaaaagaagatatcatttacacgatggcaagcggtgcgaactacggcgtcgcttactcctacagcatctgcattctcatggaaatgcaatggattcattctcacgccattcatgccggagaatattttcacggaccgttcgaaatcattgatgaatccgttccatttattatcctgctcggcttagacgaaacaagaccccttgaagagcgggcgctttccttctcaaaaagatacggcaaaaaactgactgtgcttgatgcggcagcatatgatttttccggaattgacgattctgtaaaaggctacctggctcctctcgtattaaaccgggtgctcagaagctatgcggatgcgctggcggaagcaaggaaccatccgttaagccagcggcgttacatgtggaaagtcgaatattaagaacgcgcattatatttcaccggactataatgatatataacgttatagtccggtgacaaaggaggaaaagcatctgaaaaagctcatctgcctgttcgttctgttagctttatgtctgtcagccgccgcctgttcaagccaaagcagttcctctgacggaaaagtgaccctgaagttttttcacaggtggccgaaggagccggaaaaaagctattttgaagaagcggtcaaagattttgaagccgctcatccggatattcatatccaaacggaagcggtcttaaacgattcttataaagacaaggtgaaagtcatgctcggaacaacgagcccccctgatattttcttttcatggagcgaccggtttgcttataaattcatcaaaggagataaagccctcgatctgtcgtcttactatcagcaggataaagattggtcctcacagcttgtgcagtcacaaatcaaaccctttacgcatgacggaaaacagtacggtgttccgtggcaaatggacgctaaatcattcttttataataaagacatttttaatacattacatttgaagcccccggcgacatgggatgaactgatcacagtctgtgagaaattgaaagagaacggatatattccgatcagtttcggcacaaaagcgccttggaccatttctcattatatcgggacgctgaaccagcgtatggtggatgaaaaaacgcgggcgaaggattacagcccggaaaccggggagtttacggacgaaggctatgtcaaagcgcttgaaaagcttcaggaacttctgccgtactttacaaagcacgtgaactccgttgatcacgaatacgtgcgccagcagtttacgagcggcaaagcggcgatgatttatgcggaaacggcagaaattaagctcgtcgaaccggtcaatctgggcttgtttcctttcccgaaaatcagcggcgaaaagggatctccccgtgcactgaccggatctcccgaaggatttatgatttcctcaaaaacgaagcacccgaaagaagccatggaatttcttcagtttttaacctcgaaaaaaatgggagagaagctgataaaagacgtcggtaaatacagcgcggttcagggaacggcgacagaaaacaattccaccccgatccagcgcgaagccgtgcaggatatcgtccgcgccgaaacaatggtgccgtggtttgatatggatgttgacgttgaaatcgccgatgtgtatgcggcaggcgttcagcagatgctcggcggcacaatgacaccgcgcgaggtgatgaattccgtgcaaaaagcggcgcgtcaggtcaaagcgttatctgaatagaacagatttctttggagaaaggagatgaggatttccttggtcagccgaaaacgtttcgttccgtatctgtttctcgcgcccgcgctggtttttctgctgttcgtttacattccgattattgagaatgtgtttttcagtctgtttgaatggagctcatttcaacccgaaaagacgtttatcggtttgaaaaattatattgacctgttccgcgatcccgtgttttttacagcactccgcaacaatgtgctgtatgcggtcatatcgctgatttgccaggttggcggcgggttaattctggcggccgtgctggaagacagattggtaagaaaatggtcgccgtttttccgtacggtattttttcttccggtcgtcatttccatgaccgtcattgcgctgttgtttgattttatttataacccggaaatcgggcttttgaatcagctgctggaagcggtcggacttgatgaactgacccgggcgtggctgggcgatgaaaataccgctatgctgtctgtcatttttgtgtctcaatggcagtctgtcggttacatcgccatgctgtacattgtctcgattcagagcattcccgctgaattatatgaatcggcgcagctggacggagccggaaaaatccagcagttttttcacattacggtgccgcagacgaaagaaatgtcgtttgttgccgtggtgatgacgctgaccggcgcatttaccgtatttaatgaaccgtatattctgaccggcggagggccgggcaatgcttcagaagtgctgagcacatttttgtatgagagcgcttttacaaaggatatgatgggctacgcttctgcgatcgcgacggtggtgcttttgctgacgcttgctctgtcgcttattcagatgaaattctttaagaccggaaaggaggagtaggccgatgcttcctgaaaagacggacttgcgtcatgcccgtcaggccgtcagaacaggcggaaaaccgagaaaatggtatgtcggggaaacgtctgtgtggctgtttctctttatctacctcattgctgttgcttatccgctgttatggatggcggtcagcgcctttaaaagctcggatgagatttttgagcacagctggtcgctgccctctgtctggcatcccgaaaacttcgtatccgcatggaaccaagggatttccgcttattttatgaacagcgtcattgtgaccgtgctgacttgtctcatcaccgtatttgtgagtgcctgggcggcatacgggctggcccgttttcaatttaaaggaaaagggtttgtgctgatcatttgtcttggcggcttgatgctgacgccgcaggtcagtcttgtgccgctgtactccattatccagtcattgggattgtacaatacgtattgggcattgattcttccgtacgcagcctaccgtattccgtttaccgtgattctgatccgttcctattttttgtcgatttccaaagagcttgaggaagcggcctatctggatggatgtacaagtttcggaatatttttcagaatattcttacctatgagcgtgccgattctggtgacatcaggcattttgacggcttaccatacatggaatgagtttatgtttgcgattatttttatcgatgatgaaaatttacgtacgattccggccgggctgatgcagttcagagatgcgctgcagacggattggggcgtgctgctggccgggctgacgatttctgctgctccgattatcgcgctgtttttattaatgcagagatattttatccgcggcattgcagcgggaagcgtgaaaggataagggggatgaaaagatgaaactgatagcggccggagataatgtagtagattattatcaggatcaggagacgttttacccgggcggaaatgcgttaaatgtagccgtgcttgcccggcgcttaggccacgaaacttcttatatcgggattctcggcagtgatgaagcggcggatcacgtattgaatgtgctgaaactggaaaaggtgaatgccgatctgatccgccgggcatacggagaaaacgggatggcggtcgtcacgcttgatgaaagaggggacaggatatttgccggatcaaataaaggcggcgtgcaatcgcgtctgacgctcgcttttcaggagaatgacatctcatttatcgccggacatgatctgctgcatacgagcgtatacagcaggatagaacgtgaccttccgatgctgagcggccatgtgccgatttcctttgatttctctgtaaaacgtgacgaagcctatttagaagcggtctgtccgtatgtgacgtatgcgtttttttccgggagtgatttgagtgaaagtgaatgtgtgcggcttgccgaaaaagcccgcggtttcggagcgaaaatcgtttgtctgacaaggggagaacatggcgcggtgttatcggatggggaacgcgtctatcatcagccggtggtaagagctgatataatagatacattgggggcgggtgattcttttatcgccgggtttcttaccgatttcttcgaacatcaggatattcggcgagcgcttactgcggccgccgggacggctgccaaaacatgcggggggttcggagcgttcggttacgggcatccctacaggccggacggcgggaaaagcagtgaaaaaacgagaatacgataagcattgtctcgttttttatacttgttacgcataggggctgttaatggtaaacgtgacgcggtcggtatgcattaaaaacagcgagctgtatatcggctggtcttttgacataaaagcggttttgtcaatttcaaaaagcgcatccccgatatcacaagccagatagcggctttcttcctgcttggcgtatacgacatttaacagtttcgtattatgggtgggcaccacctgatagtgctgtttcaaaatgtcatgcatcgacacgccgcctttaatatgcttgccgatgtcgggaaataaactgagcggatagtgggcgatttcgaatgagagcggctggtcgtcgtgaaataaaatgcgttttaattcaagaacgggactttcggaagcgacgcgaagtttttgagcgatggatttaggcgcttcaatgatttcatgggaaaggatctggtgtttcggttttttttccgttgattccataaattcagagtagccgttgaccgcgatgagctcccgcttcagtttagggcttttaacgaacgttccctttccctgctgccggacgagccagccttcttccacaagatcaaggatggccttcctgactgttatgcggctgacgttgtacgtttcgcacagctcattttcagtcggcagttttacggacggcgaataaacgcccttcttgatatcgtccgcgataatttgtttcagctgaatatataaaggtttcgagctcccgttatttaacaatgggacggacctcctttgtcaagtagtagtactattatatgtattatgacgttataatacaaatttgcttttcatttatgaatctgtcagaaaccccgaacatttttaacataacagaaagatgtggcggtttccagtattggaggaggtttcgaatggcatcattaacatttgaccatatcaaaaaaacatacggcgcccaatcggcggcagtgaaggattttcacttagatgtaaaggatgaggagctgctggtgcttgtcggtccctccggctgcggcaaatctacgacactcagaatgattgccggactggagagcatttctgaagggaagctttatatcgatggagacgcggtgaacgatctgcccccgaaggatcgtgatatcgcaatggtttttcagaattacgcgctgtatccccacatgacggtgtttgataatatggcgttcggtttgaagctcagaaagctgccgaaaaaagaaatcgcagagcgagtccggacggccgctgatattttggaaatcgggcatctgctcaagcggaaaccgaaggctctttcaggcggacagcggcagcgggttgcgctcggccggtcgatcgtgcgggagccgaaagtgtttctgatggacgagccgctttccaacttagatgcgaaactgcgtgtgacgatgcgcgccgaaatcagcaagctccatcagcgtttgaaagcgaccatcgtttatgtgacgcatgatcagacggaagcgatgacaatgggcgaccggattgtcgtgatgaatgaaggagatattcagcaggccgcaagcccccatgagatttatcattatccggcaaatatgtttgtggcgggttttatcggttctccgagtatgaattttataaaaggcgtcatagaagaaagtcacgggcaatggtattttgccggttcgtccgttcgtctgcccattccgaaagaaaaagcggccgttcttgtgcagaaaggatacagcggtcaggagatgactgcggggctgcgtccggagcatttgacgcttgccggacaatcagagcacccgcctgaagcggtgtgccgcgctgtggcggaagtatgtgagaacttaggcgcggagatgtacgttcatgcggtgagcggagatgaccgcatgacgatccgccttgacggcgcttcagaggtgaaacccggcgatgccattctgcttgcggtcaatatgaaccgggccgtgttttttgatgccgacactgaaaacgccgtatattgaaaaagggagcctgatgatggggctcccttatcacttcttatgatacgattaccagatttcgtccgcccattccgggtggtcgataaacggattgcggttatgctgatagtcttcgtaaatgatttcgttccgccgtttttccttactgtcgacggggtcttgtttattccatttgagcaaaacggacagttttcccatgtaaggagctgagccgtttccggttttatcattcagctcaaggtcgggatacccgtcgccgccttcataacgcaccgccatgtaaaacagcatgcgggcgacgtctcctttgacctcatcgcgcggctcccaggaatcaccgtcataataattgcccggcgctttcgggtattctgagccgccgttatcaaaatccatgtttcctctggcgctgttcacctggacgtctgcagggcgcagatgatgaatgtccgtcccggggccggcagctgttccgaagtttccgtgtgactttgcccacacgtgttcacggttccagtccccgacgctgccgccgtttttacttttggcccgtgattcctgggtgtagagcaagatgacattgttcgggtttgccggatcttcgtcagtttccttcaatgcattccatacttggctgtaagacagctttgtatgtccgctgatgatgcggtgcagggcgctctttaaggctgttccgctttttccggaagcttctttgtaatatgtctccgtatccgcagacggagtgatgacagctgaggaagtttgcggaaaaagagttgtgccgccggcagttgaaaccgccagccggctgtacagattcgtgtcagccggcgcgcccgcagaggctgacggcgcggtccaacccaaaatgaaaaacaggcagacaatcggcagaaaccaaagtttttttgtcatgacttgccctcctttacctctattatccaaaaaataaatctaatattctatcttttttgaaaaatggttccttcggcttatgggacagaggggcggtttcttggtcaaagtatccggaaaatcattgattttttggaagatatgataatgaactcgttatgcgctccttctataatgaagatcatcttgtcagtttttcagtttaaaaggagggcgtgtatggaacatcagcagctttcggcggcgaatatcgggatttccgatgacatacaatggctgtctcaattcggcgcttccgcttccggcggagtgacgaggcttttatatacgaaagaatggatggacgcccagcttgccgtcaaaaagaaaatggaggcgttcgggctggaaacggcatttgacgatgtcggtaacgtgttcggccgtctgaacggcacagaatcgcctgatgaggtgattctgaccgggtcgcatattgacaccgttattgacggcggcaaatatgacggtgcgttcggcgtgctggcgggcatgctggcgatccggcatttgcatgagacgtgcgggcgtccgaaaaaaacgctggaggctgtgtcgctctgtgaagaggaagggagccgttttcccatcacctattggggctcaggcaatatcaccggtgctttctcgctttcagatgcggaaacgccgaaagacgcgtccggcatttctctgaaagaagccatgcggcagaacggcttcggtgcaggccgttatccggcgccgctgcgcactgatattagtgcctttctggaaattcatatagaacaggggcaaacgcttgaacgatcgggaaaggatatcgggattgtcaccgggattgccggacagagacgctataccgttacgcttgacggtgaatgcaaccatgcggggaccacttcaatgaaatggcggaaagatccgctcgcggcgggaagcagcatcatccacgaactcatgctctcagcggaaagacagccggaagagctccgcctgacgtgcggaaaaatgacggttgagccgaatatggcgaatgtcattccgggccgtatccagttttccgttgatattcgccaccagcaggaagacgtgctggcagccttccatcagaaactggtgtcgattattgaaaacatcagccgcagcaaaggagtcagaccctttattgatgaatatatgaggatagagccggttcaaatggatcagacactgacacgaaccgcagcagaggctgcaaaagagcagggggcggacccggagaagatcgtaagcggagcgggacatgacgcccagatgctcggcagaacctttccggcctgcatgctgtttgtgccgagccgtggcgggatcagccactccccgcttgaattcacacccgcacatcagcttgaaaccggcgtccttacgctggcgaatgtattacataaacttgcctattaacgtaaagggggaatcggcgtgccgaccagaaaagaattgtgcattccgcaaagaacgataatgacaccgggaccgacagaagctgaaccgagagtgctgagggcgatgggcgctccgatcctcggccagtttgacccggcatttaccggcatcatgaacgaaacgatgcaaatgctccgtgaattgtttcaaacggaaaaccgctgggcctatccgattgacggcacatcaagagcggggattgaggctgttctcgcaagtgtgatagaaccgggtgacagcgtgctcgttccgatatacggacgcttcggacacctgctgactgaaatcgccgagcggtacggagcggacgttcatacgatcgagtgtgaatggggaacggtcttccggcctgaagagattatcggcgagatgaaaaagatttccccgaaaatcgtcgctatggtgcacggagaaacatcaacggggcggattcatccgctgaaagaaatcggggaagcgtgccgcgcccaagatgcactctttatcgtggatgccgtggccacgatcggaggatgcgccgtaaaaacggatgaatggaagattgacgcagtcatcgggggaacgcaaaaatgcctatcggtcccttccggaatggcgccgattacttataatgaccggacggccgctgtcattgccgcgcgtaaaaaggtagaacggggcattgcgacggcagctgacggtaaaatgctgtccggtcatcggccggttacgagcaactattttgatctgagccagctcgaagattattggagtgaaagaaggctgaatcaccatacagaagcgacagcaatgctttatgcgctgcgggagggtgtgcgccttgtcctggaagaaggacttgaagaacggttccgcagacatcagggccatgaaaaagcgcttacggcgggacttgcagcgatgggccttgatttattcggcgatccggaggcgaagctgcctgtcgtcacatgtgtgaagattccgccggaagcagacggcgaatcgatcaggagtatgcttttgtctcaattcggaattgaaatcgccagctcgttcggtccgctgcaggggaaaatttggagaatcggaacgatgggctacagctgcagaaaggaaaatgtgctgtttgtgctggctggacttgaagcggttctgatcagacacggagttgcagttaaagccggggaagcgctgcaggcggcccttaacatatatgatctgccggctgaaaccggtgtgctgtcatgagatatgaaaacgagattgaaatcatctggacttttttcccttttccccgttatactgaatggtataaaaaatgacaaatatggaatgatcatctgtttgtctggggagaaggtaagaaatcatggcgtacatggggcgattgtcaattttaatgctgaatatgtttattgcgatgcttgggatcggattgattattccgattatgcccgcatatattaccgaattcggagcgacggggagcacgatgggtctgcttgttgcggcggcggggcttacacagcttttatttgcgcctattgccggggaaataaccgacaaatacggacggcggaaactgattattttcggcattgccgcctttgccgtgtcacaattgatcttcgcctttgccggaagcctgtggcaattgttcgcatcccgccttttgggcggaatgggcgcggcgtttttaatgccgtcaatgttcgcttacattgcggatattacgaccgaggaagaacgcgggaaaggaatggggctgttcagcgcggcgatgacgctcggtgtcgtcatcgggcccggtgtcggcggttatttggttcattacggcatgtctgtgccgttcatcgtgtccgcaagtctcgcctgcttttcaaccgttctttcatttttctttctgcccgaaacgctggggcgtgaaaagcagctggaagcccggtcaaaaacggaaaaacgtgagcatctgtttaagcaaatgtcacgcgcgctcaaatcgccgttcgcgtttatgctgattctggtttttgtgctgaacttcggaattatgaactttgaatccgtttttggcctttacgttgaccataaacacggatttaaagcctctgatattgcttttattattacggctgcgggtctcatcggcgtgtttgtgcaggcggtcggcgtcagttatctcgtccgcaggttcggggaaaagcgcgtcattaacgtgacgttgatcggggctgctgcaggacttgtgtggtgccggtttgcgggttcatattgggccgtttttgccgcggcaatctttttcctcacgctgacatcgctgctccggccggccgttaatacgatgctgtcgaagctcgccggtgaccagcaggggtttgccggcgggatgaacacctcattcatcagcttagcgaatatcgccgggccgtcggccgccggttttctctttgatgtaaatatggaatttccgtatatgctgggagcggccattctcgccatcagttttctggccgcgcttggctggggcaaaaagacacagacccggccgttcacgcagcaaggataagaatcaaaagcctccgggtatccggaggctttttgctgattgtcgtttattctgcggctgtctgcatctctgaaattgcagagatgcgcatagagggaaaatcatatagcaaaaacagttgttccgtatgctcaagcatggcgcgaatggaaaccggaacaggtgtagataaagtaaaaccagctttatcgcttgacgagtctgacgaatttgatctgccggaagttgatcaaaaaagaaggcagtcaggcaggcagggacaacattgagcggcgtaaatgctgagaaggaaaaagcagggttttggaacttgctgtttcgtatgcagggggagagcattctgataaaacgggtcattgaaataatacgaactgttcagaagggggcgattggtgacaacaaggagaggttatcttataaaacctctcacggaagatgttgtgtcggttctcctgtacgaattttgcagattaaaacccgcaattaggccaacacacaattatgcaagagacaatcatctaaaaagggtgtcggtaagtacaatatggtgtacggaaaaggagttgaaaatgttgtattattacccgtcattccatttgtatcagcggcaagaatttaattattatccatgggcccatcaattgactcattcagggggctccccctatgtttccgcgcgccctcctttttataattccccatgttacagagagtgcataagaagcggagcggatagttatttctgctgctatatctgcggtttctgttaaaaagaaagacttatagaagtaagtgatctttccaggatgacagtgagaccattatccagacagccattagccaacacacgaagctttattacggttcacggaggggaagcgcccctcctttttcagaaattttataaaatccccttgcgcggcctgtcagaagcggtttttggtcttgatgtgttcgactgttggtgttgacgaagaattcaagataccaggaagcagcgaaacctgtatgtatccgcgagacacaaagctttccgccgctgagcgggttcattgtcactgcgttctgtctcgctgtagtagataacgagattttgggactgtcagttgaggaaaaataaaaaattcaaaacgtcgcaatcgtttaattaaaaagaagagatagaatctatctcttcggattattactgaactacaaaatggtatcgggttttccaagtggaggaatcatcatagaattcaatccaggcttctcctttagcgactgcaaatacctgaatggttttgtagtcagtacctaaagctttccatgtcacagcaggagggttataacccataggattaaaggtaatgcgattaccagaagtagaataattccttatctctcctacttttaaattgacgcgggtttcagactgagattgaaacaaattcttattcactttagtagagggaccgacggctgatgctgaagagttaaaaaaaggcgcgaaaacgaatgaaacaattgcaagtgataacaaagcatttttagctagtttcaacgtaaaacctccttttggtatttataggataacaataacacttaatggaaatataacgatggagaaattgttaaatattctttgaaatgagtgaacacatgccaagtgaattgataaatgcaaacatcatacatgtttcttacgtagataaggctgctaatcaaaagcagttcttttttatgaaatcagaaaaggaaaagcagcatgactttcagggcggcgttggggaagtggttgagtcttgtgtcgctccccgctgattttcaaatgaatggcgaaaccatcaaaaaagggtcatggatacttgtgacaaaggttccgaggcagtttaggatgaaatcaaaaagggtgagattatcggttgcatcccgaatatcgaaaaagcctgatgatatcaatggcagcattttttgaggatttagctgaatgttctcccttaaataagatgcgggagaacacccgcatcctggtctatggctaaattttaaccgatcagccgctgcattctcagcgcgagccgcaggcgcatcgtcgtctctggatcttttaagcttttgccgagcagttcctcgcatttttctaaacgatagatcaccgtatttcgatggacgtacaggcgcttagccgtttctgaaatctggcagtgggtttccaggtaaacagacagtgtatgaagcaggctctggtcctccttttgccggtcggccaggctttggagggtggcttcgtaaaactttttcacatcttccgccggaagcaggccgagcagctccggcacgtctttggcatgatagatttgaataaactccgcgcttctggacaaatgcccggatgaaatggcgtctgaagcttcagtaaaagcgtcagggacatcgatcagcttttggcatatgtttgagatgccgaaggagacagtccgtttaaactgcgtccggacctgtttctgaaactgctccaaaaagctgatgacagacgcgtgcatttcattccagctgtctgtcgcttcaattaaaagaataccgacatttcctttaataaagagatgagggggaaacggaaaggatgacagctccccttcaagcagatcaaatacatgatcggaaacgagctgattttcggtaaagctgatcgttttctcatttcggtcgagttttccgcaaatgcacatgtatttctgatcccagcgaagccggaattctttggcgcggcttttgatttcttcatggccggtaaacgagcggtcgatgaaattgctgaaaaattcattgcgcgcccgtctgccgaattgtttgacggcattttctttcagcagttcaaaggaaatgacgttggccgcctgttcaattgtcaaaatcatgcctttatcagcggtctgcaccagctccggaatcaccagataaccgcagtttttttcaacattcagaatcggcaggacagaatacgcctttctgtcggagagcatggaaaagcaggtgaaataaggaccggaaagggaataacagatgtttttcaataaagacgtgtcaatgggtatgctgtgggacgatgataagagttttgtatgctgatccaaaagcagcacgggaagccggaggatgtctgagagcttcttaagcagggattgcagccctttgccgctcatgatgtggtttgtaaattttttatgggcgtaaatggcctgctgcagctcatttgaacgcatatcaagaatatggctcagtgtagcattgacgatatctcccagcctgatgtcttccggaagctcaataatcggaaattcataccggtcggcaagctccgcggcatctttcggaatgacattaagatagcgcttcgttttgatccccagtcccgcgcatccccgttttgccatgaggcggattaaatctttcaacagctgcgggcggtccttcaagtggtaagccgtcgtgacgagcaattcgtttttatgtaaaaaatcagcgatgtccggcgcatccatcatgttgacgtgctgcacctccctccagccgccggatctgcctgcgattaatgcggcccgctcataagcgggaatcttcatcacatcataaatattcatcagtcaatctcctttcaggttctaaagacaaccattggttaatatgaataaaaatcatcaaaaattatagcggttttgctgatgtattacgatcatagtagcagtaaactggcaatcatagacgcatgttgtgataaaaactgacagaaaatcgtcatccttacagggaggaagataaaatggcctatgacgtaattgtaaagggtgcgaaagctgtgcgaaaaggcgggacagagcgggccgatatcgccgtcaaggacgggaaaattgcattgatcgagcccggcattgacgaaaacgcggaacaagtggtgcaggcagacggcatgtatgtgtttccgggcgcggtcgattgtcacgtgcatttcaatgaacccggacgcgaagaatgggaaggcattgaaaccggctcaaacatgcttgctgccggcggctgtacggcttattttgacatgccgcttaactgcattccttcgacggtaactgctgaaaacctgctggcaaaggcggaaatcgccgaacggaagtcagcggttgattttgcgctttggggcggtttgatgcccgggtataccgaacatatccggccgatggcagaagcgggggcaatcgggtttaaagcgtttctgtctaaatcgggaacggatgaatttcaatcagccgatgaacggactcttttaaagggaatgaaggaaatcgcggcgtgcggcaggattttggccctgcacgcagaaagcgacgccctcacccgattccttgaagccgagtacgcgctccaagggaaaattgatgcccgcgcttacgcttcctcccgtccggaagaagccgaatgcgaggctgtgcagcgggcgattgaatatgcaagagcgacgggatgcgcgcttcattttgtacatatcagcacgaaacgggccgtgctctccattcagcaggcgaaaaaagacggattggatgtcaccgttgaaacgtgtccgcactacttattattcagctttgaagacttcctcaaaaaaggggcggctgccaaatgcgctccgccgctccgctcagaggctgataaagaggaattgatcggggttttggctgaagacctgattgatatggtgtcttcggatcattctccctgtcatccggctttgaaacgcgaggataatatgttcctgtcgtggggcgggatcagcggaggccaatttacgcttctcggcatgattcaattagcgatcgatcatgggattccgtttgaacatgtggcccgatggacggccgaagcacctgccaagcgtttcggtttaacgaataaaggccggcttgaagaaggatttgacgctgattttgccattgtccggccggaaccttttaccgtcacaaaagaaacgatgttttccaaacataagcaaagcctgtatgaaggccgcacctttccataccgaattgctgcgacctacagcaaggggtgctgtgtgtatcaggatggcggtcgtaagcagagcgggtctttcggaacattcctgaagccttgtgaaataaaaaagccgattctctgatgagaatcggctttttttgtcgtttggaaagcgggtctcgtggtatctttttataaaaaggagtaaaacacattgtatgatcaaatcttgaacatattaacggcatcctggtcgcgcaagaccagtacaaaatggacggaagattgcccggccacaggccagtgcggcgtgacggctttagtcatccaagatgtttacggcggtgacattctcaaaacaaaaaccggcacaagctggcatttttataatcgaatagacggggagatatatgatttcacgagcggtcagttttcagagccgatcgtctatcagcatattctttcttccagagatgaggcattttcggacaccaatgaacatcagtaccgttacctgcaaagtgcattcagaaaaaacatggaaacggaaagagaaaaacacctgtgataaactagaatgagaggtgaaggattgtgatttatatcggactgacggggtggggggatcatgacagcatctatccgcctaaaacagcgggcccgcaaaaactgcaggcgtattcctcccattttcccatcgttgagctggacgcgagcttttacgcgatacagcccgcccgcaataacgaaagatgggtcaaagagacgccggaatcttttcaatttgtcattaaggcatttcaaggaatgacgggccatcagcgcggtgatattccctttgaatcgaaggaagaaatgtttgaggcgtttaagctgtcattatcgccgtatatagagcatggaaagcttgccatggtgctgttccaattcccgccgtggtttgactgcaagaaagaaaacgtcgcatatttaagatggtgcaggaagcagatgggcgatatcccgtgcgcgcttgaattccgcaaccgatcttggttttccccgccattttacgaacagacgctttcctttatgaaggaggaaggctggattcacagcatatgtgacgagccgcaaatcggcgagggcagcattccgaccgtcctgaaagcaacggatgaagaaaaaacgcttgtccgttttcacggacggaacaagcagggctggatcaaacctgacggcggacaaaactggcgtgaggtcagatatttataccgctataacaaacaggagctcaaagattggaaaaacaatcttcaggagctgaaaaagcagtcgcgcaatctgtatgtgctgttcaacaataactcaggcggagacgccgccgataacgggcttgagatgcttgaaatgttaaatatctcatataccgggcttgctccgaagcagctcgacctattcagctagaaaagaggtttcaagacacatgtcttatcttattttgattatattgggatttatcgcgggaacggtcggcagcctgatcgggcttgggggaggaattatcatcgtgccggcgatgctctatttaagcacgatgaccccgtttttccatgacgtaacaccgcagactgccatcggcacgtcccttttggtgattatttttacgggcctgtcatcaactctggcctatatgaaatataaaaccgttgactacaaaagcggactgatcttttttatcggttccggcccgggaagcatcatcggcgcgtatttgtctaaactttttaatgcgcatacgttttccgtctggttcggactttttatgattttgatttctattacattaatgctgaagacgaaagcaaaaccggtcaataaagcgcataaaggcatgatccggacatatgaggatgaatcgggtgagctttatacatattcgtaccgtatttttaccggtatcgccattgcctttttcgtcggtttattgggcggtcttttcggcatcggcggcggctctcttatggttccggccatgatgctgttatttttgttcccgccgaaagtggctgtggcgacgtcaatgctcatcattttcttatcctccgtgacgggttccgtgtcacatatcgcagagggccatgtcaattggctgtatgcgctgtgcctcgttccgggggcgtggttcggcggcaaaatgggcgcgtgggtcaataagcgggtgcagacgaaaacgatcgtgcttttcatgcgggtcgtcttgattttgatcggctgtgaattgatttatcaagggatattcagctaaaaggtaggagagatggtatgttagagaaactccgtttatatcatacgaatgatttgcacagccatttcgaaaattggccgaaaatcgtacattatattgagcagaagagaaaagagcatgaaaaaaacggggaggaaacactcgtattcgacatcggcgatcatatggaccgatttcaaatgataacggaagcgaccttcggcaaagcgaatgtcgacttgttaaaccggcttgagatcgatgcggctgccgtcgggaataatgaaggaattacgctgcctcacgatgagctggcgggtttatatactcatgccgcgtttcccgtcattgtgtccaacctgtttgacgcggacggacatcggccggaatgggccgagcgctacgtgatcaaaacgctgaaaaacgggatgaccgccggcatactcggggtcacggtgccgtattatcccgtctatcaaaaactcggctggacggtgacggatgcggaaaaaagcattcaagaatcacttgacgatatcaagggcaaagcggacatcatcattctgctttctcatttaggcctgatcgatgaccgggccgcagcggaaaaatttcccgacatcgatgtcattcttgaatcacatacgcaccaccttcttgaggacggacaggacataaacggcgtattgcttgcatgtgcggagaaatacgggaactatgtcggctgtgtcgagctgacgatagaaagtgaatcacggaccattgtcagcaaacaggcatctgtacagaaaatggctgattggcacggggaatctgaagatacggcggcttttctgaaagagaaagaacgggaagcggaaaacctgctctccgtacaagtcgccaatctgaatgaagaagccggcgtgaagtggtttgaggaatcgccgctcccgcttctattagccgaagcgctgaaaagctggtgcggctgtgaagtcagcatggtgaattcaggcgtcattttggggcctttacagaaggggcctgtcacaaaacttgacttgcaccgcatctgccctcatccgatcaatccggtcgccgttcgtctttcaggcagggaactccgggaaacaatcagccaggccgcctcggaacaaatggagcagctgcggattaaaggcctcggcttccgcggggaagtgatgggcaggatggtatatgccggagcggaggcagaggccggcatccttgaagacggtgtgacgcatctcctcaatgtgaaagtgaacggagaagaggtggatccggagcggatatactcggttgccgttctcgacatgtttacactcggcaagctgttcccttacatccgcgattcaaaagaaaaacaatactttatgccggagtttttaagagatctgctcgcctggaagctcgcgcggcagccgtaatgtcaaatatccgccggccgttccatctcacccgaatgaaggtaagcgggactttttaagagtaaaaataaaatactatgtcccctcttacaagcatacattgtgatatgtaaggggggatttttcttgcctagataccggagcgctcttcgcaagagagggcctttgccttttcgatatgtgcttcttctgtcgtttgctttttttatcatatcgacggtcatcagcctctggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagcatgaaggcgaaagtgacaaagcagcttcaggctcatttgaaggaagcggagtcgaacaataagcagcatgaaacggaaaaaggcgcgaaaacggccgatgaaattatgattaacatccctttagggcaggtcacgggaaacagcgttctcggaaatctggggccgaaaatccccgtgcgctttaacctgatcggtgatgcgttaactgatgtgaaaacaaaaataaagccgtacggcattaacaatgccctgatcgatatcagtatttttgtggaaattaaagtgaaggtcattattccgtttgccagtaagacatcagtcgtcacaaataatattccggtctccattaaagcgattcaaggagaggtgccgcagttttataacggaagcggcggatcaggtgtgacgccttctgtccagctgccgagtgaaaaacagaagaaagataaataaaaacacacagccgcaatctttcctggcggctgtgtgtttactttttcctgcggatttcttttcgctcccatgcccttaaatggggatacgggtcaaaagaccattccgatctgccgttatctttatacatcccgtagtgaagatgcggcgggaattttcccgcggtgcccggcggtccgtatccggaactgccgacagagccgatcacctctccgggtttgacgatctggcctttatgcacaccttttgcaaagccgttcaggtgagcgaagtagtgatacgtattattgatatccctgatgccgattctccagccgccgaaacggttccagcccttcatttcaacaataccgtagcaggtcgatctgacgggaagtccgtaatgagcgaacagatccgttccttcgtgaatccggcgcccgccgaaaccccgtgcggcgccccatgtgctgcggtagctgtaatccgtcttcacgggaagcggaaaagcgtgctctccgagatcaaggcggccgaacgttttaaacagtgtcatgaattcggtgataatgccgaccgtctgatcacggcggtaataattccagaggccgatgcggatatggtcaagatccgttccgaatcccgctaaatactgtgcaaatgtataaaggatatcctcatcattgctgacctcggcttttccgtcgccgtcgccgtccaggccgatcccgtcaaatactttaatgctgaggggcgcctcgtccttaggatttggattttcaggcccgctccacaaatgatccggaatataaatgctgatgattcccgctttttccggcagatcctttcggttcgagcggacattttcttcatattgatcaaccgccgcaagcacataccaaggaatctgcgtgactgcttcggctttgcggtacaactgcatccgttcaccgtaaacaggagccgattgttctttcccgcttgcagccggacagaaaaatgataaaaggagaagagcagataacagaactttcacaacatgatctcctttcaggattaatacaactagtttgcggcaacaatccgagaaaatgtaagtaattctcttcccttgtcgagaaatttttcctatgttaaagtgactattgaatagaaatctgcaagttttatatccatcgtgaaatagaaatttttcgcacacgaacatgaataaagggataatggagatgatggggaaatggcaaagaaagacgagcatctgagaaagccggaatggctcaaaataaagctgaacacgaatgaaaactatacgggtctgaaaaaattaatgcgtgaaaataatctgcataccgtatgtgaagaagcaaaatgcccgaacatccatgaatgctgggctgtcagacgtacggcgacgttcatgattctcggttccgtctgtacgagagcatgccgcttctgcgctgtcaaaacgggtctgccgactgagctggatctgcaggaaccggaacgcgtagctgattcggttgcactgatgaacttaaagcacgccgtcatcacggccgtggcgcgtgatgatcagaaagacggcggagcaggcgtctttgcggaaacggtccgggcgatccgcagaaaaagcccgttcacgacaattgaagtgctgccatccgatatgggcggaaattacgacaacctgaaaacattaatggatacccgtcctgatattctgaaccacaacattgaaaccgtccgccgcctgacaccgagagtccgggcccgcgcaacatatgaccgttctttggaattcttgcgccgtgcgaaagaaatgcagcctgacatcccgacgaaatcaagcattatgatcggtctcggcgaaacgaaggaagaaattattgaagtgatggacgacctgcttgcgaacaatgtcgacatcatggcgatcggccaatacctgcagccgtcgaaaaaacatttaaaagtccaaaaatattatcatccggacgaatttgccgaactgaaagaaatcgcgatgcaaaaaggcttcagccactgtgaagcaggcccgcttgtccgttcttcctatcatgcggatgaacaagtgaacgaagcgtctaaaaaacgccaggcccaagcataagataagccgaaaaaacccaaaacgccgcaggttttgggttttttgtgatggagccgtctgtgcagggaaaaagtcattcttgaataaggatcgtcagaaccgctacactggatataaaaggggaaaatttttccgtccgcccgaaccgtctcattttgcaattgatggacagaagtcaatgaattatgatagtaaagagtgataaaagaggtgaagacatgattcttattcaaaatgccgagtttgaactcgtacacgattttaaaaacggctttaatgaagaagcgttcaaagcccgctattcggacatattaaataaatatgattacattgtgggagactggggatacagtcagctgcggctcaaaggcttctttgatgaccagaatcaaaaagcaacctttgaaacgaaaatcagcacattggacgaatacatttatgaatactgcaatttcggctgcgcgtattttgttttaaaacgaatcagaaaataattgatgcagaaggggatgctgtcacgtgtattttgttgacagaaataatatcgaacaaacactccgtttttttgagacccagctggcgctgtttgacagcacgcccgcatggcagagcgaaatcgaaaaaagagcgcttgagcggatcagccatcttatgatcgaatgcattctcgatgtcggaaatgatatgattgacggctttatcatgcgcgatccggggagttatgacgacatcatggatattctgacggatgaaaaggtggtagctgaggatgaagcgaataagctcaagcagctgatctcttccagaaagcggcttgttcaggaatatcagcaagccgatcatcaggagctgtttacgctgatcacgtcaaacagggacgtgctgaaagcctttccggcccgtgtaagaacctacctggaaacagaattagggcctgtttccgcatttaaataacaacgagtgagaaaatccacaggagtgttgagtatgaaggattataaaggatatttgatagatttggacggcacaatgtacaacgggacggaaaaaatcgaagaagcgtgtgaattcgtgagaacgcttaaagcgcgcggcattccgtatttattcgtgacgaacaattcttcccggacgccgaagcaggtggcggacaagctgatgagctttgacattccggcaactgaagagcaggtcttcacgacgagcatggcgactgcgcagcatatcgcccagcagaaaaaagacgcgtcggtgtatgtgatcggcgaagaaggcatccgccaggccattgaagaaaacgggctgagcttcggagaagaaaacgcggactttgtcgttgtgggaatcgaccgcggcattacatatgaaaagttggcaacgggatgccttgcgatcagaaacggcgcccggttcatttcaacaaacggcgacgtcgccattccgactgaaagagggcttttaccagggaacggttcgctcacatccgttttgacggtgtcaacgggcgttgagcctgtctttatcggcaagcctgaatccattattatggaacaggcgatgcgtgtgctcggaacggatatttccgaaacactcatggtcggcgataactatgcaacggatattatggccggcatcaatgctggcatggatacgctgctggttcataccggagtgacaaagcgtgagcatatggcagattacgaccggaagccgacatatgcgattgactctttaacagaatggattgaacatctataaaaaagggacggccatgacggccgtccttattctgtatttctggcgctgtgggcaagccggcttgaagccgctgctgcgattgcgccgacgatatcatcaagaaacgtatggcattcgcccgtagatttatcatttaaccgcccgagaatgccgggtttttctttgtcaatgtagccgtaattcgtaaagccgattgagccgtatatattcacgatagagaaggcgagcacctcgtcaaccccatacaggctttcatcaatcgccagaatggtctgaagcggttcagacagttttttttgttcggcgagcacatctaattctattcccgttaaaatggcgttttgcacctcgcgttttgcgatgacacggtccacattgagcctgcatacttccatcgtcaaatcaggatgatattttttctgaaggaaatacaccagctcggcaatatcgtccgtctcaaccccccgttcttttaaacgcgctctggcgacagcttccacctgattcagttgttccttttctgacatttgcttcacccaatctttttttactagtttatacaacacccttccgatgtgtacgatgtttctccacttgattcaaaggattacaatatgtattcataattccgccggcgtatgactacgatgtgaatagctctaatttttcaggcaggtgattatgatgaaaagcatcattaaagaaaagtacggcatccacgtcagacagctttccgtttatcagaaataccaatgcttccagacgcctaattccttctttcttattattcccgtttccgggttttcgcaatcagagctgacggagctttactacatgagtcagtatttacaagaacaaagtgacccatacgtttcagtgtttatctttacgaaggaaggagaactgacctttgaggacgaaggcaaaacgtatgcgctcttaaaagcgccgatccccgtcgcaaaccggtcgttttctgtcggaggggagcttgccgaatttcacagaaaagggcggggttttccgtacgaagtgaaagaagcgggcaggatcggccaatggaaggacttatggggaaaacgggtggatcagctggaatcattctggatgcagaaaattcatatgtctccgcttgaaccgttcgaaaagaaaatgatcgaagcatttccttattattcaggcttagcggaaaatgcgattcaatatttagtggatacggagctggatgacaatcccggcgcagaagactcggggacaatctgccatcagcggatggaacgggatacctggtcggaggaatcattgatccgcattccgggcgattgggtattcgaccatgccgcccgtgatattgcggaatatatgcgcagcacatatttgtatcatcgtgacgacttgcttaacaaagggtttttgtttttgcaggaatatgagcaagttacgccgttatcctccttttccaagcgcctgttttacagccgcctgctgtttccgcttcatttctttgagacggtggagagttattacatttctcatgattctgaaaaacagttttacgaagagcagcttgactacattcttgccgactgcacccgctatgaacagtttttacagacatgtcacgacatgatgaatgtcaggtcggcgcaggtttttgtcccgcctgtggcgtggctcggaaaaggaatcagttcgtaagaaaatataacgtaaaaatatttagaaaatagggaatcttgtcatatcaatgtgttaagcgttttcatggccgtagaaacaatattcagccgcttgtcaaaacaaatgcgggcttatataatatttgtaacttaaatgtctgtgaagggttaacaattgtccttttctagtggacaaaaggaagaaaggtggagtttctctttggaagcgattcgtattggactgttaggactgggaaccgtgggaagcggagtcgtcaaaattatacaagatcatcaggataagcttatgcaccaggtcggctgtccggtgacgatcaaaaaagtgctggttaaagatattgataaaaaacgagacgcagacctgccgaaagaagtgctgacgacagaagtctatgatgtgatcgatgaccctgaggtcgacgtgattattgaagtcatcggcggtgtcgaacagacgaagcaatatcttcttgatgccttgaaagcgaaaaaacatgttgtgaccgcaaataaagatctgatcgccgtatacgggtcagagcttttagccgccgcaaaggaaaatggctgtgacttgtattatgaagcgagtgtcgccggcggaatcccgattttacgcacgctcgaagaaggcctttcctctgaccggatcacaaaaatgatgggaatcgtcaacggaacgacgaacttcatcttaacgaaaatgattaaagaaaaaagcccgtatgaagaagtgctgaaggaagcgcaggatctcggattcgcggaagcggacccaaccgccgatgtagaaggactcgatgccgcacgcaagatggcgattttagcccgtctcggcttctctatgaacgtcgatctggacgatgtcaaggtaaaaggaatttcccggattacggatgaagacatcagcttcagcaaacggctcggctatacgatgaagctgatcggcatcgcccagcgtgatgacaataaaatcgaagtcagcgttcagccgacactgctcccggatcatcatccgctctctgccgtgcataacgagtttaatgccgtttacgtgtacggagaagccgtaggcgaaacgatgttttacggccccggagccggaagcatgccgactgcgacatcagtcgtttccgatctggtcgcggtcatgaaaaacatgcgtctcggcgtaaacggaaacagctttgtcgccccgcaatttgaaagaaatctgaagcagccgtctgatatctacgcccagcagtttttaagaattcatgtcaaagaccaggtcggctctttttcaaaaatcacatcggccttctcagagcgcggcgtcagctttgaaaaaattctgcagctgccgatcaaaggacatgacgatctcgcggaaatcgtcatcgtcacgcatcatacatcggaagaagatttcagtgacattctgcaaaacttaaatgatctagaagttgtacaagaagtaaaaagcacatatcgtgtagaagggaacggttggagctaatgtggaaaggactcatccatcaatataaagaatttctgccggtgacggatcggacgccggtcctgacattgcatgaaggcaatacgccgctgattcacctcccgaagctttctgaaaagctcggaattgaactgcatgtgaaaacagaaggcgttaatccgacgggatcttttaaagaccgcggcatggtcatggcggtcgccaaagcgaaagaagaagacaatgataccatcatgtgcgcctcaacaggcaacacatccgctgcggctgccgcatacgcggcgagagccggcatgaaatgcatcgtcatcatcccggacgggaaaatcgccttcggaaagcttgcgcaggccgtcatgtacggtgcggaaatcatcgcgattgacggaaactttgacgacgcgctggccatcgtccggtcgatttgtgaaaaatcaccgattgcattagtgaattcagtaaacccttaccggattgaagggcaaaaaacagcggcctttgaagtatgcgaacagctcggcgaagcgccggacattctggcgatcccggtaggaaatgccgggaatatcacggcctactggaaagggttcaaagaatatcatgagaaaaacggcaccggacttccgaagatgcgcggttttgaagcggaaggttctgcggctatcgtccgcggtgaggtcattaaaaatccagaaaccgttgcgacggcaatccggatcgggaatcctgccagctgggacaaagccgtgctcgctgcggaagaatcagccggaaaaattgatgaagtcacagatggagaaatccttcacgcttatcagctgattgcccgtgaagaaggcgtatttgccgagccgggctcctgtgcatccatcgccggtgttttaaaacaggtgaaatccggtgaaattccaaaaggaagcaaggttgtcgcagttctgaccggaaacggcctgaaagatccgaacacggctgtggacgtatctgacataaaaccgatcacgctgccgacagatgaggacagtattctggaatacttaaatggagcggcgcgtgtatgaatgaggcggagatgctgttttccattacggttccgggaagcaccgccaacttaggacctgggtttgattccatcggaatggcgctcagcagatatttgaagctttcggttttccgaaacgatgaatggcagttctcggcggaaaccgaaactgtcgcgggcatccctcaaggaacggacaacctcatctaccaagtcgccaaacggacggctgaccgctatcagaaagagctgccacccgcccatgtcaaagtttggagtgacatcccccttgcgcggggtctcggaagcagcgcggccgctatcgtcgccgccattgagcttgcggatgagttatgcggcctgcagctgtcggaaagcgacaagctgcacttagccagtcttgaagaggggcaccctgataatgccgctgcttcccttgcaggagggcttgtaatcggccttcacgaagaagatgaaacacatatcgtgcgtgttgccgaagcggatatcgatgttgtggcagtgattccgttttacgaagttctgaccagggacgcaagagacgtgctcccgaaagagctgccgtaccgatgcgccgttaaagcaagcgccgtcagcaaccttctcgttgctgcgatcatgtcaaatgactgggcgctcgccgggaaaatgatgagaaaagacatcctccatcagccgtaccgcgccatgcttgttcctgagctttcaaaggtggaacatgcggccgaaatgaaaggcgcttacggaacggcgctgagcggagcgggaccgacgattcttgtcctgattgaaaaaggaaagggagaagagctgagaaaacagctttctgagcatttccctcactgtgagattgcggcgcttaccgtcccgtcagaaggaagcgtaattgaacggaatcctttagaacaggtgaaaagtgtataatgataaaaaagcgttcttcccatcagagaaggacgttttctttttctggagaaggatttttatttagggaagcgaaataaaaaagaaaaggaggagaaacgatttgaaaaaactcataaccgaggaggacattgcgtctctcgtatccgtgacagacccgcaatatgcccctgacggcagaagagccgcttacgtccggacaacagtcaatcataagcgggattcctattcctcagctattatggtatatgacacagaatccggcatctcaaacccgtggactttcggggacgataaacatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatcccctcattctatacatacacggcgggcctcacatgatgtacggccatacgtattttcacgaattccaagtgctggccgcacaaggatatgctgtcgtgtatgtcaacccgagaggaagccacggctacggacaggattttgtcaatcgtgtcaggggtgattacggaggcggagattaccgtgatgtcatgcaggcggtggatgaagccgttcaggcgtatccgtttatagacagcggccgtctcggtgtgacgggcggaagctacggagggtttatgacgaattggattgtcggacagacaggccgttttaaagcagccgtcacgcaacgctccatttcaaattggttcagcttccacggtgtcagcgatatcggcttcttttttaccgactggcagctcggacatgatttgtttgaggaagcggataagctttgggatcgttctcctgtaaaatatgcatcccgcgtttcgacgccgcttttgatcctgcacggtgagcgagatgaccgctgtccgatagagcaggcggagcagctctttaccgcattgaagaaactgaacaaaacgacgtcgttcatccgatttccgaaagctacgcatgagctgtcgagaagcggccatcccgaacagcggatgaaacgcatccgttatatttgttcatggtttgatgactatttgtaaaaataaaaaaaccaggctgtcatgcagcctggttttataattaaaatacttgttctacttcaacgacacccggtacttcttcaagaagggcgcgttcaattccggctttcagcgtaatcgttgaacttgggcagctgccgcatgcgccaaggaggcgaagctttacaatgccttcgtctacatcaacaagctcacagtcaccgccgtcacgaagcagaaacggacgtaatttatccaatacttcctgtacttgctctttcatttcaacctcagtcatgagattcgctcctttcatatacataaaaccattatattcacagtaacggtaaaaatctaatgtttggtttgcaaagctgctttctccattatagcatatttaaacttgaacataaaaaccgttttttatacaaaagctgccccgtcctttgtatactggtgtaaaggggatgatatacatgacaaagccggttacgctcagtgtttacggcgctgaaacgctttgcgcaagctgcgtgaatatgccgagcgccaaagatacgtttgaatggctggaggcggcgctgaaacggaaatacccggagcagccttttaacatgcggtatattgatattgaggcaccgcctcagcaaaaggagacagaagagcttgcggagcgcatcaagaacgatgaatttttctatccgctcgtgctggtggaggatgtcattgtgggggaagggaatccgcatttaaaagatatatatgaagaaatggaaaagcgcggctatgttgcgggctcttaaaaatggccgctgatcgcaatcagcggcttttttcttatcagccgttatgatgcttgtacatccataaaaggcctgattttaataaacggggcacacgcccgatgagcggacggtcgttgacaagaccgaagcccgctttttttccgagtgaaccgaggacgcctttcagcttaaattgcggcattgtttccggcagctcttcattgttccagcgtttcaggaggatctgcacaatttgttccgcctgcgcttcagccagctgggcgctcggcgcatgcggcaggctcgcgcaatcaccgacgacgtaaacatgctcatcgcccggaagattgtgatgcggtgttaaaacgatgcggccttgcgggtctttttcagcatccagttctctgacggctttattcggctgaattcccgccgtccacacgatggcatcggccggtattccttcatcatgattataaacgatgccgtcttccacttttgtaatattcgcattattgataatggtgacgccgtgttcttcaaaccatttctgaacgtacttgctgagtcttttcggaaagcttgataaaatcaggtcgccccggtcaaataacataatcttcagatcgtcacggctctctcttaattcactggcaagctccacgccgcttaatcccgctccgacgatagcgacagatgcattggcgccgaggttgttcagcttttgataggcttcgcgtgactgatcaatggtctgaatgctgtaagtatgttccggcgcgccgggcacgttatgatacttatcctcacagcccagtccgatcaccgcgtcatcgtaagaaatcggttcgcggtcatgaaacagaacctgtttgtttttcgtgtcgatggaagccacctcaccgtattgaacatccagattcggatgctcaggaaaagacaccctgatatgatgatcagaaatcgtgccggctgcgagcgcataatattctgtttttaagcagtgatacgggtttctgtcaatcagcgtgatggatacatctgacggaagctggttcggcagtaagcggtgcagcacccgcatgtttccgtaacccccgccgatcaagaccaattttttcataatgattccccttttgcccgaaaaatatggtagtcaatattgttacaaaataacgaactatgtaaaataacatctagaattatatcgaatttgatctaaaaccacaataatagttttaaaataacctacaaattgaccagaaaacacgcaatagtaaaacctttaacctgaattaatatgttacgataacattgagcgtgagaccgcatctttgacgaatagaggaaattccgttaggataaggtacatatgtgaggtgaaaccgcatgaatccgatgattgaattctgtgtcagcaatttagcgcgcggttcccaggaagcacttgagatcttagagaaggatccgaacttggacgtgcttgagtacggctgtttaagctactgcggaaaatgcatggagtccctgttcgccctggttaacggcgaagtggtcacggggggcacgcctgctgagttggttgacaacatatatacattcatagaagaaaatccgatgttttaatcagaggctccgaacggggtctcttttttattgcgcccgggttttggcaaaataaaaaatttgtagacagcaaaaataaatattgttatcttaataaagactttttttaaataaaattttagaggtggattcattgaatatcgtttgggggctgctcggggcagttgctatattagccattgcttttttgttatcagagaagaaaagcaaaattaacctgcgaaccgtcattgtcggtttatgtttacaaatggccttcggattcatcgtattaaagtgggacgccggccgggccgtatttttatggttctcaagccgtgtgcagcttctcattgattatgcgaacgaaggcatcagctttatttttggcccgctgttaaaagtgggcagcagcccggctttcgcgctgagcgttctgccggtcattatctttttctcagcgctgattgccattttgtatcacttgaaaatcatgcagctcatctttcgcgtcatcggaggcggactgtcaaaacttcttgggacaagcagaacggaatcgcttgcggcggctgcgaatatttttgtcggacagtctgaatcaccgcttgccattaaaccgctgattgcgggattgacccgttccgagctgtttacgattatgacgagcggcctttcggctgtagcgggttcgacgcttttcggttacgccctgttaggcattccgattgaatacctgctggcggccagctttatggcggctcccgccggtctcgtgttcggaaaaatgttaatacctgaaacagaaaaaacgcagacgataaaaggcgattttaatatggacgaagaaggcgccgctaatgtgattgatgcagcggcaaaaggcgcgtccacgggccttcagattgctctgaatgtcggcgccatgctgcttgcgtttgtcgcgctcatcgccgtagtgaacggaattctcggcggaatcggcggctggttcggtttcaaacatattacattagaatccattctcggttacgtgttttcaccgatcgcatttgtaatcggcgttccttggcatgaggcgctcggagcgggaagctatatcggacagaaacttgtgctgaatgagtttgtcgcttattcaaacttcggtccgcatattgcggacttttctaaaaaaacgtctacgattatcagctttgcgctgtgcggatttgccaacttctcttcgattgcgattatgctcggcacactgggcggtttggccccaagccgccgttcggacattgcgcgcctcggattaagagcggttattgcgggaacactcgcaaaccttctcagcgcggcgattgccggcatgtttatttagtaaacgataaaagctccctgcatatgcagggagcttttatgtatgaaaaacgggggatatttgtattgtgtccggggggaagagcttttatactaagtaaaagaaaaaaagttggaggccgatatgaattcattccgttttaccaagatgcacggtcttggaaacagttatatatatgtaaatcaatttgaagaacagctgccggaagaacggctggctgagattgccgttaaagtgtccagcattcacacgggcatcggctctgacggaatgatcctcatctgtccgtcagaaaaagcgccggtcaaaatgcggatttttaataatgacggctcagaagggaaaaattgcggcaacggccttcgctgtgtggcaaagtatgcatacgaacataagctgacagaagaaacgtcctttttcattgagacgctttcaggccttgtgaaagcagatattacggaagaaaacgggattgtgcgtgaagtcgccgtcgatatgggcgaaccgcgcctcaccaaaaaagagctgccgatgctcggcaatgaagatgaacggacgatcgatgaaacctttgtttttggagaaacggagctttccggaacagccgtatcaatgggaaacccccatattgtttttccggttgcggatattaatcaagcgcctcttacaacgctcggtcccgtcattgaaaaagacccgagatttccggaaggcgtcaatgtcgaatttgtggaaaccgtcagcgccgatgaacttcatttccgcgtatgggaacgcggctccggcattacacaggcttgcggaacgggcgcctgtgcggcggctgttgcatccgtattgaacggtgtttccgaacgaaaccgggatatcaccgttcatttagcggggggcgatcttgtgattaattggcaggacaacgggcacgtgctgatgacgggacccgccgaaaccgtatgcagcggcgtctattatttgtaaacagctcgtttgagaaatacgctcctcaaggtttataatagatatcagcatccgtttttaaaaaaggaggtctacctatgagtgttccagtaactattactgaagcagcggctttgcatataaaagatatgatgaaagagcatgaagaagaaaacgcgtttctccgtgtgggcgtaaaaggcggcggctgcagcggcctgtcttacggaatgggatttgagcacgaaaaaggcgaaaaagacagcatgtttgaacagcacggaatcaccgttttggttgacagcgaaagccttgatattatgaccggcacgatcattgacttcaaacagtccatgatgggcggcggtttcaccattgacaacccgaatgccatcgcttcctgcggctgcggatcttctttccgcacggccaaaaacgccggcacgccggaagagtgctaagggtcagcccgccattctcaggatgaaaaaataggacgtctttcttttcgatggcgcttgcaccattgttaaaaaaggcgtttatctgtttaataaaagcaaaacccgctcaacagaagcgggttttgctttttcaaagaggttattcaattgtatgtttcatcgcattgtacatatttgccgtatgttcatcggctttatcccgtgacatgcgcagccgttccgctgaagaaccgtaaccgatttctagtttgccctctttcagtcctttaaaaatcccatcagcgaattcatccagcggttctccttgagtatgcagccctgctccgcctaaatctgtatttaccgccggaggcgcaacttcaatcacttctacagatgaatcagaaagctgatgtctcagactcattgtaaatgaatgaagcgccgctttcgttgctgaatagatcggtgcaatagcaagcggtgtaaaagccaatcccgaagagacgttaatgacagccgcatcttcttttccggcaaaaaacggagcgaacagcatagacaggtggaagggagcttcaatgttcgttgtgatttctttattaaaatagtcccaattgtccttcgcatccgctttcagcacatgaaaacgttgttgaatccccgcgttgtttactaacacattcacttccggataattttctttcacccaatcaaacagtgatacacgttcagatggaatgctcaaatcactgacataggtaataagatccgggaatatttcctttgctttttgaagagcgtgctcacgccgtccggtcacgatgactttatttcccgcttttaaaaaccgttctgcgaaagccaatcctattccggcatttccgcctgtgatcagtattgtatttcccgtcagtttcatattaactcctcttttccgattgtttttacttcaacaaacttacgtctcttgaacagagcttttgatataagcctttgtcattgacgacatttcatccagtactgaccgcttgtgtctcctcatcatgtcaagccggagtttaataggactctctccttcaattacccaatcaatatattgcttaaagcctttgatggtcatgcgggtattttttaaacaaatcacgatttcaaggagcggcatttgatctgctgaaaataaccgccggctggcttcatcacgttaaatcagcggcagcagtccctttttttcataataacgtaacgttgattctgtcatattacactttgctgctgcttcacgaattgaacaacatgtcttcgaaagacctccaacagtattttttccttgtcactgggtgatgatacgacttaaaccatgttttaagtcaataaaaaaaatgtgatgaattcagacatatgtcacaaaaggaaatgggcagattttcaataggtttaggagtgacggccttcacaaaaatcctcaaatcaacggttcaaatcatactatttacaaattcggaaaaaaataaagggtatatagaatcaaaaaatctgaaagatgtgctcttagtcaacacgttctaaagtcatatttttcgaaaggatattgattttttgataggaataaactaaattgtaaaagtatagaatagttaatttattttgtaagaaaaggatgataatatgataggtcaattgagcaataaaaaaatatttttaagttcttttttcatcattttgatctgttcattactcttccaattcagtatttccgataaagttctgcagtcgtattattcttccgtcggagaaagtacctacgatatcggggagaaaagtgttcgtacgattgtcatgtttctgcaagggtttatgatcttcacaacttttgtggaaattctgataggcggatttctattattcgttgccgcttttattctcggtacaaaaaaaccgaaaaaaatatatttgcttctatatacactgacttctttaatctcggcatttaaaatgttgattctttcagttgttaactacttaacggctgattcctcgcttatatattctgccggcggcaccagcttgagtctgcagctgctggatccatttctgctcatatcaattgcggctctttatgctgccgcaggaaaactgaccgatctcagtaaaggcaagagaatcattttgactggatgttttgttttattaaaactctttactattttctttaattattttatggcggataaaatttagctcgggagagagtcaattaagctgaattttattataaattaaaaaaacagagtagggagatgttatgatgaacttagtaaaatctaataaaaagtctttcattttgtttggcgcggctcttgctgcagcaacattggtttatgcactattattaacgggaactgaattaaacgtggcggcggctcatgcattctcagccaatgctgaattagcttcgactctgggcatctctacagcagcagctaaaaaagcaattgatattattgatgcggcatcaacaattgcttctatcatttctctcatcggtatcgttacaggcgcaggcgcgatttcttatgcaatcgttgcaacagcaaaaacaatgattaagaaatacggcaaaaaatacgcagctgcttggtaaaatcgaccaataaataattgctctttttgtacaagctgcaaaaagagcctctctcccaaatacatatgtaaggattgaaagtatgatagtcaaacaaattgcggctcttatcaaatataataccctgtcatcgtttcgaaaaagaaaggaagattggggcattcctcaactcaacagcaaactgctgtctgccattattatttctctgttatgtttatatctcgttttcctgggatgcggtgttgtattcgggacaaaactgattcagctgcccctcagcgcatgggggcaatttgttttaatcgccgtttcacttgagcagcttttttgggctgccggcttctttaaagaacatcacaatgcctttctgctggatacgcgcaaggtcattcatcaattaaaaaaggtgcgttttttacagctgttttctgtttttgccggccaggcgatcaaaaaaaccattttcgtatggtatctttttgtttttccggtctttttgtttttatcaagcgcaggcatgaccgggtctgcggcgatcatcgtatttttcttgggcttcgtttattttcttctcaatttatttttatctatgctgttttcttatgttgtttatcttcttacaaatatatggagcaaattgttttacttgaaaatcctgaaaggcattttattcagcgtcagcctgctggttccgcttgcagtcgggtatgccgtttatcttctcgtgtttggggagtataccgcaaaggatatttcaagctttacggagtcaccggctttccggaacatcctcatgaatacgccgtatgtatggttagcattccgctcacattccgtgctcgttttcgctgcggtgtttgcggccgccgtccttttaacggcggggatgtttaaactgtggtcggccacgctgaagaaaatggaccttattccttatatgtttttgacaaacgctgattttgcgccaaagctgaaattatatagaaataacaaaatatttcatgccgtttttcaaaaggatctgctgtttttatcgagaattgacgggttttttatcaggaacttcggcagtatgctgtatttgttcatgctgtttttaggtttttgtattccgcttctatcgcatcactttatcgggtattcggcagccgccatcgtgtctgcggcggttatcattgcgaacttttcgtatcagctcgtcggagatgcgctcaaaacagtattatcagttgacggggaaataaaaaatcagcatctgtttcaccggaatatcaaacatgcgtggcagctggtgtttccgaaagtatgtatttataatctcgccgctcttatctattcgttcatcatcaccattttgattacggtgttttttccgtcttccgcggcgctgacgatttacctgtttattgtgtttttatgttcgggttttttatacagtcttgtccagatttcaagcaccgccctgtatcctaagaaaaactgggagcatctgtacgaaattggagaagcggggaaagcaaagacgtataacaacttatacagttctttcattttcattgtgtcgcttcaaatcgctgcgatcacgtcgtattttatctataaaaagccggaacttgaaacgatgcttattcattctgcatcaggtatttttgtcctgttcacactattaaactatggagtcatgtttctgtttcttcgcagaatcaatatggcggaaaggtttgcgaacaatgattaaattagtgaatatacaaaaaaactatagtgaaaaacaggtattgaaagatatttcgtttgaggtgaaaaaaggctcaatctatgctttgctggggactaatggagtcgggaaaacaacgactttgaaaatcatttcgggcctgcttaaaccgacttcaggccgcgtcatgattgacggcaaggaaatggattcagaagagggggggcaaatatcggctgatatcggttttgtgcccgaccatgcctttttgtatgattatttaacgggagtcgaatacttgcgctttacagcggagatgtttcaagttccgtctcagcggacaaatgattatataaagaatatgttggagacgctgaagctttctcaagacggaaatcagctgattaaaacttattcacatggaatgaaacaaaaattatcaattgcggcagcgctcattcatcagccaaagatattaattcttgatgagccgctgacgggcattgatttaatcagcggtaaaacgatacggacgttattaaaggagtacgtcaagcagggaaatacagtcctgttatcgactcacctgctggagctggcgcattcgctgtgcgatacgatcggtattatacatgaaggcgtttttgcggcggagtatcagtcatccgagcattcattagaagagattgaagaattggctgagcgtatctatacatgatgaaccgcatgttgccggcaatcagaacgtccgccattccgttaaccgcgtcagtgctgtttttttcaggcggtgtgatcgctgcgttttttttcgatcactttgtttcatcagcgtcttacaacggctcgtcaggcgcggttgaactgctgaaaaacaatgcaatcgcttgtctgtttttagccgcgggtttttttacctttgggttgacctcaatcttttatttattcaccaacgggtttattttaagcggctctattatagaaaatctgcatagcggggttcctttttatcagatttttttactgctaattcctcatggtatatttgaagttcctgcgttattattaagtggcgccattggttttaagggcgttgaattggtcatcaggctgtgtttttctaaggaaaaaaagataatggcttcaatgttcaggcatattggaatattggtgctgcttattatttgtctgctgatcgccgctgccgttattgaagcttacatcacaccaatttttaagtaaaaggggcagaaatcatatgagaagtaaattatcattaatcggtgtgccgattgttatgattatcggttatatcatttctttatcctttgagtggctgtttcctgttcttacttttggggtggcaggactatatctctttatatttgctccggtgcaaaataaattcattcgttacatctttttgtttatttttgtgattaatctgttagccagtgccgctctttatttcggtatttaataaaaaaatgacattcaatatgaatgtcatttttttttatcttcgagcggctctgctgcgtgttaaaatctgtcgccgttgaaaatagagttttttacgattacatagtcgacattacggatggcttcgagtgtattgccgccggcgtaagagatggaagattgcagatcctgctccatttcaaccagcgtgtcccgcaaagaccctttatgttcgacatgcatttttttgccctcgacgtttttcttttcgcctttttgaaattcagaagcggagccgaaatattctttgtacagctttccgtcgatttcaatcgtttgtcccggtgattcttcgtggccggcgaataatgatccgatcatgaccatagacgcgccgaatcggatggacttcgcgatatcgccgtgcgtgcggatgccgccgtcagcaatgatcggtttgctcgccgcttttgcgcaccagcgaagcgcggctaattgccacccgccggttccgaagccggttttaatttttgtgatgcagactttcccggggccgattcccacttttgtcgcgtcagcgcccgcgcgttccagctctcttacggcttcaggcgtcccgacattccctgcaatgacaaagctttccgggacatgttctttaataaattcaatcatgctgatcacggcattggaatggccgtgcgcgatatcaatggtaatataatccggcaccagctcctgttctttcagctcccggatgaattcatagtcattttccttcacgccgacactgatggaagaaatcagtccgcgcgctttcatatcccggacaaaagccagacgtttttccggctcgaagcggtgcatgatataaaaatacccgttttccgcgagccaggccgcgatgttttcatctataatcgtctgcatgttggccggtacgaccggaagtttaaacgtgtgtccgcccaacgtaactgatgtatcacattcagatcggctttcaacaatgcatttttcaggaatcagctgaatatcttcgtaatcaaatacattttccatatataacacccctaaaagcgaataatataattaaataaaattaaaatgttcgtctttttataatgtactttgttttgtcaggaatgtcaaatgatttcatgctgcctcatatgcggtcagcttgtcatccatttgcagtttggttatcatagtagtattggttgttgtaagacatttgttacgatagatagatttgcagaagaagggaggggccggtatggaacaaaaacagcccgggcacagtccgaaagcccagaaaattcaggaccggattattttaggcacgatttgggtcgtgtcggcgcttgtcattgcgctcgttgtcggaaccgtcatgaattatatttggatgtttaaataaaaaagagtctgtgccggtatgacacagactcttttttatattatttttcaaacatgcttgtagaatgcagtggctggacgcgcgctttcgggtccatgtaagccttcgcgttgttcacggctgtcggagcttcgccgaaaccgctggcgatcagcttgactttgccttcatatgtgcagatatctccggcggcaaagaagccttcaatattcgtttccatcgtgcttttgacgacgatggaatttttctcgatgtcaaggccccagtttttaatcgggccgagagaagaaacaaagccgtagtttacgatcaggtcatcaatttcaatgatttctttacggtcgcctttcacttcttcgagaacgagctgttcgatccggtcttcaccgacaagttcagcgggaacaaacggtgtcagcacgttgactttagaattatgcaggttttcgacactgtgctcatgcgcgcggaatttatcacggcggtggatgatgctgacttctttggcaatcggctcaagcatgagcgcccagtcaacagcggaatcgccgccgcccagaacggcaacgcgtctgcctgcgaattgattgaggtcgtcaatgaagtagtgcaggtttttgccttcatattgttccgctgattccagctcaagctttctcggcttaaatgcgccgtttcccgcggtgataatgaccgtttttgaataatgcgtttctgaattcgtgacaagcttaaacacaccgtccgcctgtttttcaacagattcaacggcctgctctaagcagatggtctgatcgaactttgccatttgctcttttaagttgttcacaagttcctgggcgcggattttcgggaatccggctacatcataaatatatttttcagggtacagcgcgctgagctggccgccaagctgaggcaggctctcgatgattttgacgctcgcctgtctcattcccccgtaaaaagcggtaaacaggccgaccgggccgccgccgatgaccgtaatatcataaacctttgaatcctcttgcataccaaattgcctcctaattgaaaattgttattaattataacatacaatttgaaaggatgacgaggccgaaaaccgcccggccgcttcattcttgaaaaaaattgcggccgccgctaagatggggacaaattccaatctgttttttcctgaatgttttccgattcttccggatagtatggtgatatgcagacatgtgcggttttctaaaaaattttatatttcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaagcatatcggggcaaatgacgccgacattactttggtcaataaacacaattatcattatgaaacgacatggatgcatgaagcgagcgcaggaacgctgcatcatgaccgctgcagatatcaaataaaagatgtaatcaatgaatcacgggtcaaatttgtgcaggataccgtaaaagcgatagatgtgcaaaataaaaaggtgacgctttcacaaggggacatcccttatgattatctcgtcatcgggcttggcgccgtccctgaaacattcgggattaaaggtttaaaagaattcgcttttccgatcgcgaatattaatacgtcgcgccagctgaaagaccatattgagctccaatttgcgacatacaatacggaggccgaaaaacgccctgaccgcttaaccatcgttgtcggcggagcgggctttacgggaattgaatttctcggtgaacttgcgaaccgcaagccggagttatgcagatattatgatatagatgaaagtctcgtccggatcgtctgtgtcgaggccgccccgacggttttgccgggatttgatccggagcttgtcgattacgccgttcaataccttgagagcaaaggcgttgaatttaaaatcggcaccgcggttcaagaatgccgcgcagacggtgtcacagtcggcaagaaagatgaagagccggaagaaatcaaatcgcagaccgttgtctgggccgcgggtgtgcgcggacatccgatcgtggaggaagcgggttttgaaaatatgcgcggccgtgtcaaagtcaaccctgatcttcgggcgccgggacatgatgacgtttttattctcggcgacagctcgctctttatcaatgaagagacggaacggccgtacccgccgactgctcagatcgcgatgcagcaaggagaaacggtcgccaaaaatctgggcggtttgattaaaggaggccagcttgaagagttcaagcctgacattaaaggaacggtcgcctccctcggtgagcataacgccgtcggagtcgtatacggcaggaagctcaaaggaacgccggcgtcctttatgaaaaaggtcattgataaccgctcgctctttatgatcggcgggctgggcctgacgctgaaaaaagggaagtttaaattcttctgaaaacccgcagccgcgggttttctcttcttttaaaaaagagcgctataaaaagcatgtaaaagaaaaaaatgaatgtttccgcttacatgagttgttatgttacatattctgacttgttgcttgacaagtaaatatgatatattatcagaaaattaagaaaaaagggtgatccgcatgaaaacgacagcaaaaagcacggcggcgtgtccgttctgctcaggtaaagggtattttcaattgcttcttggcggctccgaaacatgtccctcctgccagggaagcggcaaagagagacgctgatttttccagacgttgacttttttaccgcccccgaggtacactgaaagtgctgtagggggtggatgtttgtgattagtttgccggttgtcctgatctcaatcgtactattttttgtactgtttttcggcataggctttctgttgaacatgctgcttagaatgtcgtggattatggctgttgtctatccgattgtatgccttttcattatcagcaataaaaagatgatcagttacgtgcaggcgccgggggaatcctttcaaagcctgtttcagcgcatcatgtcattagcggttgcggatgtcgtgattttggcgggcggactggcgggagccatcatgtcaggcattgccataaaggcgctcagaaaaagaggatatcaaatgttttaagccgctttcttattcaagaaagctttttttgtgtcgcggcgcttttgtatagcacctcaccgagttgggaacaatgactcggaggagagtgatttcagattgacgataatcagacgcgtattcatgatcgtgctctttttgggcgcatgccatgcgacatacttttccataaccggtgttgaagcaaaggatctgacaaattggatgacggaacatcgcggcgccgttttgaaaaacatcggcactccgtttcaatccttacagaatcagccggaaaagaaggcatcaggcagggtaaagccgctggaagaagcttttgactgggaacgctatccgtcacaaaaggtgacggccaccggttataccgccggagcggaatctaccggaaaatctccgggtcatccgcagtacggaattacatattcaggtgtgaaggtcaaacgcgatttatattcaactgttgcggccgatccgtctgttttcccgatcgggacgattctgtttataccgaattacggttacggggttgtcgccgataccggctcaaaaattaaaggcagccgccttgacctctactttgacaccgtcaaggacgtctataacaattggggcaaaaaaacacttgaggtctacattattaaaaaagggaacggcacagtgaccgaggacgaacttgtaaagctgaacgaaacaaagtcgctgcaagtgttcagaaatcaatacaaaacggtaaaagaataaaaacgcttcagcatccgctgaagcgtttttacataaagaaataatctaaaatcaatgtcagcacaataccggtgacgccgccgaagaacacttcaatcggctgatggccgagcagttctttcagtttcttctgtttttctttctcttccgctttctgaaagtccttcgcttcgctgacaaaccgattaaagtcgatgaccagtttattaatgactgtcgcctgttcacccgcatgccgcctgacacctgtagcatcgaacatcgtaatgacggcgaaaatcgcggcgactgcaaacaggggcgagtccagtccctgttccaaagcgattccggttgacagcgcggtgacggcggcggaatgggagctcggcatgccgccggtgctcgtcacaagagaccagtcaagttttttggatacgataaattgaataggcacttttacaacttgggcaaaaataatggcggcaaaactcgccagtaaaggaaaattcataagtacatccatatgcgacatcctttctgtatctgctgattccgatcgtatcgaaaaactgcagaaaacgcccttagtttggtaaaataaaatcaatgaaaaatgttttttcattataccactttacataacaaatacccacataaggagtgtgtactcatgttttatgcatctgatcaactgcggcatcccgaaacactggtcatcggtctttttcaaaaaagcacgctgaacggatttacgaaggaattggatgataaattggacggtcatctgacccagctgttaaaggatggtgatgtgtccgccaaacgcaatcgtgtatcaaaagtataccctccggctgcgaccggtatgaaacgtatttattttatcggcctgggaagagaagcggattattcgtttgaagatacgaaagaatgctttgcacgagtatttcagcagattcatcaagataaaaaacaggaagtatccgtgttgctcgatacattcgtctccggggaagtgcctgccgccgatgccgctcatgcgctttcggaaagctgtctgcttgcggtttatgaggtgcaggattataaacataaatcgaatgagccggatcaggaactgaaatcagtctgcgccgtgaccgaagaagacctgagggaagtgcaggccggcctgaacgtcggcgcggcatacggccaagggacgaattcagcccgcacgcttgtgaatatgccgggtaatatgctgacggccactgatttggcgtcatatgccgctgagcttgcggcaaaatacgacttcgagtgtgaaattttagaaaaagatgaaatggaagagctcggcatgggcgggctgcttgccgttaacaaaggctcatccgaaccgccgaaaatgatcgttctgaagtatcagggcaaagatcagtgggaagacgtcatcggcctggtcggtaaaggaattacctttgatacgggcggatattcaattaagccgaaaaccggcatcgtcggcatgaaaagcgatatgggaggggccgcctcggtattgggcgcaatggaaattatcggcgaactccggcctgaacaaaacgtgctcgccgtcataccgtctaccgacaacatgatttcgtccgatgctatgaagccggatgacgtcatcgtttcgctcagcggaaaaaccattgagatcctgaacaccgatgcggaagggcgtctcgtgcttgccgacggcatcacatacgccaagcagcacggagcctctgtccttgtagacgtcgcaacgttaacgggcggtgtcattgtcgccttaggtaacgaaatgacgggcgccatgaccaatcacgccgcgttttatgaacaggtggcggaatcggcgaaagaatccggcgagccgatctggcagcttccgattacagaaaaggataaaaaacgggtgagaaacagtcagatggctgatttgaacaattctccgggaagagaaggccacgcgattatggcgggggcattccttggtgaattcgcggaaaacacgccgtgggttcatctcgatattgcgggaaccgcgacggcgaataaagcgacatgcttcggccctgccggcgcaacaggcgtcatggcaaggacgttggctgttttgactgagcggtttacgcccgaaagataacagcatcccgctgccttgatgcagcgggttttttgatttccaaaatctttagttgactaaagcgcagaatgtatgttaactttaattatctactacattagcaaactaaaggatttttggagggactcatcaatgaatgctgttgttgtcgcagtattgcttatgctcgtcttaagcctgctgcgtgtcaatattattatagctttaatgatcggcgcgcttgccggcgggctgaccggcggcttaggcctcggagagacggtgaaggcttttacggacggtctcggcggaaatgccaccgtcgcggtcagctacgcgctgctcggagcatttgccgcggcgctgacgaagacggggcttcccgatgcaatggtggaagcgtctgtcaaactaatcggaaaaaaggaagattcgcggaaaaaagcactgtcaaaagtgttaatcgtactggttattttaatcatatcctgtttctcgcaaaacgtggtgcccgttcacattgcgtttattccggtattgattccgccgcttttaaaaatatttaacgaacttgaaatagaccgcaggctgatcgcgtgtgtgatgacattcggactgactgcgccgtatatcgttctgcctgtcggattcggacagattttccaggggatgctgagagataatatggcgtccgccggtttaaaggtgccgctcagtgatattccgtatgctttaatcatcccgacggccgggatggtagtcggtttaattttatccgtcatcgtcttccggaaaccgaagaaatatgagacgaaggagattgccggactgtcgtcttctccttatacgaaaaaaagcattgccatcgccctgatctccattgccgtgtcgcttgccgttcagctctatctgtcacaagtgctcggagtggaaggtatgatcatgggcgcgcttgccggcttgtttacgctgtttatcagcggagtcatgaagcgcaatgaagcggataagctgatcacggacggcatgattctgatggcttttatcgggtttgtcatgcttgttgcggccggtttttcaaatgtattgaacaaaacgggcgatgtggcttccttggtcaaagcatcaacaggctttatcggtcacagtcaatcattaggcgcgctcctgatgctggtggtcggtttattaatcacgatgggaatcggatcatcatttgcaaccgtacccgtcattacgaccatatttgtcccgctgtgcgctcagctcggattcagcccgatggcgacgatcgccgtaatcggagcggccgccgcggtcggtgatgcgggttctcctgcaagtgacagtacgctcgggccgacgtcaggcctcagcgccgacggacagcaccaccacatttgggatacgtgcgtaccgacatttattttctataacattccgcttgtgatattcggctggattgccgcacttgttctgtaaaaaaaggctcccggaaaggggagcctttttgtatgctgagaacatcttacgccggatttctgctgaaccccgtcgctttatgaatagacctgtatacggcaggcgcgatagatgccaataacagtgctaaaatgatatcttttatgaaaaaccatatcatgtaaaaccaggccattccgtagctgatcggagcatgaagccataatttcagcgcaatatacgtataggtcgtgccaatgatataaatgacggcggtaccgatcaaagaggcccatgcataatgcaggcggccgggtttttttgttttttccagcagccatccggctgcaaatgccgccgggatgtaagcgagaataaacccgccgctctttccgataaacggcgcaaagcctgctgagaattgagcgaaaacaggcgccccagcgagtccggccaatgcgtataccgtcatggcaatggctgcccgtctggcgccgagaagcatcgcggctaacagacaaaagaaaggctgcagcgataacggaattcccgcaacttgcaaaaaaggagccattgatgtaatgttggcgccgacggccatcagggcggcaaacatgccgataagcgccatatcgcccgcgcgaaggttgcgttgtttcatttgtttttcccccttacacttgtaccagattagcgtaatcgaagggtgattgattgtcaacaaagatttaataaaggtttactaaatggagggagccatatgtttttcgggaaaacgaagcaaacaaaacagtcggaacggattccgccaaatcaaaatgtcacaacgaagtttcccgtgcttcacgccggaaatgttccttattatgaagatatgtcaaaatggaatctgcaagtgtacgggcttgttgaccgtcctatgctgttaagctttaaagatatcaaagcctttccggaagccgaagtgaaaaatgatattcattgcgtcacgggctggtcccgtcttgataatatctggcagggaatacgcgccaaagacatcgctgagaaagcgggtgtgcacaaagaagcgggattcgtcattctgcacgctgaagagggctggacggccaacctgccgctttctgattttacgcgggaaacatccctgctggcatatgcgcataacggcgagccgttaacgccagagcacggctatccgctcagaggcgttttcccccatctttatttctggaaaagcgcaaaatggctgcgcggcattcagtttacaaaggaaaaccaccccggcttttgggagaaaaacggctaccatatgaggggagatccatggaagaatgagcgctttacatgggattaagcccctatccctatatagttcttaggtaccttattaaaataaggtgctttttttatatcaaaaatccattgactttgtttggcaaaaaacctattatttgaggtgtcttttgatattgaaaatcattatcaataaggatagataaagcaattgccacaaaggggatgaacacataatggacggaaaacaaataaaccgggggttcgcgccggccggccgatacgcagttccgggcacagaagtaaaagaaatgcgctcaaaaggaggccgtacgtatcgtatctttgtctcttttcctcaggaagaaccgcctgcctccggcttccccgtcatctacctgcttgatgcaaattccgtgttcggcacaatggccgaagctttgcgggtgcaaagccggcggcctgaaaaaacaggcgttgttccggcggtgattgtcggaatcggctacccgacagatcagccgttttccgccgaacggcacagtgattttacgatgccgctttctgaatcagaactgccggtgcatccgcgcggcgcggcatggcccgaacagggaggggcggaagcgtttctggagtttatagaagaagaagtaaagcccgcgatggagcgggattatccgatcgacagaggcaggcagacgattttcggccattcgctgggcggtctttttgtgctgcaagtgcttttgacgaggccggacatgttccagacctatgttgcgggaagtccgtcaattcattggaacaagcgttttattcaggaaaacgcagaacgtttgtcagaccggctctctgcggaaaatcttcaagtcagtgtattgctggctgcgggagaaattgaaaaaacacataaaagcagaatcccgcagcacgcagaggcgctgtactctttattatccggatttgaagatgatggagtccgtgctaaatacagcgagtttgaaggagagggccatatttctgtcctgcccgttttaatcagcagagccctgcgtttctgcctgaatccgggagggccgcataccccgtattctcccgcatgagaaaaaacaggcccttcgaactaaatgcggctgattctaattttctaattgactgcgtgttttgatttggatatgattgtcttgaatcataattgataatgataatcattatcaatatagaaagggaatgataatatggacgcattgggaatgaaagggaaaacggccgttgtcaccggcgccgctcaaggcatcggagaagcaacagcgcttgcccttgctgaacaaggcgtaaatgtggcagctatagatacaaatgaagacctgcttcccgggctaactgacagactgcggcaaaaaggcgtgcaggcgcaggggtttgccgcagatgtatctgacagtgcggctgtcaatgatatcatcgctgccgttgaacgtgacatggggcctattgaaatattggcgaacgttgcgggcgtgctgcggccgggtccggtgcaatccctcagtgatgaagattgggatcaaacattttctgttaatacgaccggcgtatttcatgtatcgcgggctgtcagccggtacatgattgagcggcaaaaaggcgccatcgtaacggtcggttcgaatgcagccggcgttccgcgtgcttccatggcggcttatgcggcgtcaaaagcggctgccgccatgtttacgaaatgcctcggactggagcttgcggcctatcatatccgctgcaacatcgtatctcccggttcaacggaaaccgacatgcagcgggcgctgtggcgggatgaaaacggagcacaggacgttatcagaggttcgcttgatacatataaaacgggaattccgcttcaaaagctggcaaagccttctgatattgcaaatgccgttttgtttctggcctctgaacaggcaagccatatcacgatgcatgatttatgcgttgatggcggcgctactttaggcgtttgatgtaacgaaaaggagggacaaacatgacaaatcaacctgtattgacggaagtggctgcaaaaaaggtgctggatacttacaagcccggggcgttctttttagcttccccgaaaaggacgatgctcgcggaaggtttgtttgcaaaagtgccggatgcagacgcggagaatcagctggattcactgcctgaacgtgtgagacagacgcttcttgaggcaaagcaagccggcatcaaacatccgattgcggccggcgccattccttttgacggaagaaaagcttcccggctttttgtaccgaagattgtccatacggcaggcccgctttcgtttgcggaatcttccgcagaaaagccgcaatccaatacatatgacatccgtcccgttccggagcctgagggctttatgagcggtgtggaacaaggcgtattcaacattacggacggtccgctcagcaaaatcgtgctgtcaaggacgcttcatctgaccgctgaaaaggatatcgacattcctcaggccgtcaagcatttggcgcagcacaacccgcgcggctatacattcgctgcggatgtgacgggaacgtcagaaacaagaaaaacgcttttcggcgcaagtcctgaactgctgctgtccaaaaacggaacatcgattctgtccaatccgctggcaggttccagacctcgcagcacagatcccgccgaggatcagagaagagcggaagaactgctgcaatcagcaaaagatctgcatgaacatgccgtagtcgtggccgccgtggccgccgccctaaaaccgttctgccgtgtgcttgatgtgccggaaaaaccgtcactcattaaaactgaggcgatgtggcacctgtccaccgaggtaaagggagagcttagtgatccgtcaacgacatcgcttgagctggccattgctcttcatccgacgcccgctgtatgcggaacgccgacggatgcggcgagagaagcgattcaggatatagagccgtttgaccgcaatttctacacgggaatggcgggctggtgtgatgctgaaggtgacggagaatggattatcgcacttcgctgcgccgaagcggaaacaaggtctctccggctctttgcgggtgccgggattgtcgccggatcaaagccgcaggacgaactggacgagacatcggcgaaattccgcaccatgctccgggcgatggggctttaccaagatgagttgtaaaaaaggaggggacggatcgtgctgactggatttacgccatggccggaagaatgggctgacaaataccgaaaagacggctgctggaagggtgagacgttcggaggaatgctgaaagagcgcgcggctttatacggaaatcaaactgccgtgacgtgtaaagatgtacattggacctataaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatatgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgggttgttctgtcaccgacgccgagtccggatgactgcttcccgttaattgaaaaagaacgtgtcacgattacagcgctcgttccgccgcttgcgatggtgtggatggacgcatccggttcgcgaagtgatgatttatcaagccttcaagtgctgcaggtgggaggggccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgcccccggagaagcgggacatttgtttacacgcggcccttacacgattcgcgggtattataaagcgcctgaacataatgaaagatcattcacagccgacggattttatcagaccggcgatatcgtcaaactgacggcggacggctatatcatcgtcgaaggacgtgcgaaagatcaaatcaatcggggcggcgaaaagattgccgctgaagaggtggaaaatcaccttctggcccatcctgccgttcatgatgcggccatggtttcaatgccggatgattttctcggagagcggtcctgtgtgttcgtcattccgaaaggagaagcgccgaaaccgggagagctgaaagcgtttttacgggagcgcgggctggcggcatataaaattcccgaccgggttgaatttatcgcttctttcccgaaaaccggcgtcggcaaggtcagcaaaaaggaccttcgcgaaacgatcgcccaaaaattgaagcctgctgaaatcaaacaatcttaaaaaaggaagtgtttacattggctataccgtcaattcccgcatatgcgctgccgacagcgtcagatatgcctgaaaataaagtatcgtggacgctgaacccgaaacgcgcggtgcttctgatccatgacatgcagaattatttcgtcgatgcttttgagaaagggaaggctccgatcacggaggcggctcagaatatcaagaaaataaaagagcaatgcaaagcgctcggcattccggtggtgtacaccgcgcagccgggcagccaagacccggcggaccgcgcgctgctgacggatttttggggaccggggctgaaaagcgggccttatgaagaaaaggtcattccggagcttgccccggatgatcaggacattgtcctcacaaagtggagatacagcgcgtttaaacggacgaatctccttgacatcatgcgtgaaagcggcagagaccagctcatgattacgggaatttatgcacacatcggctgtctcgtcacagcctgtgaagcatttatggatgatatccaaagcttctttatcggagacgccgttgctgatttttcttcagaaaaacataagatggccatcgaatatgcgtctcagcgctgcgcttacacggctttgacaaacgaagtgctggagctgctgggcggcgcgccggtttctgaaggagaagggaagacttccgccgtattgacaaaagaccgggtgcgggaacaaattgcggcgattcttcaagaatcaccgtctgatattccggatcatgaagacctgctggacagaggccttgattccgtcagaatcatgagccttgtcgaacaatggcgccgtgacggagctgaagtgacgtttgttgaactggcggagaacccgacgcttgaagagtggtggagacttctttcttcccgatctcaaaaagtcttgccgaacgcagattatttataaagggagagaatagaatgcatgatacacaacagctgcctctgacaggcgcacaggccggtatctggtttgcgcagcagcttgatcctgataatgcgatttacaatacaggcgagtatgttgagataaacggcgcgatcgatgtgaacatatttaaaacagctctcgaacgtgtgctgacggaagccgtgtcattacacgcccgcttcgaagagggagcagacgggccgaagcagatcatcaatcctccatttgaagctgcgatcgatgtcatagatgtgagttcagaagctgatccgaagcaggccgcactcagactcatgcagacagatttggctgagcccgttgatatggcggccgggcctttgttccgcgacattttatttcaggcgggaccggaacgctttttctggtatcagcgcattcaccacattgcgatagacggctacggtttttcactgctggcacggcgtacggcgcaaatatacaccgcaatacgggaaggacgtccggataacgggcgctccttcggctctttggaggaactggtaaaagaagatcaagaataccgcgcgtctgatcaattcctgaaagatcgggaattttggatggagaaatttgcggatgaacctgatgtcgtcagtttggcagaaagagcgccgagaacgtcaacaagctttcggagaagcacggcttatctttctgaaacggctttgcagcatgtaaaagcgattccgaactggcatgaagccgtcacagccgcagcggcggtatatgtccaccggatgacaaacgcaggggatatcgtgctcggtttaccgatgatgggacggatcggctcgatttcactgaatattccgagtatggtcatgaatcttctgcctttgcggctttctctccgtccggatatgaattttcatgaggccgtcagccaagtggcaaaagaaatccgaaacatccggcgccatcagaaataccgccatgaagacatgcgccgcgatcttaaattgctcggagaaaaccgcaggctgttcggcccgcaagtcaatgtgatgccgtttgactacgcgcttgatttcgccggagcgccaggcaccgtccataacttatcagccgggcccgttgatgatttgtcaattaacgtttacgacagagcggacggaagcggaatgcgtgtggactttgatgcgaatccggaagtgtacagcgccgaagatattgaaaaccatcaaaaacgattcctgcttctgctggaatccgctgtgaaagaccagacacaaaaaatcggcacactcaaccttctgcctgaaagtgaacgtctctgcgtactggaaagctggaatgacacgcgcaaggccgagaagcagaaaagtatgccggagctgttttacgaacaggccgtaaaaacaccggaccggccggcaatcatcaccgaaaacgaagagctcagctatgccgaattgaacaagcgcgcgaaccagcttgccggcatgctaaaggaaaaggggctcggaccggaacaatttgccgctttgctgcttccgcggtcacaggagttggccgtgagcatgctggccgttttgaaaacgggagccgcatacctgccgcttgatcctgattttccttctgagcggatcacatacatgctcaaagatgcacaccctgcatgcctgattacaacgatggaattatccggccgcatgccggaagacagtgatgcaaaaaggatcattctcgatgacccggatacggtaaaaaccgttgccgctcaaaatgctgactgtcccgctcaggctgaatgttcgcctttgcaccccgcttatatcatatatacatcgggttcaacgggcaaaccgaaaggcgtagtcgtgacattaaaaagcgtaagcaatttcctcttatccatgcgggaaatgttcccgctcggcgcacaagaccgtctgcttgccgttacgactgcggcgtttgatatttccggacttgagctcttccttccgctcatcagcggggcggggtgcgtcatcgcacgtaaagagacgattcaggaaccgcgggcgcttgcgaacatgattcactcatacggtatttcaatcatgcaggcaacgccgacattgtggcattcattagtcaccaatgaacctgattccctccgggcgctgcaggtgcttgtcggaggtgaggcgcttccgaacgcgcttatgcatgctctgcttgaatcaggctgtacggtgacgaatctgtacgggccgactgaaacaacaatctggtcggccgcacagccgcttgcaaaagaccatacaggggcgcctccgatcggaaagccgatttggaacacgcgggtatacgtgctggacgccgcattgcagccagtcccgccgggaattgcgggcgagctttatatagcgggcgaggggcttgccagaggttattataaccgtcctgatttaacagctgaaagattcattgccgatccgtacgggcccgcgggcgcgaggatgtaccggacgggagatctcgtgcgctggcgtgaggacggctcgcttgattatatcagcagagccgatcaccaaattaaaatccgcgggttccggatagaattaggagaaattgagtcagtgctgtcgaaatacccgggtatttcgcaggccgctgttattgtccgtgaagaccagccgggagataagcgcctggcggcttatactgtcgcggatcagccccttgatatcggcggacttcgtgaatatatgggcgaaagcctgccggattatatggtgccgggcgcgtttgtacagctgaaagaattgccgctgacgccgaataagaagctcgatcgcagcgctctgcctgcacctgatttttcagctgtcctgtctgacagagggccgcggacgccgcaggaagaaatattatgcgatctgtttgccgaggttctcggtctcgcgcgggtcggaattgatgacgggttctttgaattgggcggacattcgctcttagccggacgcctgatgagccggatccgggagacgatgggcgcagagcttggcatcggacgtctgtttgataccccgaccgttgccgggctcgccgcacagcttgacaccgcaaagagtgcgcggcctaagctcaagccgtttgaccggccggagcacatcccgctgtcatttgcgcagctgcgtctttggtttctctactgtcttgaagggccgagcccgacttacaacattccggtgattgtccgcatgtcaggcaagcttgaccaatcagcgctgaaacacgccttttacgatgttgtcagccgtcatgaaagcctgcgcaccgtttttccggaaaataagggatcatctcatcagcttattttacctgctgaagaagcccgccctgtgtttacagtgacacgtgcagacaaaaacgagctccaagacatgcttgccgctgcggcaagatatcggtttgatctcgctaaagagccggccgtccgggctgagctgtttgatcttggtgacggcgaatatacgctgatggttctcctgcatcacatcgcaggcgacggctggtccttgaatccgctcatgcgtgacttatccatagcctatatcgcccggcaaacaggtgaaaaagcagaatgggcgccgctggcggttcaatatgcggattatgcgctttggcagcagcagcttttaggcagcgcgtctgattctgagagcttaattgcgcgccagctggatttctggaagaaaacgcttgaaaatgtaccggatcagctggagctgccgtctgattttccgcgtcccgctgaatcaagctacaggggcggcgtcattccggtcaacatcggccaagagcttcatgcccgtcttctctcacttgccagaaatcagcgcgtaagcctgtttatggtgcttcaatcagggctttccgcactgctgacccggctcggggcgggaaccgatattccgatcggcagtccgatagccggccgcagtgatgacgcattaggagaccttgtgggtatgttcattaatacactcgtactgagaaccgatacctctggcgatccgagcttttgtgagcttcttgaaagggtcagggaaatgaatctcgcagcatatgaacatcaggacgtgccgtttgaacgtctcgtggaagaattgaatccggttcgctcccggtcaagacatccgctgttccaagtgatgctcgcattccaaaatacgcctgaccctgtactcagtcttcctgatatggaaacaagcctgcaaatcagcagtgtcggatcgtccaaatttgatttgacattggaattggctgaacagcgccatgatgacggcacgcctgccggtattgaaggcctgctggagttcagtacggacttattcagaaaagaaacggctgaagcacttgcgggacgcctgcttcttctgctcgaagatgccgtatcacatccggataaaccgatcggaagcttaaccattcttactgatgaagagcgccggaagcttttgccggttaaacgggcaaaacagcatattcagcctcggcagacactgcctgaactgtttgaaatacaggccgccgcaaaatcggatgaaacggcggcagtatttgaagagagcggactcacttatcaagagctgaatgaaagatccaatcagctcgcgcacatgatgattgcccgcggcgtcggcccggagcagtttgtcgcactggcgctgccgcgttctttagatatgattgtcgggctgttagccgtcctgaagacgggggcagcgtatttgccgcttgatcctgattatcccgcggaccgcatcgcctttatgttacatgatgccaagcctgtatttatgctcaccaaccgtgaaggcgcaagtaagctctctggcgaaaacggcatgccggccttcatcctggatgatccgcagaataaggaaacacttcggcaatatgccgtcacgaatcctgaaaatgccgaccggattcgtccgctgagaccgcttcacccggcctatgtcatttacacgtcgggatcaacaggtgtgccgaaaggtgtcatcattccgcacagcaatgttatccggctgtttgagtccacgcggcattggtatcagtttaattctgatgatgtatggacgatgtttcactcctacgcttttgatttctctgtctgggaaatatgggggccgctgcttcacggcggacgtctcgtcgtcgtgccgcatgacatcagcagatccccggaagcgtttctgcatctcctcgtgaaagagcgagtgaccgtacttaaccaaacgccgtcagcgttttaccagctgatgcatgcggaaaaagaacacaaagagctggggcatcagctcgcactcagatatatcatcttcggcggcgaggcgcttgagctgagccggcttgaggattggtacagccgccacgcggacaatcagccggtgctcgtgaatatgtacggcattacggaaacgacggtgcacgtcagttaccttgaattagacaaaaacattgccgaactgagagcaaacagcctcatcggctgcggcattcctgatctgaacgtatatgtgcttgatgaccggctggagcctgtgcctccggggatcacgggcgaaatgtatgttgccggagggggcgtggcacgaggctacttagggcggcaaagcctgaccgccgaacgctttgtggctgatccgtacggcccgccgggaacgagaatgtaccggacgggggatttagcccgcctgcggacggacggttctcttgattatatgggcagggcggaccaccagattaaaatccgcggcttccggattgaattgggggaaatcgaagcggttctcgtcaaacatccggatgtcgaggatgccgccgcagtcgtccgtgaagaccggccgggagataaacggctggctgtctaccttgtccgatctgccggcagcaccttggacacgggggacatgcgccggtttgccgaagaaagcctgccggattacatgattccgtcagcttttgtccaaatgaatgaactgccgctgacaccgaatggaaagcttgaccgaaaagcgctccctgcgcctgacttccaaacggaggtcaccggccggggaccgagaacgccgcaggaagaaatgctgtgtgagctgttcgcagaggtgcttcatctgccgcgtgtcggtattgatgacagattttttgatttaggcggccattctttgcttgcggttcatttaatgagccgtattcgggaagcgatgggagccgagctcaatatcggaacactatttgaagctcctacagtggcaagtcttgctgaaagacttgagtcaggaacgggcacaagcgcgcttgatgttcttcttccgctcagaacggcaggagaagaaacaccgttgttctgtgtccatccggccggcggtctcagctggtgttatgccgggctgatgtcttctttagaagctgattatccgatatacggcttacaggcgagaggcatcggaaaaaaagaaccgcttccgcaaagcttagatgacatggcggctgattatattgaaaaaatccgcaccgtgcagccgaaagggccgtaccgtctgctcggctggtctctcggagggaatgtcattcaggccatggcgacacaattacagagccggggcgaagaggtttcgcttttggtgatgcttgacgcgtatccgaatcattttctgccgataaaaaatgcgcctgatgacgaggaagcggtcattgcgctgcttgctctgggagggtacgacccggacagcctcggggatcagccgcttgattttgacaccgcgctgaccattctccgccgtgaggggagcgcattagccagcctggacgagtcagtgatgatgaatctgaaagacacgtacgtaaattctgtcgggctgttaggaacatacaagccgaagccgttccacggagatgtgctgttcttcagatccacgattattccggagtggtttgacccgatcgagccggatacttggaaaccgtatattacgggggaaatcgagcggtatgacttagactgccgccataaagatatgtgccagccgggcccgcttgccgacatcggcgcgattctggcagagaaattaaacggacggcgtacagtccggtaaagaaaggaaagagatgatatgacaaatccatttgaacgggaagacggttcataccatgtgctcgtcaatgctgaaggccagtactcactgtggccggcctatctggatgtgccggacggctgggaaacccgcctgacgaatgaaacccgccccgtttgtctcgaatatattgaaacaaactggcgtgatatgaggccggaaagcctgaagcggaccgaagctgctaaaatgtaataagaaaagcctgccgttatttcggcaggctttttatgcggacatcagccgttaagctgtgtatgatcacaaaatgtataagggtggccttcttcatccgtgcaccatgactgagacagaaaagccaaaaagaccgcggcccactggtctgcaaactggattaaaataccgccgtcgtgccacgttccgttatccttcttccagcgtgtatcaattgggtttccctgattcatatgaatattatgcatgccgtttgtcggcttgaacccgaaaatcttatcagcgcccggctccggcccgaatttagagccgtaaatatagacggtggctttttctgatttggctttttgcatgtacgtctcaataaagtcatttaagtcattatccggcccggtgacttcatgcggaaggggcaccatgttccggggatcaaacaatccgccgcggacataatccagcgccagctcacgtctggtttcatcaattggggtatatccgtacggaatgttcggcagcagggtgatcgcgcttgcgtcaaaatgatcgcgtgccgcatacagcacctctgattcttttgaacttgacatgacattgatcgcacagcgatagcgcgtatcaggctcgcctagcacctcgacttgaaaatgcggagaatcatcatctgtttcccttttcatatctaacacagcgccttttagtacaccatagtgctgaacagccatatgaatcctcctttttcttccgggatatgaattgatattcgagacagggggccgtttttccttttgtgagaaagaaaaaaggacagcccgctgatcaggctgtcctcttcatctctattaagcttttgcagccgaaccttgcattgctttttcagcaggcacgtagtcatagcctaagtctttggctaccgcttcatacgtgacatgtccgttagccgtatttaagcccgctttaagcgcagggctgtctgcaatggcttgtgccgcgcctttattggcgatttgaagcgcgtaaggaacggttacattcgttaatgcgagcgtagacgtacgcggtacggcgcccggcatattggcgacagcgtagtgaacgacgccgtgtttttcgtaagtcggattatcgtgggttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggaatctgcaatatttacagggtttgacatcaatgttttaatctgatgcccgaaaatatcatcaagctgacgcaggcggtctgcgttcaaatcgatcattgtcacatcggcaccgagtccgacagccattttcgcggcatttgttccgacgccgccccctccgatgatcgtgacttttccgcgggatacacccggtacgccggctaataaaattccttttccgccttttggtttttcaagaaactgtgctccgatctgcgcggccattctgccggccacttcggacatcggcgtaagcagcggaagggaacgtccgtccgttaccgtttcgtacgcgatagctgtcacgcctttttctgtaagcgctttagctaattccggctctgcggctaaatgaaggtaagtgaacaagaccagaccttgacggaaatacgcatactcttcagccagcggttcttttaccttcatgaccatttccgcatcccatacttgctttctgtcctccagaatttccgcccctgctgatacataatcttcatttgtaaagccgcttccgagccccgctccggattccacaagaacccgatggccgtttccgataagctgtgaaacgcctccaggtgttaatgccactcgattttcattgtttttgatttcttttggaaccccgataatcatgtctgtttcccccaatgtttgtgtgatgcttcaagtgtagcgcgatttttgcgaaaattctttgtttgaaacagaaaataaaaaaacacggatttgtgaaatttcacgaacccatgctgcgaagtttgatatccaggtaaatcgtaaacttctcattcacattttttaagtcgatttctgcgatctggctgattcttttcagcctgtaattcaatgtattgacatggatgttaagcgctttagcggcggtgttgacattgctgtcggcatcaataaaatgttcgagcgtttttaccatatcggcttggtgctccctgtcatactgctcaagctttgacagggaatagttcatatagccgctgtgcttgcgtttttcatccaacacatcaaggtactgataaatgccgagttcagaaaagctgaaaaggtgtttggtttctctcacaaaccgctctttcgcttttaatacggaaagcgcttcctgataggatcggtaaacgtaagaaatcgattcgtaaataccgccgatcgcaatcgacgcatcctcaattttatatcgttccttcaactgtttttgaatatgaagagcgaagtgctttaaatctttaaaaggctgatcggttttcggcgcggctaataagattaattcatttgaatcaacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatctcggcttcctgataaatatggccggtcagcattttccaaaaaaactcctggccccgctcttcgattttcgttttgcggatctgcaggtgcaaaagcttgttccgcaccgctttggctgccagctgaagtgtcttcagatcttcgtcattgagcttttttttgatctcaagcgcccaaataaatccgagaacctgactgtttttccagatggaaatcgccacgcggttgcttaggcccacctcgtcaatttctttcactttgatcggctggtccgtttttaaaagggccggaatggttccgtctttccacagtttgttgatgactttttccggcaccctccgcccgataatcgtcgacgtccgggcaggatctgtacaatcgctgtgcgtgctgtatgcaagcagtttatgattaacgtcttctattgtaatggggcattgaagaacttcactgatatggtcggcaacatcttcaagcctgtcgaaactgtacttaaatggatcttttggattggtcatctgtatccctactttttcatagcttcatatcttgatcttaccatcttgcttttcagactgaaaggcatctttgcagggaaatagactaggacaataagatcattcagtgaaaacgaaaataataagaaaatcatactattttatttacaaaatgtgtaattatgacgaaaaatccaatatatcataagactcattttgtaaaattaaaacagatttgtttgactgtgccgattggttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggaaggtgcttcaagtgaagcattcgcggatcaatatgagcagctgaaaccttcatttattaaaatgtctgaattgcttcaagatgtgaatcatcagctcgatcaaacggcaaatacgcttgagtctaccgaccaagatatcgctaaccaaattcgcggataataagatgaatgaagaaacggagcgcctgattcaatcaagaagacggcgctctttctatgtaagggtgatatgaatatgtatatcgatattacaatagatttaacacattataacggcagcgtcttcgatctcagattgtcagattaccattctgtgaaaaaagtcattgatattgcccggcaggctcagcatgtatccgttccgccgcgtgaaggctattggatcagagtggtcaataaagaaacggttttttccggagaacaaaagctatctgactgcggcattacgaacggagaccgccttgaaattttatgaaaggacatggtggaatgacaggtcataacagatcttatttagaaacagaattagacgccgtccgggaagaaaccgaaacaggcttcacgttcaccttccagcgggaaaaaatcaagcttcttgacgggctggaagcgaatgtgattaaagatgccgatcctttttttcaaaaagaggtctcagtttcagaagacgaagtaaccatcacaatcaaacctccttcttcttatcaggctttccgctatataaaaggaaaagataaaaaaagcaggtggcaatttgcctaccgtctcgtccaagccgtgaaacagcataagctgaaacgtctcaatctgattgccgcccctgaaaatatcgtgtttgataaagcgctgacgccttactttcttcattacggcgtaaaggagagccttccgccttatgaggaagatagagaaagggtgttaaaagagctcaaagcctgtgcggcgcttgcagctgacggggcgtacaccttcgatgaatatttgaagtacaaggagacgcttcatttctctcctgaggtgaaaagcgtgttagaggcggagacgattgaagaactggaagaagccattcaaaccgcaatcgattccctcgaagaaagggacaagacatacataaaactgccgaaaaagaaatggaaaatccaaagatacgccggtctggcgcttgccgtcctccttgtgccggcacttctttactccttatacgttctgtttttcgtccagccgaagcaagaggcaattacggaaagcaaccgctattttttaaatcagcagtacagcaaagtcattgacacactcgctaaatacgatgcggaaagcctcccggaatctgtgcagtacgagcttgcttcctcttatgtggcagttgaaaatctgagggaagaacagcggaaaaacatcgggaatctggtcacgctgcaatcagacccgaagcacttcctttattggattgatatcggcagaggggaaaatgaagaagccatcaaaatcggccgcaatcttgagtacaacccgtacatctggctcggacttacaaaatataaacagcaattattagcggatgacagtatgaaagacgacgaaaagcagaaagaactggacgccgtggaaagcgagcttgcgaaggcgaaaaaagaggcggaggagcagcataaagaagcggaggaaaacagtgacaccgccgaagcttccgccggacaggatgaaagcaaacaagacaaagcgaaagataacaaagagaacgacaagaaagatgagaaaaaagatgaaaaaaaataacagcacacatcaaatggccgcatgtaacgatcaggctgtcgtcaggaggttcgccatatgagtctgttatgggtcttttaccgagagcacgtacaaaaggttcagctgtctgaactcccgccctctcagccgattacgatcggtccggatatgaaagatacaatcacggtcggcacacttccgttacggcaaaacgccgcaaccctttatcggaaagaaacagatcgttatgatgttttcctgggaaataactgtgccggcgaattgacaataggaaatgaaatgccctgccggattgaagaagagacgctgcggcttctgctcacccctgaccaggaagaatcctccgtgtattttatcggcgggaaggatgagatcgttttctcatcagaaacagaggaagcggatatatacaaagagccgtcctccgctcaaacaggggctttttatctgcgtaagtcgggaggatgctggtctgtcgtccctgatggtcaggaagtttatgtgaacggaaagcttgcagaagctcccgaaaggctccggacgggagatgagctgctgtggaattttctgcgtgtgaggctgacggaggacgaccttttagaaatcgttcatcacgaaaagcttcaaaccggtttaaccaaaacggtaaaaccaagcaccgaaatgaaaaagaaatacccgcaatatcgaagaacgccgcgcatggtctacgatcttcccgaagaccgcgtttcattcagctttccctcgcaggaaagcgaacagaataaccgggggctgtggctcgtcattctgcctcctgtggtcatgctgattgtaatgggggttgtcgctattatacagccgaggggtatattcatccttgtctctttggcgatgtttatgatgactctcattacgtccaccgtgcagtatttccgtgaaaaaaaccagcggaaaaaacgggaggaaaaacgggagcgtgtgtacaagcagtatttagaaagcaaacggaaagagcttcagacgctgtcggaaaaacagctgcacgtgctgacgcatcattttcccccgtttgaaaaaatgaaatatttaacttctgaaatcagcggccgcatttgggagaaatcgctggaaagcagggattttctgatgcttcggctcggaacgggcacggtcccgtcaagctacgagatttcaatgagcggcggagacctggcgaaccgtgatgtggatgacttgatggagcagtcgcagcacatgcagcgtgtgtataaagacatccgccatgcgcccgtgaccgttgatttacaagaagggccgatggggcttgtcgggaaacctcagatcgtcaaaaatgaaattcaccagctgatcggccagctcgcgttcttcaacagctaccatgacctgcgatttgtctttatctttcatgaggacgaatataaggaatgggaatggatgaagtggctgccgcaatttcagctgcctcatatgtatgcgaaaggatttatttacaatgaacagacccgcgatcaattgttatcgtccatttacgagctgctgcgggagcgggatttggaagaggataaagaaaaaaagatctttcagccgcattttgtctttgtcatcacaaatcagcagctgatcgcagagcacgtcattttagaatacatcgaaggccggcatgagcatctcggcatctcggccatcattgccgcggaaacaaaggaaagcctggcagaaaacattcacaccctcgtccgctacattaatgaagatgagggagacattctcattcaacagaaaaaagcggtgcagatcccgtttaagctggacaggcatgaacggacaaacaacgagcggttttcccggacgcttcggacattgcaccatcaggtcggaatgacgaattccattcctgaaacggtctcatttctcgagctgtttcatgcgaaggaagtaaaagaaatcggcatcaggcagaagtgggagacaagtgagtctgcaaaatcgctggctgttccgatcggctataaaggaaaagacgacatcgtctatttaaacctgcatgaaaaagcgcacgggccgcacggattgctggcgggaacgaccggctccgggaaaagtgaatttctgcaaacatatatcctgtcattggccgttcactttcacccgcatgaagcggcgtttttgctgattgactataagggcggaggaatggcgcagccgttccgcaaaatgccgcaccttctcgggaccatcacgaatattgaaggaagcagaaacttcagtatcagggcgcttgcatccattaagagcgagctgaaaaaacggcagcggctgtttgatcaatatcgcgtcaatcacatcaatgactatacaaaactgtataaacagggagaaacggatattccgatgccgcacctgtttttgatttcagatgaattcgccgagctgaaaagcgaagagcctgactttatcagggagcttgtcagcgcggcccgcatcggacggagccttggtgtgcatttaattctcgccacgcaaaagccgggcggcatcattgacgaccaaatatggagcaactcacgctttaaggtcgcgctgaaagtgcaggatgcaagtgacagtaaagaaatcctgaaaaacagtgatgcggcgaatattacggtcaccggacgcggctacttgcaagtcggaaataacgaagtgtatgagcagtttcagtctgcctggagcggcgccccttacatggaagatgtatacggcaccgaggatgacattgccatcgttaccgataccggcttaattccgctgtctgaggtggatgcggatgatgcggcgaaaaaagacgccccggcagaaatagaagccgtagtcgaagaaatcgagcggattcaaaatgaaatgggcattgaaaagctgccgagcccgtggcttccgccgcttgccgaacgtatcccgcgcacgctttaccccgcgcaggaaaaagaccgcttcttcatcgcctgcgttgatgagcctgatcagcaaagacaggcgcctctcgcttacacaatgatggatgacggcaacatcggcattttcggctcatccggctacggcaagtcagtggctgccatcaccttcctgatgaatttcgcggaaggatacacgccggaagagcttcatatgtacatctttgacttcggaaacggcacgcttctgccattggcaaagcttccgcacaccgcagactatttcttaatggatcaaatgagaaagatcgaaaaattcatgatccgcatcaaggaagaaatcgagcggcggaaacggctgttcagggaaaaagaagtcagccatatcaaaatgtacaattcgctcagtgaagaagagctgccgtttatatttatcacaattgacaatttcgacatcgtcaaagacgaaatgcatgaattagaaacggaatttatccagatttcacgcgacgggcaaagcttaggcatttacttcctgctgaccgcaacgagggtaaacgccgtccgccagtcgctgttaaacaacataaaaacgaaagtcgtccattatttaatggatcagtcagaaggatactccatttacgggcgtccgccgttcagtctcgaaccgatcccgggccgcgtcatgatccaaaaagaagaactgtatttcgcgcaaatgtttcttccggctgaagcggaaaatgacctcgagatgttccaggcgctgaaagctgatgtcaaagctttagctgagcgccacgccggaacagccggaccagacccgattccgatgcttccggatatgctgacggccggcgaattttcactccgtctcggcccggaacaagacccgttccgcattcctgtcgggcttcatgaggaaaaggtcagccctgtgtactttgatctgggtaaaaataagcattgtcttattttgggccagacacagcgtggaaaaacaaatatcctgaaagtgatgctgaatcacctgctgcgtgaaggtgcggaacgggtcgggctgtttgactcgattgaccgcggactgtcgcagtatgcgcaggaaacaaaggtcagctatctggacacaaaagaagacgtccggcagtggatcgaaacggcagaagccattttcacggagcgcgaagctcagtatacgcaggccgtcaaaaatggcgatgtgcacaaactcagtttctctccggtcgtgttaatggccgacggcattacaagattccagcagacgatcgacaccgccttacaggacaagctggcgatgtttatgaaatcttacgcgcatgtgggcttcagttttatcccggcgggcaatcacagcgaattctcaaaaggctatgattccttaacgacggaaatgaaacagatccgccacgcgatgctgcttgtgaaaaaatccgaacaaaatgtcattccgctgccttaccaaaggcaggaaccggacattcagccgggcttcggctatttggttgaaaacgggaaggagcaaaaaatccaaatacctttatgttcagcggaaagggaggccgtcagatgaccgaacaacgaaaaagcctgatcaaattaatagccgcggtcgtcatcattctgctgctgccggtgctgtttttccggtttatcggcgatgacccgggaaaacaaaaaatcaacgccacccgccaaatcgcagtcgtgaatgaagatatgggcttacaaacagatgaaaatgaggaagaggaatccgtccatttcggcaaagaagtagcggccgctctcggcggccgtccggattattcatggacggttgtcaacaggagcgcggcagaaaacggtctggcggctaagaaatatgacgccgtcgtttacattccatccgatttttcaaaagacatcttaagctatgacaaggagcgtccgcaaaaagccacgctgacattcaatattcaaagcaacctgaacgccgtcaacaaagaaaaagtgcagcgtgagcttgaagacgcccaaaaatcaatgaataaaaaaatgtcggcattatattggaatttcgtctcacaaaaagtgaacaatgtccgaggcgattttgacaagatcgtcaataaagaatcagagtttcaaaatgtcatgtacaacttttacaagccgagctccaatgacttggcaggtgaaatcaaacggcaaaaagacctgattgacgaactgaaaaaatcaatgaatgaagcgcagggcgcggcaaaagaaaaactgacttcggcagatgaagccaaaaccacgctcaaagactttgccgacacggtcgagcgctacaaacaatatcaagaaaatcagaaaaaactgctgatggccgcgcaggaacaaaatcaaaagcaaatcacaaccggactgaacgccattaaagcacagcaggccgccaaccagttcagcacgatgatgagcgggctctcttcaggcataaaccgggcgcagacacagcttgaccagacgggatcggctctttttgccgcccaacaggtgagagaagcgcaggttcctgatcaggaacgcgggatggcgaatattcaatccaatttactggacaattatttgactcaatataaagcgcaagcaagatttgaaacattgaacagcattcaaacccttatgaaaagggatcggccggcattaaccgttccggaaaaggacccgggtgatgacggctcggatgaaccgaaagaagaagaaaaaccggaagaagaaaaacccggcgatctgaaaattgaccttgacgatcagcgtgacgaattaaaacgcatctccgctgaaatcaatcacatttctgacggattaaaagaaccggaaaaagaaaaaccggaaccggaagaaccgggccaaggcgatgacggtgaaaactccggcgataccgatccgaataacggaacggctcccggagaagacggaaaaacggaagacggcacaaaagaagagcagcctgcctccgataacacaggcgatcaggagccaaaaaccgtccagacctcgacagccgctgaaaacgtcactccgcctgctgatgagccggcggacgatccaaacgattctgaaagggacggcggcacggacatatctgaggcaaaagaaaggctgaaccaagccgcagaacgcattcagcaaattgaaaaagagctggaagagaaacagcagactcataataaagaactgaaaaaacgtctcgatgctcttgatgaagaaatccaaggccttaaaaatcagattgccaaagttgaaaaacgggcagataaattaaaggaaaatttggaagaattggaagaaacgagaaaacaagacttcgataccgtttacagaatgattgtaagaacagaacagaacattctgaactacccgtcattggatagcggccgcaaatctgctcttgaacagatgtttgccgctgacatcaatacaaaaaagatatccgatttaatgagttactataatgatttatccctgtatgaggcgacactctatcactctcttgacgcgggctcgctgcctgatgtgaaaaaccgggtgctgaaagcccagcaaggtgaagtccaaaccgttcttgccatcaaaccggaagaaacggcaagctgggaaaatctgaaaaacaacaaaatgcagactgatgaagacatcagcaatttcattaaaggcatgaccgaattctcggataactacagctcgtatatcagagatgagcaagccggggtgctcgatgagcttgccagcatttcagacagcgcggcgaaagcatccgatcagctggctgaaggcgctgtgcaggaagcggccgcgttcagcggagacggattaaccggaacgatggcgctcggcgctcaggataccgtcggccgtgaagtcctgcaaatgtctgacacgatgggccatctgtcagaacgccagtccggcatcatcagctataccgacaatatgcagcaaagcgtaaatgacgtccagcaaaaagcggacaccctgaacagcaactggggcaaaaacgtcgattccacgaaattgatcagaaatgacgtgtacggcattttagggaacgcgctcgttgacggacaggaaaacggatatgtttatgattatctcgccaatccgcttaaaatcagcggagaggtgccggaagaccgggttcagaatgttccgccggtcgtcattttggtgatcgtcctgatcagcagtcttctgatcggctatttcagctcgtattatcagcaggcgccgcttcttgtcaaaggcgcgctctttgggattttaaacattatggtcggattgatgatcagtctgttcggtctgaatatctattcgcttccggatgatcagacgattaaatggtcagtctttacgattctcctgcttgcggcgagttcagcttttatccgggcagcctttgtcttcagctcaattaccggatggatcgcatcatcagcgctcattctcttttatgtggcgcctttgatcgacctgattatgccgaacttcacctttgacagtccggtttcgaaagtctatatcgatattcaatacggaacgggccatctgtttgcgttgggggtaacggttcttgcgatcattacgctgattgcggcggcgcttccgctcgtcattcggctgtttgcggaaaaaacggaggaaagtgatcagtcttatgaggcgtaacacgttcatggaaaaaggattgctgctgtttgctctctcctttttccttttccttccccaagccgcagccgcgaatgaggaaaatactgatgtcaagccgaatgaatatgaaaagaaagacattgaaattcgtacggactacctgcacgacgatgcctactccgaggaaaaaacggcgcttccgaaagaacagaaggatatcacgtttgatcagccggccgaaaacccggatgacaaactgatatcaaatttgtttacatcgtcagacacggagccgaatacgatcaaagcgcaatcgaaacaactgggtatcacatttgccgagccggcggtgcggcatacctcggcagatatggaaatggaagagaaaaagacttcttatctgcttcctgctatttatgccgtcttgatcctcctcgggattgcggcaatgatctatctgatcccgaaagtcacggcgcaggaaaaggcaaagcggtaaaacggatcgcttgtgtttgcgggaagacagcccgtaaaataagaaaaaaaggaggagtttcatgcagttttttcttataacaggcgcgtcaaaaggcttgggccgggcgcttacggaacaggcgcttcaagaaggagccgaagtcgccgcgctttcaagaacgataagcggggaaaagcgcgaggggctgacagaatacagtgttgatttaaccgatctcgcagataccgggcggcagatgaaggcgattcttgatcaagcagaggagaaggggtactccgccgtcacactgatcaacaatgccggaatggtggaaccgatcaagcgggcgaaagacgcttccgccgaagaattgaaccgccattacacccttaacctgacggcgcccgttttgctcagccaaatgttcacaaagcgtttcgaagcgttcagcggcagcaaaacaattgtcaacatcacatcgggcgcggcgaaaaatccttataaaggctggagcgcgtattgcagctcaaaagcggggcttgatatgtttacgagaacattcgggtttgaacaggaagatgaagagctgccggtccgcatgatatcattctcgccgggagtgatggatacagacatgcagtcggtcatccgttcttcgtcaaaagaagatttccatgacatcgaacggttccgcaatctgaaagaaacgaaaaacctcagaagtcctgaatacatcgccggcgtcattcactcactgatcgcgggcgagccggaaaacggacggatatacgatatcaaagaatttttgtagagcagctttcacgctgctcttttttgtttgtacaatcacttaggggtccggcggcatatgatgaatgaaacaacatataaggggtataagaaatgtatcagatgaattgagtttcttctcgatttatgttaggattctaaaaatatatgaaggaggggtttccatgagaaatgtaacgttaatggatgtcttcacccatccaatcgcacaaaagtatttacagcgttccggtgtcgcccatgcgatcgcctgcgcgtttcatgcataccgtcttgccgtaaaagcaggtgtcagcccggatctggcggcgaaagcggcattactgcatgacgtcggccattatgaatggtacacagacggcaaatgggattatgaaaagtacagaagaaatgatatccatgccattaaaggcgcggaacgggcgcataagctgctcatccggctcggtgaagaaccgaaagcggcgaaggacattgcgctggcgattctgcttcacaccgattcctatctgcctgaaggcgaactggacaagaatacgctccagcaaatcgtgaaacaagcggatgaactcgatgaagaacccggcggacatcaccattaccgccaaatggatcacacggccgcgctcaaacaaatccaaaagcttgatcagttaattgaccgagcccaatatcccataagaagctcagtctaggccactcatgcggccttttccgcttacataactccgcatgctcactaacaccttttccgctccgatagacgtactgtgtcaaagcctttgtccgctgcatatgctgaaggaaaacatagtaaaggggatcagcgaaaatggcccatcaaggaagcccgcaaatcgtctcgttagtggatccttacgtttatcagaccatccataagcttatcggctcaaggtttatcattcaaaccgtcagacgcattgtcagaggacggctgattgatgccactccggatcacatcgcaattgaagagacgcatgaccgtgtattttatatcagaaaccgccatgtggtttccgtcatgcctgattataccgaacgcgtgtaacagcccgaaaaggcgcaaaccggaggcggcactatagaaccccggtgcgtcttcttttttgagatacatagatgcacggcggctttttttggtacaatcacagtacaagttcacacgacaataggaggaaaccgcttgttgaaatcaaaggtccatttttggacgctgcaaattttgctcgttttgctcattatttacgtatcaacgaaagtctcgtttatatttcagccgtttttcggttttatcaccactctgttttttccgattttgatctcgggcattttgtttttcatttttaatccgatcgtgcgcctgcttgagaaaaaaatcccccggacattggcgatcctgctcatttatctcgttttcatcggtctgattgcctttatgttcactgccatcgggccgattgtggcttcccaggtcacggggctgattaacaatttccctgattacattcatcagattcaagtcttgacggcgcaattatcccattccaaatggtttacgtggatgatgacgcaggattatgtgtcgatagaaaaaatccagcagtctctgacgggatttttacaaagccttccgcaaaatattacggcaagcctgtcggccgtgttcggcgtcgttacgaatatcacgcttgtcgtgatcaccgttccgttcattttgttttatatgctgaaggacggccggcggtttccgctcttggcggtcaaaatcctgccttcttcctaccgggcggaaggtcggaaaatatttaacgacttatatgtcacattggccgcctatttccaaggccagctgctgatttgtctctttgtcggaacggcatgttttatcggatattggatcatcggcctgccgtatgcgttaattctcgggatggtgatcgccgtcaccaatatcattccgtacctggggccgtttctcggggcggcgcccgcggtgattatcgcgtttatggattcgccggctaaggcgctgtttgccgttattgttgtcgttgtcgtccagcagcttgacgggaacctgctttctccgcttgtgattggaaaacggctgaatacccacccgctcaccattattcttctgcttatcggagcgggcagtttcggcggcattctcgcaatgatcctggccgtgccggtttacgcggttttaaaagctttcgtcttaaatatcgtccggcttatcaaacttcgtcagcggtcaaagctcgaagacagccgcaagccgaaataaaaacgggcacaactcccggtgcagcgcataaaatgctgtaaagaaaagcggaggtgtgggtatgcctgcaattgtgggaccgatttatattatgagtttagccggagacgctgcggcgagcttcggtgacgtgtttgccatttctcccaaagccgttgaccactcaggcgcgggggcaggggcgtttcattccggagattttgtcaaaattactaataaattcagcaaaacgcgctttgaagacatcgatgtgtttgacgaacctgattggtttaacgcgtgacagcctccttttaggaggctgtcgcttttttgtagtataatagaatcagtctttataaaaggggaatgttttatgaaaatcagaaaagcgaatattaccgtgcattccggaatgatcggtgatgtatatctgcatgaaaataaaaaagaacagcatacccttgtagccgttccggaacttgagtggagcacgatcatttcctatgaggaagagaaaaaggcgctggcgcagcggcttttacaatcattcagcaagctgattgaagaagaacccgccggagagctcgccggcaagatctcccattgggtggctgaaatgtaacgaaaacggtttaccgcgtcccgtccggggcgataattgtaaaacaagctgggagggacaggccgatgagcgacaaaacggttgacctttatttacagcaggggatgtacggccctttgcagacgaaaccggatgaacgccatttatttttaggctcgctgcgtgaaagagtcatcattgccctgacgaagggacaggtgctgcaaaagcagccgtatgaagaagtgaaacaggcgctgaaaagccgaaaagacgcggtgctctatataaacggaaggctcccgtatcatgcttattcaccatatatgaagcttgccgcacttgccggtgtccgaagctccgtcatctcggaccttcaattcgaaacgccgctcggcctggtttttgccgccgattatgccgtgaaccttgacggcatttacgtgcaggatgacatttttcagcgctcactcctgaaatcttaaaagggcaaaacactgtttgtcattttacaatgccaattcacttacaagtggagataggatataatggttttcatatgaatggcggggaggccggctatgaaaaaagcatttatatgcattgattatacgaatgattttgcagctgagaacggggcattaacctgcggagaacccgcgagacagattgaagatacgattgtcagtttgacgcaagcatttatagaaaacggtgattacgttgtctttgcggtagattcgcatgatgcagacgatgactttcatcccgagacacgcctgtttcctccgcataatatcaacggcacggagggcaaagagctgtacggaaggctatcgcctctttatgagaaacataaacacgcaaaaaacgtaaattatatggaaaaaacgagatattctgcttttgcgggaacggatttagagctgaaactgcgggaacggcagatcactgagctgcatcttgcgggcctgtgcaccgacatctgcgttcttcacacggcggttgacgcctacaacaagggctttcagatcgtcattcatcaaaacgctgtggccagctttaatccggaagggcatgaatgggccctgtcccattttaagaacagcatcggagcgcaagtggcagagtaaggaaggggaaaacaattttggtggagcatggttttaaagacgacagtttgtctttacatacagacctttatcaaattaatatggccgaaacgtactggagagacggcattcatgagaaaaaagcgatttttgagctttttttcagaaagcttccctttgaaaacggctatgcggtatttgcgggcttagaaaaagcaatcgaatacttggagaacttcaaatttaccgacagcgatctgaattatttaaaaacggaattgcactatgctgatgatttcattgattatttacgggatctttcttttaccggatctctttacagcatgaaagaaggcgagctcgtttttaacaatgaaccgattatgcgggtcgaagcacccctgattgaagcgcagctgattgagacggctctgcttaacattgtgaattaccaaacattaatcgccacgaaagcggcccgcattaaaggcgttgtcggtgatgaagacgccctcgaattcggaacgcggcgcgcccatgaaatggatgcggccatgtggggagcgagagcggctttgatcggcggcttcagcgcgacgagtaatgtaagagccggaaagcgttttaatataccggtatccggcacgcacgctcatgcgctcgtacaagcgtaccgcgatgaatatacggcatttaagaaatatgcggagacccacaaagactgcgtatttctcgtagatacgtacgatacgatccgttcaggcatgccgaatgcgattaaagtcgcaaaggaattcggcgaccggatcaacttcatcggcatccgcctggacagcggggacttggcgtacctgtcaaaaaaagcgcgtgaaatgcttgatgaagcgggtttcacagacgcaaaggtcattgcttcaagcgatcttgatgagcacacgatattaaacctgaaatcccaaggagcgaaaatcgatacgtggggcatcggcacgaagctgattaccgcatacgatcagccggctctcggcgcggtttataagcttgtcgccattgaagaggacggcaaactgaccgacaccattaaaatttcgtcaaaccctgaaaaagtgacaacgccgggaagaaagagagtataccggattatcaacaagctgaatcaccactcggaaggtgattatatcgcgctttatgacgagcgggtaaatgatcagaaacgcttaaaaatgttccatcccgtccacacgttcgtcagcaaattcgtcactgacttctatgcgaaagacttgcatgagccgatctttgaaaacggcgttttatgctatgataatcccgaaattaccgacatccagcaatacgtgcaggataacctcaaacttctgtgggaggaatacaaacggatcagcaagccggaagaatatccggtcgatttaagcgaagactgctggagcaacaagatgcagcggattcatgaaatcaaaagcaagctgaaacgggaacttgaatagaaaacaaagcggcctttcctatctctggaaaggcttttttgttgtgataatatttttcacatttagacaaatttcgtcaagttatttgatatacttatgttcgaaggccgcatctaagggggtaaatgaatgaaggtgtttgttgcgagacagcctatcttcaacagaaacgaacaggttgttgcttatgaacttctttaccgggagagcgaagagaaccgttattcggccgcggatggagataaagctacgacggatctcattattaacagctttatcaacatcggaatcgaaaagctgactgaggggaaacgctgctttgtgaattttacagaaagcctgatgttttcagatctccctacctcctttgatcctgaccagcttattatcgaaattcttgaggacataccgatcactccggcgctcatctcaagatgcagacagctgaagaaattaggatatacattagcacttgatgatttttacgccatcaatccggaaaatgaagagttagtggaacagctgatgaaatatattgatattttaaaaatcgactttttgcaatcctcgcgtctggagcgcaaaaaaatcattcagacgtacagctgtaaaagtctgatttatttagcggagaaagtggagacgagaaaagattataaacaggcggccatagacggctttcacctgtttcaaggatattttttcagtgaaccgcgtgtcatcagcggaaatgatctgacgtttcattttcattcttactaccagcttttaagcgaattaaacaatgaccagcctaatatacagcgcgtgacggaatacatagagcgtgacgtcagcttatcgtatcagattctgcgttttttaaacggatcgcaaacaaggctgaaaaaaaagatagacagcatccagcaggccatcatgatgctcgggctgaatgagattaagcgcttgatttacattctttcattcagagatttaacggcgaaaagccactcaagccaaaaagaaatcattaagatttccttaatcagggccaaactgtgcgaactgctggcgaaaagaaccggaaggccccagccctcttcttacatgctgatcggcatgttttcgctcatcgatacgcttctccacagggaactggaggatatcatcaaagaactgcctttaatcgatgaagtcggacaggcgctgctcggttatgaaaacgattattataagatgctcgcgctcgtcaaagccattgaatgcaacaactgggactgtgacgagtggggaaaagaactgaacaaagaagaagcgtatgaatgttacttacaggcgatcgaatggtgccggcagctgatcgattgagccgctttaagccgaccatctgagggcgatgataaaccggctttgctctctgatcagactgacacggatgccgtcgggattatacgtcacgtcaaagtcatttttgatgccggtctgcttaatgagccgcttgaccgctgcggtgtcagatgattgcgctgcggtgaggatgctgcgcgcaagctcttttgacgccgacagccgcgcaaggagcaggcgcgcatcctccagcatgcccgcagcttcttttgcggacgctgtcaaaatatctgcgtgaaccggggcactgggcgctggatgccggtatggcgcggcgaaaacagggcagcatggatacacataatgcatacggcggcctccttcctgagaaaacattcgttatacatgagtataggcggcgtgataatgagttatgacatgcaaaaagaccacaatgcgggggttgcggtcttttcggtgtttgtcggtggttatgcgacgctgtttgcccattctgttttgaaattgtgacggcagggactatagtccctgccggtttgtcggaaaaccgttgaaaaaacagcagaaccgccagattggtctgctttatcctaaacgtctgcctttgcggtagttatatagtcccgttcgctaaatgccctgttcgggactatggaattaccatggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaacaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcattttttatccatttcatggataaagtattatacgattgttaaaaaacgaaaaacctgctgtctttcatcacctgcatttagtaaaatagaatgggagggtgaagacaattattgagcaaatgtgtttagatgccgaaacgattaaagagaagatgaaggaaattgtggcgcacaatatatgcaatactaacttgaaaatgtaccttctaaaatttattgcatcaaaagattcatttggatttgctgaattggcatatcaacattacaaggcgttcaatggcagagacacagaggcgattttaaagttagccgcaggtatagaattattagtcctgtcatatgacatttatgatgatttagaagataatgataatctgaaaatggaatggatgaaaacaggtctccccattacgctgaatactgtaacggccctctatacattaagtatacaggttatgaatcaggttagtgaaaatccggattttcttaagcaaatattaaactttgctttgagttcaattgagggccagcaagatgatattttgaatgcaccgcaaactgaagaagagtgcttgaaaatgattaagaataaatcgggctctttaactgcaatgccttgcgttatgggagcgatgctggcgacaggaaagttaaacccaatcgttcaatcatattcatatgaactcggtataatatcccagattgataatgattatcaaggtttgttttacttaaataatgattttgttcaacgcaaaaatacacttgcttatttatacttaaaaaagagattcaataaagcttctgaagaaatcttacaatggtatgaaaacccggagttattcaaaaccttaaagactcgagacataaaaaagaaattaattgaagcaggtgtaacccaatacttattggttttgaaacatttgtcgttaaaaaaattaaaaagtaagatatttgaattggagatagaaagaaataaaacggaagctttattaaatgcgattgttaatttagaggaggatgaaaaataatgcaggaaattgtaggatacttaaccaaaaatccagaagttttaaataaagtgattgaaggaaatgctagtctgatcggagttagccaggatcaaacagattgtgttataaatgcgtttaagggtatagatgttatttctttcggcggtgattggaaatattgaggatgatataaatgaagtccaagtacaataagatttcagttgtcttaattctgcttacattggtatatgtcatttatctgacttatataagcacaaataatcttttagtcggcgccaccatttctgaaaataaacagggcgaaattaaaataaaagatgtagaagattttacaatggcatattacgccggagtgcaaaagggagatatagtaaagaatattaatggccaaaatgtaaagtcaattaatattcaaatgaataagctgaaaaatgtaaactcgatggtcgttgatagaaacggtcatgatattgagattaagctcaatttatttaatgataggaacttcagtacttacttaataccgataattttttatgtagtatgtttattttgctgcttcttcatcatcaagataaatgaagaaaaaaacttgaaatctgctttggtgctaattgtatttcttttgtctgcttcaatcgcatatatcagtgctggaggatcggcaaaaggcgatttgcttagcagatgcatcatgttgttaacattaataactgtacctttaaattatcttctgtttctttatcattactttaaagaattaggtactgtgcttttcagcaaaaaagtttttgctttgtatttatttccaactataaatatattatttgaattatttcggtcgcgattatcttttggtgattttattccaaaatttaatttgatttcgttttttcttctttttttggttgtagcatattactttattgttattttgagaagaaacaaagatactgaccaggcacatattataaaggtgcttgtggttataaatatattggcattttcgccttttttatgtctgtatcttataccgtatgtattttttaatgattattatgtctcttctttcttaacagcatcatttatgctgctgatacctttttcacttgtatatcaattcatgtcgaataaaatatataacgttgattttatcttaagtaagttaaaatattacggctttttagcgttaaccccaactataattctggttacgacaattgagttattacgtgagccggaagaaaatttttacaatcttaaactgacatttttaatttatattttaatgttagctgttttttattataaagaaatactcgatttccggtttaaattaaaaagggtctctgaaagattcaattaccaagacagtatttataagtttacccaattaatcagaaactcgtcttctttaaatcaggtttttggagaattaaaaaccaccattctcgaagtcactcttacaagtaaagtgtatatatttgaagttacgtatgatgggaatgtaaaggcatttgacgaaagagattcaagtttgatagatgattatcaagtgcttttaaatagtgttactgttgaaataggaaaaataacggagtttaatcaaggtttcgcaatgaaagtaggagaacggggagatagatcattcgttgttctctgtttgtctaagatgaatacgccccgtttatcacgtgaagaaatttcttggttaaaaacattatctttttacgttaatgtttcaatagaaaacgtgatgaaaattgaagaacttatgaatcaccttgaagatttaaagaaacaggagacaaacccggtctggctcaaaaagctgatgtttacgatcgaggaaaagcagcgttcggatttggcccgtgatctgcatgattcagtgctgcaggatttgatttctttgaagcgccagtgtgagctgtttctggccgattttaagaaagaggagccttgccagttagaggtgcaggacaagcttcatcagatgaatgagcagatgtcggatgtcattttgatgacccgggagacgtgccatgagcttcggcctcagctgctgtatgatttgggtctggtcaaggcggtatccaagcttgccgcgcagcagcaggagcgtgcgccgtttcatatccgtctgaatacgggccggtttacggcggcgctggatttggatacgcagctgaatttgtaccgcattattcaggaatttctttcgaacgccatgaagcattcacaggcgaatgaggtgctgattatgctgatcagcattcaaaataaagtgattctgcattatgaagacgacggtgtcggctgcaatcaggaagaaggcggcggacagtcgatgagcatgggtctttcgggtattaaggagcgcgtccgtgcgcttgacggacggatgaaaatcgacacaagtgaaggaaacggttttaaagcggatattgaaatggaattgtaaccattttatcaccaaatcgacttggcagaagccaagtctttttaataaaatggaaatgagtgagtaaaagggaggaaaccatgaaaaagatactagtgattgatgatcatccggctgtcatggagggcaccaagacgattctggaaacggacacgaatctttctgtcgattgcctcagtcctgatgccagtgaacaattcgttctccggcatgatttttcagcttacgatctcatattaatggatttaaatctgggtgatgacatcagcggcatcgagctttccaagaaaatcttaaaagagaatcctctctgtaaaatcattgtctacacaggctatgaggttgaagattattttgaagaatccatccgcgcgggcctgcatggcgccatcagcaaaaccgaatctaaagagaaaatcatgcaatacatatatcacgtgctcaacggacagattttagttgatttctcctatttcaaacagctgatgacccagcaaaaaacaaaaacgtcttcttcccctcaaagtgagcaggatcggttaaccccgagagagcgccatattctccaagaggtcgaaaaaggtttgaccaatcaggaaatcgcagatgcgcttcacttaagcaagcggtcgattgaatacagcctgacatccatttttaataagctgaatgtcggctcccgaactgaagcggtgctgatcgccaagtcagataacgtactataaatcttgaagggagaatgacctatgaatctgaacaatacattgctcggcgcactcggtattgaaatcactgaaaacacgccggagagatgcgtggcggtgatgccggtggataagaggacggtgcagcctttcggatatctgcatgggggtgcatcagcagcgctggcggagactgctgcaagtgtcggggcccagcattttatcgaccggtcgaaacaggcgtgtgtcgggcttgagattaatgccaatcatttaaagtccgtgaaagagggcggaacggtcacggcgatagcggaacccgttcacacaggcagggcaaccattgtgtacgggattaacattttcgatgaacgagaaaggctgatctgtgtttcccgctgtacgctggctgttataacaaaataaacaaacagccggaaccctgaatcgtccggctgtttgtttttacaaatatgaatcttcttttcgtttgatcacaaagtttctgatccctttgtaatcatcctgaacgcttcttttatcaagcgccgctcccgaattgtacgcggccctgcatatgaggtgcgctccgaccggcgccgtcagcaggataaaaatgatgccgagcagtatttttacagaaatttctccggtcagcatccacaagtagcctaacaccccgagcaataccaaattaacgccgagtgtcgagccttttgaagaggcgtgggcgcgcgtatacacatcaggaagcctgagtgtgccgaaagacgcgaccaggcagatcagcgatcccatcagaatacaaacggcgaccacccatttaacgatttcgatcattttcgataatctctcctttctccaaaaacttagcaaaggcaatcgtgccgataaacgataaaatgccgagcagcagaatgatgtccaaaaaggccgatgtgtttaagagaatggatacaagcgcggtcatggcaatcagattaatgccgatcccatcaagcgcaacgacccggtccggtatcgtcggccctttcatgacgcgaatgacgtacagaagagtcgaaaccgccataatgccgagtgataattgcagaataaacgtaaacatcagcggctcacctcctgaatggctttctcaaaagagacgcggatgtcgtggatcgctttctccgcatcttcaatatccatggcgtgtatatagagaatcgaccggtcatcggagatatccatcacgagcgtacccggtgttaaagtgattaacagcgagagcagcgtgatctcccaatcctccgtcaattccgtcttaaacgcgaaaatgcccgggcggatgttcagtttcggcgctataacggttttcagcacgctgacattggccaaatatagttcctttataaagatcagcaccagtctgatgactgaccatattttccaaatgtaaaacggccgcgagaagaagcgccggaaaaaaaacagcgacgccaagcctgcgataaatccggttataaaacccgccgtgctgaggctgtttgtgagaaacatccagcaaacagcgagaagaacgtttaataatagttgaaaagccatgccatctactccttcaaaacagcttcaatgtatttttccggattcagcagattctcagccgtctgattgacatacggtgaaacccattcggttccgagcccgaacagaagcgacaaaaggagaaaagcggctgccggataaagaagtccttttgcggaccgtccgcctgcgccggggatttctttttcttcgccccaaaaagccgtcgtaaaaaccttcagcaccgaatagagcacaagcaggcttgatacaagaatcaatacggagaacaatgtttcccccttatcgaacccgccttccgcgatcttcagcttgcccacaaatccgctgaacggcgggatgccggccaaagatatggctgaaataaagaacatccatcctaaaacgggataacgggtgatcagtccgcccattttatgcaggctggcagtgcctgtcaatgcgataagcgtgccggcaagcataaacagcgctcctttaatcagcatatcgtgaatcaagtaataaaccgctccttgaatggaggccggcgtgttcatggcaatgccgaacaaaatcacgccgacggctgtaataatattgtagatgacgattttcatgacatccgaaaaggcgatagatccgattacgccgaatagcaccgtcagcatcgcaagccacatcatcaattggtgggtaaagcccgtatcgtgaataaagatcagggtgaatactcttaaaatggcatacaggccgactttcgtcaaaagagacccgaataaagccgaaattgcagccggcggggcgtaataagagcccggcatccagaaatacagcgggaatatcccgccctttaaaccgaaaacgacgagaagaaggacgctgatcacggttatcagcccggtctggcccgattcgcttatttttacgcttagatcagccatattcagcgtgcccgtcaccgcatataagtaaccgacgccgatgacaaaaaacgcggatgacacaatgttaaacacgatatacttcaatgattctcttaattgaattttcgttccgccaagcacgatcagcatgtaggacgcgataagcagaagctcaaaaaagacgtacatgttgaacaggtcacccgtcaaaaacgctccgcttacgccggccagaagaaactgcacccctgaataatagaaagcgcgctcccttttttctccgatggagcggaaggagtacagggtgacgagcagcccgattatggcggttgtcaaaacaagcagtgcggcaagctgatccgcggcgagcacaatgccgtacggcgctttccagccgccgagtgtcagcgtctgaatcccgtgtgtgaaaaccgtctgaacgagagcggcgctgatgacgatggagacacaggaagcggcagtgctgaatatccgcatcagcatcacgtgcctgttcataaaaatcagcagcactgcggcaagcagcggcaccagaataggcaatatcacaaagttattcatgttgatcatttcccctcattcgatccatatcgtccgttttcagttcctgataggcgcgaaacgccatcacaagcaggaaggacgtgacgccgaacgaaataacgatcgccgtcagtatgagtgcctgcggcagcggatcgacaaaggacgtgctttttccgcccagtatgggaggagcgccttttttcagtccgcccatggtcaggagcagcaaatggacgccgtggctcaaaagcgcggtgccgataatcacgcgcagcagacttttagaaagcagcaggtaggttgccgccataaacaaaataccggcaatgacagacattaagatttccactattcttcctctccaatcgtttgaataatggtcatcgtcacgccgacaacaacgagatacacacctaaatcaaacaaagtggccgtcgcaagctccgtattcccgagcaccgggagatgaaaatggccgaatgtatgggtgagaaagggcgctccgaataagaacgaacctgcacccgttgcaatcgcgataagcagacccgcgcccgccacataaataaaattgacgggcaaaatcgatttgacggtttttaaatcaaaggccaaaagcagcagcacgatggccgaagacgtaatcagtccgccgacaaatcctccgccgggggcgttatgccccgataaaaataaatagaaagagaaaagcagaatgataaaagatacaagcttcgttgccgtctgaaggatgatgtcgtttgtttttggctgtctcaacgcttttctccctcctctgttacttttgttctgatcatgccgtaaatcccgagtgcggcaatcgacagcaccgtaatttcaaacatcgtgtcaaatcccctgaaatcaacgaggatgacgttgacgatattgtttcctcccccgagcttatggctgtaagcggtgaaaaaggaggagatgctgtcttttgttttttcgctggaagacgcgattccgagcattgtcacgatgacgccgacaccgagagaaatgataaaattcgtcatccggaatgttcttgtcttctttttccgccgcattttcggcagatggtaaaaacaaagaagaaacaaggcgacggatatcgtctcaatgacgagctgcgtgagcgccagatcgggcgctctgaaaatcacgaaaaacagcgcgagtgtgtacccgacaacaccgagtgagataatggccgtcagccgtgatttggcgaacacagtcgcaatcgttgcgctcaccataacgagggacagcacgatttcatacaggccgatctcagccattcctttcgctgtcatggaaaagccgcctttcatgacgaacgccgctccgatgagaatgataaacgacgcaaagatatacagcagataatcccgcaaaaatccggtcatataagatgacgtcagctggtaagatcttttttccatactgcccgtcaccgcatcgtaaagcttgttcagcgtcagttttttcggaaacagaccgtacagacgctcccatttagacagcgttacgtaaccgatcgtgccgacaatgatgatgccgagggtcatcattacctcagccgtcaccccgtgccactgggaaatatggacatggaatgtatctccgccggttaacagagcgggataaatggagttcatcgccggttcaatcaggctgtaagacaaaacgttcggagcaaaaaacagactgacggcgcaagcggcaagaatcaccggcgaaatcagcatgccgagcggagcttcatgcggcgtcttttcaagctgatccgttttgcgcgcgccgctgaacgttctgaaaaacagcttcatgctgtagatgaaagtgaagacgctcccgatccatgcgagaacggggaacagcacgccccacgtatccaggctgaaaatatctgcatgagcaatccgcagcatacttgtaaagaacatttctttacttaaaaagccgttaaacggagggagaccggccatggaaaacgttccgatcagtgaaacggtgaacgttaccggcatgagcgccatcaggccgccgagcctgcggatatcccgcgttcccgtttcatggtcgataatgccggccgccataaataaacttcctttaaaagtagcatggttaattaagtgaaacacagccgcggtgacagccgccgtaaaatactctgaatgctcataatgaagcgcggcggctcctgcgccgagcatcgatacaatcataccgagctgactgactgtggaaaatgccagaatcgcttttaaatcggtttgtttaatcgcattaaaggaagcccataccatcgtgatcagaccgactgaggcaaccgtccaaaaccagacgggtgaaaaagcaaaaaccggactgaatctggcaatcagataaatacccgctttcaccattgtagccgagtgcagataggcgctgacaggagtcggcgcctccatggcatcaggaagccagatataaaacggaaactgcgctgattttgtaaaggcccccaataacaggagaaccatcgccggaataaagaacgggtggcctgcgataatatgcacctggttgaccatttccctgatactgaaagaatccgtcatcagatacagcaggataaagccgccgagcatgcacagcccgccgccgacggtaatcagcagtgatttttccgccccgtagcgtgatttcttccgcttatgccaatacccaattaataagaaggatgacaggcttgtcagctcccagaacatataaagcacgatgacgttatcgacgagcacaacgccgagcatcgcgcccataaacatcagcaggtacacataaaaagggccgagcttttctttgtccttcgataagtaaaaaatactgtaaagcgtcaccaaagagccgatgcccgtaatcaataaagcgaataacagcccgagtccgtcaatataaacggtatagttaataccgagggacggaatccattcggccgcataccggacggtttctccagccattgtgacagggagcttgctgataaagtaaacaaacagcacaacgggcactatcagcacaaaccagcctgtatggacttgttttacccgtttataaagaaagggaacgataaatgcaaataaaaaaggcgccaaaatcgcgaaatgtaacagctgcaacagaagacctcctttgcttgttttttcatcaagcaactgctttatgtaagaatgaatcaatcaattcacggtcataggacccagtacaaattatatcgcacttttttttaccctgctacggcataatgtattcctctttgtgtttttgtggtcttttgaacccaaaataaatttatcaaatatccggatctttgtatatacatttctttttcagatcaagctttacaaaaggagctggtcagatgaagagaaaggcggcggcctgtattggaatattttgttctattattgcaggaacattcatagttgatgatttctgcaaaacgcggcagcagacggaagcagatgattgggagcatttttttctcggtgcggaatacgcagaagacaagctgagtgcggctgaatcaatgcaaacgccgtttcagccgcgtgagtatatcagaatcgtatatagatgaaaagagttccggcaccagggtgcggaactctttttgtgtggcaatcagcgttttcctttaatataagggatgccgttggctttaggcgcatccgcgcggccgatgaagccggcaagcgcgagaatggtcagaatgtaaggagccatcagcatgtatacattcggaatgtctttgaacaggggcaaaagcgagccgataatgctcaaactctgcgcaaacccgaagaacagcgcagccccgagcgcgccgatcggatgccatttgccgaaaaccagcgcggcgagagcgataaagccttgtccggaaatggtggagtgcgtgaaatcaagcgcgatcgtggaagcatacacaccgccgccgagcccgccgaacagcccgctgatcatgacgccgatatagcgcatgccgaacacgttgattcccatcgtatcggccgccatcggatgttccccgacagaacggatgcgaaggccgaacggcgttttgaataaaataaaccaggaaacaaaggccagtacgatggctaaaatcgacgtataatatacgtctgaaaagaaaatctttcctaaaaccggaatatcgcttaacccgggaatgttcgttttgtaaaagggctccgggattttatcagtctgcgcctttccgtaaatcagtttgacgataaacagtgtcgctcctaacgcgagcatattgatcgccacaccggttaccgtctgatcggcgcggaaagaaaccgcggcagccgcgtggatcagtgagaacagtccgccggcaatcatagccgcagccagagcgagccacggagcggcggcgccaagctcgcgtccgaaaaataagttgaacatgacgcttgtaaaggcgccgataatcatcagtccttcaagaccgatgttgacaacccccgatctttcagaaaacacgccgccgagagcggttaaaataagcggagccgcatatacgagtgttgccggaacaataatggataaaatctgcaggaagtccacttacttcgccccctttttcttcaatttatcaaggatgagacggatggcgtagcttgatgccacaaacaaaataataatggcgatgacgatgtcaacgacttcagaaggcaccccggattcaatcggcatatttaatgccccgactttaaggccgccgagaagacatgccgccagaacaacgccgattgccgtgctgccgccgagaagcgcaaccgcaatgccgtcgaagccgacgccggtaaaggcgcccttaaccgccgcatattgaaaggttccgagtccttccatcgcgccggcaagccctgcgaaggccccggaaatcatcatggcgtacatcatattttttctgacgctcattccggcgtattgtgcggcgtgctggttaaagccgacagcccggaattcaaatccgctttttgttttatgaatgataaaccacatgaggactgccgcaaacagagcgatcagaatgccccaatgaaggcgggagtaatctgtcagctgctctaaaaacggcgagcggagcgacgcgctttcatgaattttgtctgttttgtcccggtggtccgtcatgacatcggaaatgagataattggttaaatgaagagcgatataattcatcatgatcgtgacaatcacttcgtggacaaaaaaacgggcttttaaaaatccgggaatcaggccccaaatgccgcccgcagccgcagccgccaataacgaaagcggaaggtggatgtaagcgggggcgtcaaaggaaacgccgacccacaccgcggcggtccagccgacaaggagctgtccttcaaccccgatattaaacaggccggtccgaaatgcgaatgccacggccaatccggacagaatatatggcgtaatctgccggatcgattccccgatgtaatacacttcaccgaaaatgccgctccaaagagccgaatacccgcttacgacattgtagccgctggcgagcatgatgaccgcacccgcagctaatccaaggatgatcgcaatcagcggcacagccagatgagaaagtcgattaatcatgtgttttccccgcctccatttgcttacttcccgccattaaaagtccgagctcctgctcgtttgtttcaagcggattgacgtttgcgatgatgctgccttcaaagatgacggcgatgcgatcgctgagattcattatttcatcaagttcaaaagataacagaagcaccgctttaccggcgtcacgctgctcaatgagctttttatggacgaattcaatcgcgccgacatcgagtccccgcgtcggctgggccgcaattaaaagatccggatttctgtccacttcccggccgataatggccttttgctgattccccccggagagagcgcgcgcaggcgtatattcatcaggtgtcctgacatcgtattcttcaatcaggcttcgcgctttgtcataaatcgtgtgtttatttaatatgccgaaagaagagtagggcttttggtaataactttgcagcacgatattttctccgatcggaaaatcaaggacgagcccgtgtttatgtctgtcctgcggaatatgcccgattccggcttcagtgactttcctgggcggcatattttgcagctgtttgccgtttaacatgatcgtgccggcatttgtttttctgagacctgtaatggcttcaattaattcagactggccgtttccgtcaacgcccgcaatgccgacgatttcaccggctctgacagagagggagagctgtttgaccgcctcaacgccgcgcgcgtctttcaccgttacatcagaaagcgaaagcacttcttgtttcggttcagccggctgtttatccgtcttgaatgacacttcgcgtccgaccataaggcttgccagttcatcttgatccgtatgtgcgacatcaagtgttgtaatgccttttcctttccggatgatggtgacacggtcgcagacttccataatctcttttaatttgtgggtgatgaggataattgattttccttcattgacaagatttttcataatctgaatcagttcttgaatttcgtgcggagtcagcaccgcggtcggctcgtcaaaaatgagaatgtcggcgccccggtagagggtctttaatatttccgcccgctgctgcataccgacggagatatcggcaactttggcttcaggatcaatgtgcaggccgtaacggtcggaaatatcacgcacgtcccgggcggcgcgctgtctgtcaattcggccgaaagttttcggctcttttccgagaatgatattttctgagacggtgaaggtatccacaagcataaaatgctggtgcaccatcccgatgccgagatcgttggctttgttcggactgttgatgtgaacgcgttcgccacgcacccggatctcgcctttttccggctgatacaggccgaataaaacgttcatgagtgtcgattttccggcgccgttttcaccgagaagggcgtgtatttcgccttttttcacttgaagcgtgacgtcatcattggcgacgattccgggaaattccttgcgtatattaagcatttcaatgatataatccaccgatttgtcgctccttttcagagatactttgatgagaaagagcttggcaaaagaaaagctgcaagagatgcagcttttccttcaccgctcttttcaaaaaagagaggggataagcacgaaagtctccttatcccctggttcttactcagccttgaaggatttcaattctttttcagttgaagggatcacgagtccgtccgcgattttcttcttccaatcgtctgttgctttgatgacatcgtcagaaaggttctccttgtgatccgagatgccgactgcatcttgcgccaaaccgtatgttaatgttttgccgcccgggaatttaccgtcactcgcttttttcgttaagtcctccacggcagtatccacttttttgaccattgatgtgagagtgacattgtcttttgttcctttgacttggccttccgcgtactggtctttatcgacaccgataacccatacgttccgcttcggatcttcttttttcagatttttcgcttctgtgaagacgcccgttcccgttgcgccggccgcgtgataaatgacgtcaacgcctgatttgtacatgctttcagccgtcgccttgccgacatcggctttgtcaaacccgcccgcatatttcacttcgacggtcgctttcggatttgcggcttgtacacccgcgcggaagccgatttcaaattttttgatcaattcagattccattccgcccacgaatccgacttttcccgttttgctcgatagcgcagcggccgctcccacgaggaatgaaccttcctgttccttaaatgtaaggctcgccacgttgtcttttttgacaacggcgtcaatgatcgcaaaatgtgtgtctttgcgctgatcggcgatttcgctgatggaatcctgcatcagatacccgacgccgtaaatcaggtcaaagtgttcccgcgctaatttatttaagttcgttgtataatctgcatctgattttgattgaagatagtcaaaaccgcttttgccttttgtaagcccgttgtcttttccgaatgcctggatgccttcccaggcggactggttaaatgatttgtcatcaacaccgccgatatccgttaccatgccgacggtaaagtttttgctcccggagccgtttgctttgtcacttgaactgcatgcgcttaatatggttccggccgctgcgatgagcgccatcgccattccgattttgcgttttttcaaagatataacccccctgtaaaatatggctgtgccgttcaattcagacttgagtccccgtgccggatgcagaatcgaaaaaactttctgataataatgatgagacgtctctctttttcccgccttgagcggctgtctcttccgggttcgggacttatgacttatctgaaaagatctgctaaccaatcataatttatcattttacccgccataaataaatagaaatttgcttattttttaaaaaatatcaattttatgaatcggcttcctcatctggttaaaacagaggagaatcagccgggtcattatccttatatagcatatcaaaaaggaatctcaagccttttgtcacgggatatgacagtaaaaaagcaccgttcacagcgaaacggcgctttttgacattataaatattgtttgatgctgctgacattgccggtgttgatatgatattgaaagacgggtctgccgatcgtgccgtacgccatctctacattcagcacttgtatgtcttccagaaatttaaggtatttccggatggagacttgcgagatttcagtatgcttggcgagatcttccgtggtaaaagagccgtcgccgaaagactcaatgctcgcccagatgagtttaagcgtgctctttgtcaatcccttcggaaggtgaaccttttccgctgcttctttcttttgaaaaagctcggcatccaattctttctgtgtcatgcttctgtgtgattgataaactttctgcttgcgtctgtagtcggaaagagcggtttgaaagcggtcaaattcaaatggtttgattaaataatcgacggcgccgtaccgaagcgtttttttaatgacgtccagctcgcttgcggccgaaatgacgatgacatcaaccgattcattctgcttgcggatttccgttaaaagctcaagcccgttttttcccggcatgtaaatgtcaagaaggatgagatcgatatgatgctcgctcagcacgtgcagcgcgctttgaaaggatgatgcgatccctttcagctgaaatccttcaatctggctgaggtagcgcttatttaattcacccaccatggggtcgtcttcaactatgagtacattaatcatcattttcctccttcggttcatacggaatgcgaagactgaaagtcgttccttcattcttttcacttgtcacaatcatatggccttttaaattttctgttgcctgctgggtgaaatagaggccgaacccccggtttgtccctttcgtggaataaccttgttcaaaaatacgggcttggtctgccgcagacattccggctcccgtgtccgtaatctctatgtcaagctggcgatcctgaaaccgcatcgagcacgtaatgttttttttcggcatctgcgccaccgcgtcgagcgcgttgtttaacaggtttccgataatcgtaatgagctcatggatgacggccggatccgccgcattcggaatcaggctgccgagctgaatgtccagatcagcgccctgctcgcgtatgtagctttgttttcccagaagaaaccctgcgagaaccggacttttgacatcacttataatctcgcttgtttccgtcttctgctgaatggcaatgtctttaatgtaagtgccgagatcatcgtattcttttaactggacaagccctaaaatgacatgaagcttattcatgaattcgtgagactgggctcttaatgcgtttgcatacattttaacaccggacagctgttctgctaaatgtttgacctccgttttgtccctgaacgtggcgatcgctccgacggtttgtcctttcagatgaatcggaacttcattaaagaccagctcaagtccgttaatgcggatatctctgtcctgaagcggttttttcgtttcaatcacctgtttcagccggcttttcgggagaatatcgttcacatcttgatcgaccggattagtcggaatacccattttaataaaaagccgtttcgcctctgcattggcaagctttatttttccccgcgcgtcaaccgccaggatgccttccttcgttgattcgagcatggcgctccgctcttccaggagggtggcgatttcataaggctcaagaccgtacataatgtttttgacggtgcgggcgacaatgacggctccgatgacgccgacaaaaatacttacgcagataatgaaataaagcggtctcaaactgtggctgacgacatcctgtattttgttaagcgaaattccgaccgaaacgacgcccacttgttttttatcttttccatagatcggtacgaaggctctcatggattttccgagagttcccgctgatgtgctcgttttgatatggccgtgcaacgccggctgttcgtctccgccggtgaatttcttcccgattttatttgcgtcggggtgggtgaggcggatgctgttcatatccatcaccacgacaaattcggttcctgtcgtatgctggacatccagtgtataattccggagctctttcagcccttttcttgtttgcaatgcctgcgcgacactcggtgtttccgcgacaagctttgcggtgcgcagcgcggttgtccgttcttcttctttcacgcggtccgcggtctggacgctgatcgtgaaaaaggtgatacaaagtgcgataaggacgacaatacagacgaatatcgttaaccgggtttgcaattttaatgtttttttcataacagccttccttacgtttatcattcccgcgttctactttactccgaaaaagccggtttgtgaagatcaggcccttatttcgtaaaagtgaggaaaaatggaattttttatcttgtcaatgtgttttaagtcctccataataagtgaggtagattacagaaagggactttttatatgaaaaatacttattggacgggttattttccgctcgttgcgattctgctttttagttcgtcattatccatttctacctcgctttatgtcatgaagatacttcagacgctcggcatgtatcaggggatgctggattatttctctgagaaagggatcagactggcgctttttgcagcgttcgcccttgtgtattttatgcttttttcggctttgaagctgattgcaaacacagtgacagagctgtctcttttgtttttcacaaatgaccctgaaggggacaatctgaaaaaaatcagattaggctctttaatttatgtaggcggaggaattctttcctttgcgctcgtgcagaatggtttttggattgcggcgttatttgccgttgttacgctcgtttatttgattttcatggtgtacagaatctattcgacactctcgatcgcttcgctgatcggttttatattgcttgagattctgttttggtttacttttgttatcggtattttgtacatctttatcaagctttataatagcataatggctagcttacctgtgtaagctagccatttttgttaagacagaaatctgtttttgatctcaggggaggggagcatgcatgcttccctttttccgaaccatttgtaacggcgccgggcgatgaaagaataggctctgtccctgagggggcggggcactgcgaaaaaaaccgctgacagccgccaggctccgcggagatgacgggaaacctttaacacggctgcggattttttgtatatccgcccgttttcgataaaaatcatgctgtcaaattgttctgtcggaagtccttctgatgccaaaagctcccgggcggtatctgattgcaatgaagcaaatgagattttgccggccggatcgcgtttaatgatgaattgaacggcgccgctgcataagttgcagacgccgtcaaacaaaagcacgcggtccggaagctgagctggtttcaaagcggatcccctccgttatctttaataagctgcctgcagcgtgtttttccagatcgaaagctgagggcttgcgtcatgaaggtattcgacgcttgacggtgtatccttgccgacccatacccccatcgtataagcgtccgtcaggccgacaaaccacatatcgtgatagtcatttgacgttcctgattttccgccgacgtacggagctttaaagttcgctttttttcctgttccgcttttgacgacggctttcatcatttctttgatctgcatgttggtccgcacgctgaatacctgcgccggctcatctttccattttaatatcgtttttccttttaaatcagtcacttttgtaatcgcgtgactcggcgtataaacgccgttgttgccgaacgtggtgtacgcattggtcatttcaagcggcgtcatgccgtttgtaaaaccgcccagcgccgcaggcaggcggtaatccgcgctgaccagcttcgcgaaatgaaacggttcaaggtagctgaacgccttattgacgccgacgcggtccatgattctgatggccggtgtgttgtacgagtatttaaacgccgtttccagcgtaaccgtgccgtatgtgcggttattatagttctgcgggcagtaatccgcactgcagaatttgcttgcgtcaattttgctgtgtggcgttgcgccggtcttttcaatgtaaggtccgtaatcaagcagcggcttaatggatgaaccgggctgtctgtatgcttgataggcgcggttgaaatcatatttatgataatctttcccgcctgaaagcgcgataatctgatgtgtctgatgattaatcacggccgctccgccctggacacctgcatacggcagattttgattcacttgggcgacgacctggttttgcatatacggattcagcgccgtataaatcttcacaccgtcttttaacaatgtgctgactctgtcggaaagctcaccctgtattttttgtttcgcctttccggaagctttttcaagacgtttgtcatagccttcggatgaggaaacaagctgtgtgaattcatcatttacataggaaacatagtcaggatatttatttgttttttcgtttatatcaagcttgatcttttccttttcggcttttttcagctgtttcccggatataacgcctgcttttttcaatccgttaagcaatctgacttgtcgttttttcgtataatcaaaatgcttgagaggatcatataatgtagggttattagggatggcgcagataaaggccatctctcccaaagtgagagatttcagcggcttgctgaaataaaattgtgccgccgaaccgacaccgtatacaccgttattaaaataaatcgtatttaagtagccttctaaaatctcatctttgctgtattttttctcaagctgataggaataggccagctccgtcagttttcggctgaaggtgcgttcatggcttaaatacacattccttgccagctgctgggtgatggtgctggcgccctggtcaattttatgatctttgaaattggaggcggccgccctgaccatccccataaagtcaaaccctttatgctcataaaaatgacggtcttcagaggttaaaaacagctgctttacctcattcggtattttattaaagggcacgatcacgcggttctcatgatcgctgacaatctcagaaacaaggcttccgtccctgtcatacatgtaactgttttgaaccaggttgatcgcttttaaatcaatatgtttatcgagcacctgatcaaaaggcttgatttgttttacctctttgccggaagcaataactgtaaatgcacacaacgggataatgccgagcagcaaaatccatccgattattttacgtaccatggtcactctcttttctcctgatttctagccatatcgtatcattcttttaagaatacgagaaggttaaatttagaagaaatcgtgatcgctgccggtcagcccgcatttgacgctgtatccttttgcagatgtcccgccatccataaaagccccgcgcctattaaaaagagaaaggcggtgacgtagaaagcagccgaaatagaaaaaccgcttgagaccgcacctccgagcagagggccgagcacgtttccgagaaaacgaaagctgacgttatagccgagcacctctccctggatgctgcccggagccctgacgcggatcgcggccgtaatgcaggggagcgtgccgcccatgaccatgccgaacagaaatctgaagactaacagaatggagagggaggaggcgagcgcctgcggaataaaaaacaccgctgatgcaatcaaaagcacgattaagatccggctgtggccgaagcggtcgccgaagtccccccatttccgggcaagcaataagctgccgagtccggtcgctgaaaacgccattccggagaaaaaggctaaattaacaggtccgtgcagctcattgacatataaagcgagcagcggctggatgctgaaattgccggtctgcacgatcatggtaagcaccatcatcgcccaaagcgcgggctggtgaaaaatataagagagcacctgttttctggaataggttttccgcttgttttgtttctcgccgagcggctgctcattcacctgaaataaaacgagaagcacggatacaaaaataacaaaagacgtaataaaaaatgtgtacgtaaacccgaagctgtcagcgagtagcccgcccagcatcggtccgaataaagtgcctgacacctgacccatctgcagcgtgccgagcgttttcccggcagtctctttcggcgtctgcgccgaaatcatggcaagcgaagtcggaacaaagcctgttacaagacccataagcagccggaggacaaacagctgataaacagatgtcacaaaccccatcaataaaatgctgacggcaatgccggtgcctgtgatcaagagaatttttttgtagccgcgcttatcgccgaatctgccccaaaacggggaaatcacaaacgccattaaaaacgtgacgccgaacacatacccgctccatctctgcacatacccgcccgaatgggggctgatcgtttcgatatataacgaaagaaacggaacaatcatggtcatgctggcggaaataaagaaatttgtaatccaaatgacgacgaagttcttcttacggacagaaataacatcaccttctttaattttcgtgtgtctaatcattagtatataggaatgaatccggtatttgtattttcgatgcggatataggaaaattcattatttttagaaaatgaagaaagtttcagaggggaaactgatatactatcataaaatatcatttttgatcggaggaaaggcaggtgtaaaaaagtggatcagcgcagtctgctcattattgattttgaatttacgatgcctgacggaaaatacagcccgcaaaatttctttccagagattattgaagcggggattgtcaagacggtgaatgatgaagtgactgaaacgttttcgagttatatcaaaccgaaaaaatttccaaagctgacgaaacgatgcaaaacctttctgaacatcacccaaaaagacgtggacggcggaatcacgtttaatgaattcatccgcaaattaaatgagcttgatcctgataaaaactgcacgatcgtcacctggggcaatatggatatgaaagtgttaaagcaaaattgcatgtttaaccacatcccttttccgttcaaaggagaacttcgggatctgtccctagaatataaaaacttcttcggcgacagaacattgaccggcctttggaaagcggcagaagagtatggcgataaagggacgggcacgcatcataaagcgctggatgatgcgcggacgacatacaaattattcaagcttgtcgagcgggataaacaatatcttgaaaaaccgaaacctccgacgatcggtgatcgcgtcgatctgacagaactgtttcgccgggccacataaaaaaacccaatcatgccgactgggtcaagttcttttaaaatagtcacgctctaacgcagccaagttggcgagcgaacgttccgcccattctgagccgtccgctgtaagctgatctttcagccgggcagacgccgcttgtaaggaagccgtataatcaggaacttcgccatcaaacggtttgaccatctgatgcggtatgtttgtctgttccccgaatgcaagcgctcttctttcatgaaagaacggaacatccgcctgcttcggatgatgaagatctccttgagcgggatgcgtcagaacggctttaattttcactaaatagtgattgggcctgacgtctgtcacttcccctatgtatgctcctgttttataaaacccttttacgattgtgccgatttcaaacgaattcatagcgttcacctctctctagttattctataaaagatcaacgcgattggctagtgaacagctgccggaagcctgactgaagccgttgtgcccgagtgctcgccgctggtgaaatagacggagccttcatgatgctgaataatcgagaatgtcacggtaagcccgagcccggtgccattcgttttcagcgtataatacggtttgccgagtttctgcagttcttcatcggacatgccgattccgttatccgtaatctgaatgagaatcatctcttcctgtttttggacggagacctcgattcggccgttttcagagggcacggcttcaatactgtttttaatcagattaatgaaggcctgtttcagtttttttacatcgccgaacacatataaatcaggctcgctttgaacagtcacggtcaccgatttaaaattggcataagactccattaaggaacctgtttcctttacgagcagagaaatatcaaacttttctttttcatagtcatcctgcttcgccatatcgagataattcgtaatgatcgtctgagcccggtcgagttcggacagcacaagtttctgatatccggagtgggatttgtcctgaagctgctcgccgctgaacagcagctgcacaaaacctctgacgaccgtaagcggattgcggacttcatgggcgacgcttgccgcaagctcgctgacgacggccattttttctgagtgaatcagccttgcccgcatggacgcattctcatcaatgatctcaatcaaataaatgcacagcaaaagggcgctgacttgaaaaaaaacggatactgccgcctcataataaacggaagatagattttgaaaattgaaaatattggtcgcggaatagatgaagacagatgcggttaataaggcggtttcagtgcagccgatgagaagagcgaaaagcagtttcttccgctttgagaaaaaaggccatttcgtttggagctggatagggatgatgattaaaaaaggaattaaggataagaaaaaaagagcggaaggttcaaaccatatgagctgaaaaaaaacggatgccgcccctgcggcaagtcctgctgcggtaccggaataaagcaggcagacgataatgggaatcagctgcaaaccgtaacggacggaatgaagctcctggatgggaaaagccgtacataataaggaagatgacgctgcaaatacggcgaccagcaggcggttcgctctcggcacaagcaaatcgggcttgctgagccagaagacttgatagagaaaaatagggaataaaataaaagagaagtgaagcaggtaatcctttacaatctccatttatgcgaaatcctttcctatgtaaatatgaatctattataacatctttaccggcaaaaaaagtatttatttctctaaagcgaacgcccttatctcatctgataaaggcgttctttccgctgctaagagagcgctgctttcattctcttaagcccttcttttacggcggcggctgaacagccgacattaagtctcataaatccttcgccgcccggtccgtatttcgttcccggctctaatatgattttcccttttttgagcattctttctttgagctcggcatccgaaaatccgtatccgctgaaatccatccagatcaaataggaagcgtcaggtttcatcatgcggactttcggcaattcttttcttaaaaagtcctcagccaatttcatattcctttcaatgtaaggaatcagtgcgtcaagccaagggcctccctttgtataagccgcttcgattgctgcaaccgcaaatgtgttgaggctggaaatcccgttctgatgcaatgcggcggagaatttcgcccgcttataacggtcgggaatgataatggcggatgcctgaatgccggcaatattaaacgtcttgctcggcgcgacacaagtaatggaaatccgcgcaaactcctcagacagagaagcaaaaggcgtatgcggctttccgtacagcatcaagtcggaatgtatctcgtcagaaacgacggtgacgttatgagcggcgcacagcgatccgagctgcataagctcatcccggctccacgctctgccggacggattgtggggattacaaagaatcatcagcttgacctcagaatcgctcagctttttctcaagatcctcaaaatccatgcagtagacgccgttctcttcccgtaatgggttatgtaaaacctgccgtttgttttccttgatcatctgataaaaaggcgtatacaccggtgattgaatcaacaccggatcgcccggttcggtaaaggcttgtactgccatgctgattgccgtgacaaccccgggactgaacgtgatgcttgcgggatcgggccggtagccgtgccgtgtctcaagccatgaagcgacggcttctcttgtgttttcgtcaggagacgtataaccgaatatgccgtggtcaaggcgggcttttaaggcgtcagtgaccgcttcgggagcgcggaaatccatatcggcaacccacatcggaagtgcatccgatacgccgaataacgcttccgccttgtcccatttcaccgattgtgtgccaagacggttttctcgaagatcaaagttcatgtatgtcactcctgtagtatcattattttgcacagcgtatctatgataaaatagatttgcaaactttattataagcggtgatgaaaatggaagaaagccaagcggtcatggaaatgatgaaaatcattgccaagtgggacccatttaaatatggagaagatttttatgagacagaagccgtcgacatcgttcaggccgtctacagtgaagaccgtgccgacaagctggcagcagccattcaggatatctttgaagcttcatttgagcaaaagctaccgatcgaaggctgccaaaaggccgccgagcagcttctgttcataaaagaaagcagctcctgcaccccttaaaaaccggcggttccgccggttttttttattgaataaattcaaaaatccgttccgaaacaaactccgggcgctcttcgggtacgaggtgtcccgtatccttgagtgaatacagaatggaatccggcaggtcgtcatgaagccgttttccgactgagaccggaacgacccggtcttcttctccccatattaaaagagcggggttttgcactttcttcaaatcctcgggctctaaatcgccctccctgtgtctgatgaaccttgtcatcgctttgaaaatctggcggtctgtaaatggtttttcgtaaccgtcaatcatttcctgatcgataagcgtccggtcgtgaacgacatttaacaggtttttcagcacaccgtcttttgaaagccaatacttaagatacaggtcaaaacaagggaggtgcgtcccgaatataatcgacgggtgcgagcgctttaaataccccgagctgcacagcaggacgattttagaaaaaagctcgggtctgagaagagacgcggataaggaaatctggccgcccatcgaatggccgatgagtgcggcccggctgataccgagcttttccagaagtccgatcagaagcttggcgaggtttgcgtaagtatatacgaaagtccgtgacttttccgattgcccgaaaggaggcaggtcaacggcgataatatcataatggtttctgagcagcgggatcagttttctgaagctgaatgccgaagataaaaaaccgtgtacgcagacgagtgtctgtctgccgggattttcataatgctcgtaatacagttcaactccgtctatcgcggcccgtttaatcggtgaaacagcttccatgagagccttcgccgtcctttctttgttgtaatgtaaaggcttttttgattgtcagattttagttctggtttctttcgggtttttcttagcatttgtcgaaaatcgtgatataatgtcatgaagatttttgataatgcaaaggtgtgaaacgtatgaagctgacggaaaaagaaacagaaatattagaaattttagacgaaaacagccgcgttgatgcggaaacgatcgcgaaaatggcgaacattcccgccgaagaagtcaaaagcatcattgaaaagcttgaaaaggaaaaagtcatcattgattatgcggcgatgatcgactggcgcaaagtcgacggtttggaaggcgtcacggcgatgattgacgtaaaagtcactccgaaacgaaatgtcggctttgatgaagtcgctgaacggatatacagattccaggaagttgaatcagtgtacctgatgtcaggggtgtatgacttatctgtcgttattcgcggcaacacgatgtcagacgtggcaagcttcgtgtctgaaaaattgtccacccttgagtccgtcgtttccacgacgacgcactttatcctgaaaaaatataagcatgacggcaaagtctttgaaagcggagacgatgacaaaagaatcgtggtgtctccgtaaatggaaacgaagacttcttatttatctgactacgtgcagcagattaaaccgtcaggcatccgcaaattctttgatctggctgctacgatggaaggcgtcatttcactgggagtgggagagcctgactttgtgacggcctggaacgtgagggaagcgagtattctttctttagaacagggttatacggcttatacggcaaatgcgggtctttatgaactgagagaagaaatcagccgctatttagatcagcggttcggcctgagttattcgcctgacagtgaactgattgttacggtaggggcaagccaggcgcttgatctcgctgtccgcgccattatgaatcccggagaggaaatgttaattcccgaaccgtgttttgtcgcatatgaatcactcgtgaccctgacgggggcgaagccggtgccgattcagactgtagctgcaaaaggtttcaaagcatcagcagccgattttgaagcggccctgacggacaaaacaaaagcgctgcttctatgctcgccgtcaaatccgactggttccgtctattcgaaagaagagcttgaatccatcgcttccttcgctgaaaaacatgacttgatcgtgcttgccgatgaaatttatgccgagctgacgtatgatgagccattcacgagcatgggagccatccgcggcatgaaggaacgcacgattttgatttcaggtttctccaaagcgtttgccatgacggggtggagactcgggtttacggcggcgcctcccgtgatcagggatgccatgctcaaaattcatcagcacgcgatgatgtgcgcgccttccatggctcagtacgcggcgcttgaagggctgaaaaacggtcaggaagacgtcgaaagaatgaaaaaaagctaccggagacgccgaaacctgattgtggaaacattgaacgaaatcggactcggctgccaccaccccggcggagcgttttacgcctttccttccattcagtcgaccggcatgagttcagaagaattcgcggaacagctgctcattgaagaaaaagtagccgtcgttccggggaatgtattcggcccgagcggcgaaggctacatcagatgttcctatgcgacatccattgagcagattcaggaagcgctcgtcagaatcaaacggtttgttgaaaaaagggcataaaaaaagatacgaacccggttcgcatccaaataaaagggggggaatactagaaagccttcgtaatcatagtataccccctttatctgcgcttaaacatgatgatgtaaaaaagttctctttgcgaaaaacaaacttgtatgatataattttaaattgcgtataatctgtatttaatttaacttaggagttgttatgaatggcagcaaaatttgaagtgggcagtgtttacactggtaaagtaacaggattacaagcgtatggtgcgtttgttgcattagatgaagaaactcaaggacttgttcacatttctgaagtcactcacggtttcgtaaaagacattaatgaacacctttctatcggtgacgaagtacaagtaaaagtacttgcagttgacgaagaaaaaggcaaaatcagcctttctatccgtgcgactcaagcggcgcctgaaagaaaagaaagcaaaccaagaaaaccgaaagcggcacaagtttctgaagaaacatctgctccgcaaggtttcaacacattgaaagataagcttgaagagtggattgaacagtccaaccgcaaagaccttatcaaaaaataaccatcaaaaaaagcaccggatatgtatgttcggtgctttttttatgtttatctgacttccggatttgccgcttcctcgcgggatgtttcttcgttcggcttaaacagcaggccgagattgatcagaccggcgatgccgacaagaccgtaaataatccgcgacagagctgatccttggccgccgaagatggctgctactaaatcaaattggaaaaatccgatcagtccccagttaatagcgccgataatcgttaatacgagacagatacgctgaataacactcatgtaaacaacctcctctataaattcgtgaaacagttatagattgtgacaaagcaaagaatctatgcatactacattctccgccgtgtaaatcacacactgtctcaagctgtacaagtgcctttcccgggaaaccgctgtctgtaaaccgtgtgatgtgccgtcaaaaaagcggattgctttacattgaacgtcaactttctgcataatataaatccaaaggaggagatgtcatgcaaaactttacatattggaatccgaccaaattgattttcggaaagggagaggtcgaaaaacttcctgaagaaatcaagccgtacggaaagaacgtactgctcgtatacggaggcggcagcattaagcgcagcggtctttatgatcaagtaaccgacctgctgaaaaaagcaggagttaccgtacatgaattggcaggcgtagagccgaatccgcgtgtctcaacggtgaacaaaggtgttgcgatctgtaaagaaaacagcatcgatttcttattggccgtcggcggcggaagtgtcattgactgcacgaaagccatcgcggcgggcgctaaatatgacggcgacgcgtgggatatcgtcacgaaaaaacaccagccgaaagaagcgctgccgttcggaacagtgctgacacttgcggcgaccggttcagagatgaactccggatcagtcatcacaaactgggagacacaagagaaatacggatgggggagcccgctcgtttaccctaaattctctattctcgatccggtaaacacatttaccgttccgaaagaccacaccatttacggcatggtcgatatgatgagccatgtgtttgaacaatatttccaccacacgtcaaacacgccgtatcaggaccggatgtgtgaatcgcttctgcgcacggtgattgaaacagcgccgaagctgatcaacgatctggagaactatgagcttcgtgagacgattttatatacaggcacgatcgcattaaacggaatgctgtcaatgggcgcaagaggggattgggccacacacaacatcgagcatgcggtatcagcggtatacgatataccgcacgccggaggtttagcgattctgttcccgaactggatgagacatgtgctcaaagaaaatccggcccgctttaaacagcttgccgtccgtgttttcgatattgacgagacaggcaaatcagatgaagagatcgcacttgaaggaatcagcaggctgtctgaattctggacgagcctcggcgctccgaacagactcgctgattacgatatttctgatgagaagctggatacgattgcagataaagcgatggcaaacggagcattcggacagttcaagtcactgcagaaagaagatgtgcttgcgatactgaaagcatcattgtaataacataaaggggggcggccggattggcagctcctttttttctgtgttatagtaattcccttacgatttttttggaggtcatgataaatggagaactttacgtactgcaatccgacgaaactgattttcggaaaaggtcaaatcgaccaattgaaaaaagagctgaagcaatacgggaaaaacgtgctgcttgtttacggaggcggcagcattaagcgaaacggcctgtatgaccaagtaacaggcattttaaaagaagaaggcgcagccgttcatgaacttgcgggcgttgaaccgaacccgcgtctggaaacggtaaataaaggaattgagctgtgcagacagcatgagattgatttccttctcgcagtcggcggcggaagtgtcatcgactgtacaaaagcgattgcggccggtgcgaaatatgacggcgacgcatgggacatttacagcaaaaaagtaacggcgcaggacgcgctcccgttcggcacggtgctgacgcttgcggcgacaggctctgaaatgaaccctgattccgttatcacaaattgggaaacaaacgaaaaattcgtatggggcagcaatgtcactcatccgcgtttctccattttagatcccgagaatactttcagcgttccggaaaaccaaaccgtatacggcatggtggatatgatgagccacgtatttgaacaatacttccacaatgttgaaaacacgccgcttcaggacagaatgtgttttgcggtccttcagacggtaattgaaacagcgccgaaacttttggaagaccttgagaactataagcaccgcgaaacgattttatacgcgggtacgatcgcattaaacggcacgctgcaaatgggctatttcggcgattgggcttcccatacgatggagcacgccgtatcagcggtttatgacatccctcacgcgggaggacttgcgattctgttcccgaactggatgagatacacgcttgatacaaatgtggaccgttttaaaaacctcatgcttaatatgtttgacattgatactgaaggcaaaacggataaagaaattgcgcttgaagggatcgataaattgtccgcgttctggacaagcctcggcgcaccgtcccgccttgcggattatgacatcggcgaagacaagcttgagctgatcgcagacatcgccgcaaaagaaatggaatacggcggattcggcaatttccaaaaactgaacaaagatgatgtacttgccatcttaaaggcgtcactgtaagatacattcccggccggagtgattttcaagctgcagatgtaaccgttttgggagtccctctttccggattttctattagttcattaggagcaagtgaaacacccttttccatgagacaactatggaaatcgtttcatccgtaaaggaccaattaactttgcgattgtctgtcatctatttacacgaaatctaaatcacgaagatgaagagccgcgaatttaaaaaaggggcgctgattcaatcagcgctcctttttatgcattttgtgtactaaggtcccgctgcgcccccatatagcttcccattaagttttgataaccgggaagatgactggagactaatgcgccaaaaccttcaacatcgttgcgccaatcacgctgaagctcgcatgctgtgctgaaccagttcataagctgcacgccgccatgagccatacgggttaatgatgcatctgctacttgcttattaaacgtccccgaagcatctgtcacaacaaacacttcgtagcctgctttaatggcagaaagcgcaggaaaagcaacgcagacgtctgttaccacccccgcgataatcagctgttttttgccggtcgcttcaatggctttaacaaagtcttcattgtcccatgcattaatttgtccgggacgggctatttttggcgcatcaggaaagagatcaacgagttcttgcatgagcggtccgttgggtccattttcaaagctggttgttaaaataaccggtaaatcaaagaatttagccgtatcaccgagagccaatacattgtttttaaattcatcaacgccatagtcacgcacgagaccggaaataaggccggtttgatggtcaactaaaagcacggcagcatcatcttttgaaagacgggaataaagatcagacattttatcatcctccttgaattaaggcaagtcagtttgtcaatggaaaacggtaaatctattcatatactgtataggtagaaagttatttctgaagtgacttttcgtgaaggtgatgatctttcaattaatccggaatgggaaccggagcatgatcaatccaatggatgaactgttgtaaatagcgttgaagataacgttttgtttgttcatccgtaagtatgtgttgagcggaatcaattttctcatggacttgcgaaatcagcattttttgaaagggcagaacattgacttgcatagcttcgagtacttctctcgtttgcatttgaccaaaagaggtgccgaaccctccgggggttgcgccgattaagccaaccggttttctgtttaaaacggaagaggtccgcggtcacgatgcccagtccaatgcattttttaatacccccgggattccggaattgtactctggacttacaatgatgacgccgtcaacgtctcgtatatcagctctaaaggatgttacggagtctggtgctccggccatttctaaatcttcgttaaaaaaaggaagagtgtctatttcaacccagcgaaattgagccgcattatcgaagtcaatcaatgattgagcaatcactcgattatacgagttttttcgtaaacttccacaaataagaccaatggttttagtcaaagaatcacctcccggtttaaaattattttcatcttaacatgataacccaaatatagacactatttttaaaaatggacatttataccttaatatgcctgcttagcagcctctcaagaggagtactatataaaaagaaccgtcccatcggtattggcgatggatgtcaacctgctccaaagtaaaggtgatacgttcctggatcaccaacattcgattcgttacctctttcacgattattacaaatataactatttcgaatccgggatattgtataaaaaatgagcgcatcttcagcgcaaatcccgtattcatcatgccttcttcatgacttgatttagcgggtgagttcatataaagtgaaagagaaaacaattcaccgtgatggagggacaagcaaatgacgcatgtacgctttgattactcaagagcgttaccttttttcaatgaacatgaacttacatacgcacgtgatttcgtaaaaacggcacaccataatatccatgaaaaaacaggcgccggaagcgactttttaggctgggtggacctccctgaaaactatgataaagaagaattcgcgcgcattaaaaaaagcgctgaaaaaatcaaatcagattctgacgtgcttctcgtcgtgggtatcggcggttcatacttaggcgcccgcgcggcgattgaagcgctcaatcattctttctataatgttctgccgaaagataagcgcaaaaaccctcaagttatctttatcggcaataatatcagctcaacttatatgaaagatgttatggatcttttggaagacgctgatttctctatcaatgtcatttctaagtcaggcacgacgacggaacctgcaatcgctttccggattttccgcaaacttcttgaagaaaaatacggaaaagaagaagcgaaagcgcggatttacgcgacaacagataaagaacgcggcgctttaaaaacgctttctaatgaagaaggcttcgaatcattcgttattcctgatgatgtcggcggacgtttctccgttctgactgcggtaggccttctgccgattgcggtaagcggggctgatatcgatgaaatgatgaaaggcgctcttgatgcaagcaaagacttttccagctcagaattagaagagaacgcggcttaccaatacgccgtcgtccgcaacgttctgtataataaaggcagaaccattgaaatgctcatcaactatgagcctgcgctgcaatactttgctgaatggtggaagcagctcttcggcgaaagtgaaggaaaagacgaaaaaggcatctatccttcttccgctaacttctcaacagaccttcactctctcggtcaatacgtgcaggaaggcagacgtgatctgtttgaaaccgtattaaacgttgaaaaaccgaagcatgagctgacaattgaagaagcggaaaatgatctcgacggcttaaattatttagccggcaaaacggtcgatttcgtcaacaaaaaagcgttcgaaggcacgatgcttgcccatacagacggaaaagtgcctaacttaattgtcaatattccggagcttaacgcatatacatttggatatctcgtttatttctttgaaaaagcggtggcgatgagcggttatctgctcggagtcaacccgtttgatcagccgggtgttgaagcctataaggtgaatatgttcgcgcttctcggcaaaccgggctttgaagagaaaaaagcagagcttgaaaaacgccttgaaaaataaaaagaagggctggccctcagcatgacgggtcagccttttttaaaccgtgaaaggtgtgatgatgaattgatgcggcttttatgtaagcatgtcttcatttccgtctgttccgccgctatcgtctattcggcactaaaactgtctcccgaatccctcttgcaaaccatcctgtttttcgctttccctctcggcttgtttacggacatggtccggctgaaactgaagattggccggatgcatacgctgatcacgaagtgctgtctctatgccgccgttttctatatttcaacggaagccgctctctccgcaattgtgacgtatgttctgattgaatgcgccgtcacctcttttcagcgtctgtctgccgctcccggttcttcccggacgccgtatgaagataccgcagagcggggacgctaaagacaaaaaggagcatatgcacatgatcagcataccatcttcacttgaaggtcaatcgtttttactccgcgaactggaacaggtgatgaaaccgatcggttataccatcggaggcggctgggagtatgaccgcgggttctttgattacaaaatttccgatcaggacggctatttatttctccgtatccctgttgaagcaaataagggacacctggatgaacggggggccgccgttacaatcggcacaccctttttgctgaggcacgtttatcagcaggaaacggatgatgcagcaggcggcggtgtttttgagtcattattcaaccaattctccgaaccgaaacggcgggatgcggcaattgaccgctcatatacagatatcggcatctcgcttgtgaaagagctggaagacgtcctgctgcattaaagagccaaaaacagatcagtatcgagcacctggtatgacaggggaggggtcagcatcggcccctcttctttttgtatgccgatgatcgtggtattccgtctgagataatagagcgcgcagtcatgataagatgagccctttagttcctcggggacgggaatgatgcgcacctttttctccagcgtcagatctgacagcgtttgcggtttggcaagctgcagcttgacccggtaatgctcaaacatcacccggctcgacaggtgtgatgtgcacagaatcttattggctcctgcgcgctcggcgtttttgacataccgttccgttaaaatttctacgatacaataaacagacggatgcagccctttgatggcgagaagcgttaataccgacagcatatcagcttcggattcatttttctgctggtccgctgtcagaatgacggtatcagcttccgtaatattcgccttattgagcgtgctgtcatcagcggcatgtccgcggatgaaatggacgttttcaataagcggaccttcccttaatgaatcatcaatcaggacgacagtttttgacggtgcgatgtgctgcagctctttcagcagcatatgcgatttttcgttccatccgataagaatgacgtgccccttgcctttaaaggcgaccttcccttcgacatagcggtgctgtttgctgaacacggctgaagaaagcgtggcgaaataggcggtcacaaaactcgctccgcttaatacaagcaccatgccggcaatctgcccgagcggcgtctgcggaacgtaatcgccgtagccgactgtggccaccgtaatgaccgcccaccaaaccccttcaaacacagacgtgaattgcttcggttcgagcatgtaaatgagttggccgaacaataaaatcaaggcgataatgatcagcccgatccgaacatataacggccatctcagccaggaaataaaaatacggtttgatttcattcgtccggctcttctttcgacagagagatggataaaatctgcttaataatggtgtttagtttttcgtccagctgttcctggccgtatgagtcacgcgcatgtctgattaaatcggccgtctcatcttcaaactgaatgagaggttcgtcgttttctgattcattatagagctggatgaaggcgtcaagcccttcgttcattctgtctatcgcattgctcagctgttctttctcgccatttgtcactttcatgtcgatcacacctgtatctttttttatacagtatgtcccagttcgtttgatgtctttcaaaaatcgccgaaaacatattcacccttattttttcatatgataaagaaagcggaccgaaaaagggtgagtcaaatgacggtcattcaaaaactgttggcggcgctggccggagcgcagctgcttgcttcggcggccgtattgcttattttcgatttgaatggatacaatcacatgtccggcggattttcatggcttgtttttgcaaaagagaccgcaggcacgtttccgttttacatcggaatggccgggtgtatcctcatcatgctcggaggattgattcctgtcagaaaaaagaagcggatttctgtacaggaaagcgggcaatcattaaaataatatataagcagatcgtacgatataagagaaaaaggaagaggataatatgctgtttatctttttaacaattgctgcattgggtttgtcgttttgggcacaatttaaagtgaaaagcaattttcagaaatactcagacgtggaagcctccagtcagcggacgggggcggaaacggcaagacggattcttgatattaacggtttatatgatgtgccggtagaaccggtaagaggcactttaacagaccattacgacccgacggagcgggtggtgcgtttatctgagccggtatattacggccgctccatttccgccatttccgtcgcttcccatgaagtcggacatgctttgcagcatcaggaatcatacggcgcgcttgtgctgaggcacaaaatttttccggtcgtcaattttgcctccggggtcgcccctctgcttttcttgggcgggatgctcctgggcagcttgaacttaatcggactcggcattattttgttttcggccgctgtttttttccagcttgtcacactgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaatggtcgtgatgagaattaacacgaaggaggtggccccttaccgtttgcggtaggggtttttttgcttatattaaaactgattctcattatgctgttaatcggattaacggccatctttgtcgctgcggaatttgcgattgtcaaaatccgcggttcaaaaatcgcggagctggttgaaaccggagacagccgggcgctcgcggcgcacagggtgatttcaaatctcgatgaatatttatcagcgtgccagctcggcattacgattacggcgctcggactcggctggctcggtgaaccgacgattcagcggcttcttcatcctgttttcagcctgatcggaatgccgtcatctattacgcacgtcgtcacgtttattgcggcgtttatcgccgtcacgtatctgcacgtcgtcatcggagagcttgcgccgaaaacgatatccattcaaaaagccgaagctgtcagtctgtggacggcgaaaccgctcattctgttttataaagtgatgtatccgtttattaagctgttaaacggctcagccggatttttggtcaagctgttcggttttcattcggtgaaagaacatgaggtcgtggtcagtgaagaagaattgcggctgattttgtccgaaagctataaaaaaggtcaaatcaatcaatctgaattccgttacgtcaataaaatatttgaattcgataaccgggtcgccagagaaatcatggtgccgcgcaccgaaatcgccgtcatctcgcttgaacagtcagttgatgaagccatacatttgatcatcaacgaacggtatacgcgatatccggttattaaggaagacaaagatcacattctcggcattattaacaataaggatttatttaaagcgtattttctcggccgctccattgaattaaaagaaatgatgcgtccggtcatcagagtcattgaaagcatccccgttcaggagcttttgatccgcatgcagaaggagcggattcatatggcgattctcgttgacgaatacggcggcacggcgggacttgtgaccgtcgaagacatattggaggaaatcgtcggggaaatccgtgatgaatatgaccaggatgaaatgccccacatcgtcaaaaaaggcgaacaccattatgtgatggacggcaaggcgctcatagaagaggtgaatgatctccttgatatcgccatcgaaaatgaagacattgacacgattgccggctggctcttaacacaaaaaatggagctgaaaaatggtgatgtgtttcatgccgaagggtgtgaatttaaggtgctggaagcggaagaccatcatatccgcttcgttgagattaaaaaaactgatttctgagcctcctgcttttgcaatgaggctttttttatggaaaaaatgcttcttcgtcccgctccttcatatgctgtaaagaaaggagtgtcggtatgaaaacggattggtggaaaacggcggccgtctatcaaatttatccccgaagctttatggattcgaacggggacggaatcggcgatattaacggcatcagagcaaagcttcattacataaaagagttgggggcggatgtgatctggctttgtcccgtttttgactcgccgggcgcggacaacggctacgatattcggaattataaacaaattgccggcgaattcgggacgatgaaggattttgaccggctccttgcggatgtccatgcgctcggcatgaagctgattatagacctcgtcattaaccatacaagcgatgagcacccttggtttatcgaatcacgctcagcgaaagattccgaaaaacgggactggtacatctggagagacggaaaaaacggcaaagagccgaataattgggaaagcattttcggcggatcggcgtgggaatatgatcaagagaccggccagtattacctgcacctgtttgacaaaaaacagcctgatttaaattgggaaaacgaagcgatgaggcagtccgtttatgagatggttcgctggtggcttgataaaggcatagacggcttccgggtggatgccatttctcacattaagaaaaaagaagggctccctgacatgccgaacccggacggtctcccgtacgtcccgtctttcccgtatcatatgaatggggaaggcataatggatctcttaaaagagctgaagcgggaaacattttcgcgctatccgatcatgacggtcggcgaggcgaacggagtggcggcttgggaggcggctgattgggccggtgaagaaaacggcgtctttcaaatgatttttcaatttgaacatctcggcctctgggatacggaagatgatcaaagcatctccattccggcgcttaagcgcgtcttgtccggctggcagtacagccttgaaggaaagggctggaatgcgttatttatggaaaatcacgaccagccccgttccgtttcggtatggggtgacgaacggtttttgacagaaagcgccaaggcactcgccgtgatgtatatgctgatgaaaggcacgccgtttatttaccagggacaggagctcggcatgaccaatgtttcgttcccatccattgaagattatgatgacgccgcaattaaatatctgtatgaaaaagagacgtcccgcggcgttccgcatgaacaagtgatgaagatcatctggaagaagggccgggataattcacggacaccgatgcaatggagcggtgaggcgaacggcgggttttctgatgcttctccgtggctcggagtgaatccgaaccacacatggctgaacgctgcatcacaattgcaggatgaaacatccgtataccatttctacaaacggctgctcgccctcagaaaaaaacacggcgtattgatcagcggcacatatgaattgctgcttccgaatgaccggcagatttatgcctatctaagaaaaaacggaacaaaaaccgccctgatcatcaccaatctgtcccgaacccccgctttatacaggcatcccggttatccgcttgactccgattctctcgtgcttgcaaacgcggaaacagaatcgcaccgccatgtgacatccttcctcttaaagccttatgaggcccgcgtatatatatggtgaaaaacttcagtcccgaggctgaagttttttgtgatctgtgtttatcatcgcgatccgacaggaaaagacaaatacagaaacgaatatgggaaaggaagagaaaaagaaaggaggcattcatatgctgaaaaaattgcagattcaaacaaacaaaagggatgaaatgatcgacatcacacatgaagccgaatcgtttctccgcgaaacaggcgtaagaaacggtttggcgctcatatactgtccccataccaccgccggcattaccatcaatgaaaatgccgacccggatgtgaagagggatatgctcagaaggtttgatgaaatgtatccgtgggagcacgaactggaccggcatatggagggaaatacggcggcacatatgaaagcgagtacaaccggcgcctctcagcatgtcatcatagaagacgggcgcctgatactcggaacatggcagggcgtttatttttgcgaatttgacggtccgcgaaacagaacatgttatatcaaaatactggctgaaacggaggaaaacaaatgagtgagtggatgagtccgttatcattaacaaagcccgtcattcaggccccgatggccggcggactggtcacgccgcgtctggcttcggcggtatcaaatgaaggggcgctcggaagcctcgcttcaggatacgtcagcccgcaagcgcttgaaaaacagcttatcgagatgaaagagctgacggaccgctcctttcaagtaaatcttttcgtcccggaagaaagacagatgcctgaggcggaacttgttgaaaaatggaaagcccgcattccgagggcaaaagacgccaagccgttctctgatctgaaagaagaatggaatgatttcgcggaaaaagcggagcttctgatccgttacggagtcaaagcgtgttcattcaccttcggcctgccgccggaaaaaacggcggaaaagctgaagaaaagcggttgtttccttttcggcacggcgacaacgccggaggaagcgaaggcttttgaagaacggggaatggacgccgttatccttcagggaatagaagccggcgggcatcgcgggtcgtttctgccggttaaaggagaaccggctctcggccttatggcgctgattccgcaggctaaagacacgctgaatatcccggtgattgcggcaggcggcatttttgaccgccgcggggtgcaggcggcccgatgtttgggtgcggacggcgttcaagtaggaacaccgtttctcctttgtgaagaaagcagcgcctcaccggcatatcaaaaagccattgccgaatcaaaaggagccgatacgcggctgaccaccctgttttcaggaaaacaggcgcggggaatcgtgaatcagttcatgaaaacatatgaagctgacgagggaaaaacgctgccttatccgctgcataatacgctgacaaagccgatgcgcgggcacgcggctcaatcaggagacgcggagcatatgtctttatgggccggccagtccgccgcgaaacttgaggggccgacagacgtgaaaaccgttttggacagattgtgcgaatcataatccagaaatcgtgaggtgatggatgatgaagattcttcaaatgtcctataaaaaaagagggactattgagtttgtctttgaagattttccgcattccaaagtcaccatggcgccgattaaagggtattactttgtccgcgccattaaatggagcagacgggacagagccgtcacccgccatgatttagagaagtttgaatgggctgcaaaccaagcgctcggcacgacggctttttaccggaaaagaaaagcatttcacatcccatcgtcacaatgacagacgatgggattgttttaatgcatgatctgataaagcgcgggtgcatcaagccttgttgcctggttaagcagataagccggctgcacggcatttttttttcttaaagaattcaatctctggatgatttgttcagcggtcagaatcccgagaccgtgggcgaaatattgatcattccccatcacaatgacattttctccccgccactgagcctttgcagggttaaaatcaggatttttaaaatataaacagtctccccgtaaaaagtggctgccggtttccgtgtagatcggcagatgctcatagtgccagtcatacaaagtgatatcccggaaacgccggttaaaccgttcttcaccgattgtctttaagacggccagataataaattacaacaatggcggtagcgcattcaaatgcgtaaaacgccccgttttcaataatatcccgaatcgcttttgaagcgggaatcctgtacttcagctccagggctccttccggcgtcagtctccaataagccgtatttccgtatgttttggcgaaagttgcaaatttcacacctgatccgtgcagttctcttgcggcttccacaatatggcggcgcagccgcacctcgaacatcagttcagcaatcgacccgtaatcgaattgtacgggagaattgagcagttcatttatatacggaacaaggctttcttccgtctgccagttcgcgatgtcctgaggccgaagcacttggccggatatgataatcatctgcgcgccccctatctttttttataagatatgcaggaagcttgggcaatgaaaatcaagtgataaaaaaggaggaaatgttaacaaaatgtgaagactgagccgatatataaggtatcacacttgagggagcagcttaatatgaaaaaattcattaattggtgcacaaaggcatcgatttcacggaaattaatcatttcatttatcgtgatcttaatcataccgattctcgtgttagaattcagttcataccatacggcgagcaattcgctggatgatcagatttcaggtaacgcgaagaataacatcgaatcttttaacacaacgattacaaatgatatcggcgcaaaagcaaaggcgattgaatttttcagtgaaacgttaaaaggatcatccttctcaaagaaaaacatgtctgctcttgaagaaaagttcgggcaatacacgtctattcataaggacgtagcccgcatttacggaggtacggaagacggcagctacgcacaggcgccgaaagaaaatactccggccgattacgatccgagaacacgcacttggtataaagacgctgtgaaggccggcggcacgctcgttgtcaccgacccttacaccgcggcaagcgacggcagcatggtcattaccgtggcaaagcagatgcaggacggaacaggcgtagtggccatggatattacgattgaccagctgctgaagcagatgcagggaatcaaaatcgggcaaaaaggattcgtgtttatcacgtccaaaaataaaacctatgtcgcgcataaagaccacaaaccgggcgataaagtttcaaccccgtggctgaatgaggtatacagcaaagacagcggcattatttcatacaagctcgatgatcaaaataaaaaaatggcatttacgacaaataaactgaccgggtggaaaatagaggggagcatggagctcaacgaaattaaagacgcctcacaaccggtgctgacgatggggatgattgtccttgcagcatccattatcatcgggggaattttaattctgttgattgtcagatccattacgtcaccgctgaaacggcttgtccgctcttctaaacaaatcagcggcggagacttgactgaaaccattgatatccgctcgaaagatgaattgggcgaactcggcgcgagctttaatgaaatgggagaatctctgcgcggactgatcagcgcgatccaaaactctgtcgataacgtggccgcgtcatcggaagagctgaccgcttcagcttctcagacaagcaaagcgacggaacatattacaatggcgatcgagcagttttcaaacgggaacgaagagcaaagcgaaaaagtcgatgcaagctcagccaagctgaatcatataaatgacggactcgccgccgtttcccgcacatcatcatccattacggaggcatctaaacaatcgaaggaagctgccggcaccggggaagaatatgtgcagcaaaccgtcgggcagatgaatctcatcaatcaatcggtccagcaggcggaagcggttgtaaaaggccttgaggccaaatcaaaagacattactcatattttaagagtcatcaacggtattgccgatcagacaaacctgcttgcattaaatgcagccattgaagcggcaagagccggtgaatacgggcggggcttctcagtagtagccgaagaagtgagaaagcttgccgtccaatccgccggttctgccaaagagattgaaaaactcattcaggaaatcacggctgaaattaatacttcgcttcacatgtttacatccgttaatgaagaagtgcaatcaggacttgccgtaacggatcgcacgaaagaaagcttccagaatatcttcggcatgacgaacgacatcgccgaaaaactgcaatcaatgaacggcacggttgaacagctgtcagacagctctcagcacgtttcagccgcagtgaccgatattgcggacgtatcacgggaaagcgcagcaagcattcaggatattgccgcatccgcagaagaacagcttgcatcaatggaagaaatcagcacatccgccgatactttggcgcaaatggccgaagaactgcgggaattaacgaaacaatttaaaatcaactagtaaaaaaggacgctttccaggtggaaggcgtccttttttatagtgacagccggataattaaataaaaagtcttgcatacaaagggagtacatagaactatttttcatttatgacttaattttcaatgtaataaaaagggagtcggccgatataaacagtaaatgattgaaagaggtttacaaaattgaaaaaaacagcaaaaaaaatcgccagaaaatcaatagccaaaaaacttatcatttcatttttactgatcttaattattccggtagcagtattggccgccggcgcctaccgttcggcggcttcatccgttgaaaagcaaatgatggaaagcgccgaaggaaatgtgcaaatcttaaacaatatgattgatgaccggatcggaatgtttacaaaaagctctgcatatttcagcgaatgggcgacaagcgctaaatttaaagaaaaaaaccaaacggaaatgcaagaaaggttcaaacagtttattgaaagcaatgataaagcgtccgccatattttcaagcagcaaggaaggaacgtttacccgttatccgcatgccgatatgccggccgatttcaatccgcttgaaagaagctggtatcaggaagccatggagaataaaggccaaaccatcatcacggacccttatgagtccatctcaaacaaaaagatggtcgtcaccatggcccgcgcggcgcaagacggatcaggcgtcgtcgccattgatataaaaatcgacgatctcatcacgatgacaaaagaagtgaacatcggaaaagaaggatacgcctttatcctcagcaaaaataaaaaagccgttgcctacagtgatgaaaaagccggcgcggcggtatcgggaaaatgggttgatacattatacagcgggcaaaaaggcgactatgaatatacgctgaacgggaaagcgaaaaaaatggcgtacgtgaccaatgaagcgacgggctggaagatcagcggaaccatgtccgtggatgaaatcaaggatgcggcaagaccggttctgactctggccgttatcatattggcgatagccgttgccgcagggatgattttcatttattttgtcatccgctcaattaccaaaccgttaaaacgtctcgtagcttcagcggaaaaaatcagcagcggagatctgacggaaaccattgatgtcagctctcaagatgagctcggcgtgctcggtaaaagttttaatcatatgacagattcactccgttcgcttattcagggaattcaggactctgttgaacatgtcgcttcttcctcagaggagctgacggcttcggctgagcagacgagcaaagcaacggaacatatcacccttgcgattgaacagttttctaatggaacggaagaccaaagtgagagtattgataaagcgacagcacaagtgaatgagatgaaagacgggctcagcgatctggcggaagcggcagccgttgtgacggaaacttcaattgaatcggcggagatatccggcgccggtgagcggcttgtcaagaaaacagccggccagatgggcgccattgaccaatccgtaagtaaagcggagcaagtcgtacaagggcttgaactcaaatcgcaggacatcaccagcattttgcgcgtcattaacggcattgccgatcaaacgaatctccttgctttaaatgcagccattgaagcggcaagagccggtgaatacgggcggggcttctcagtagtagccgaagaagtgagaaagcttgccgtccaatccgccgattcagcgaaagaaatcgaatccttaattcatgaaatcgtcaaagaaattcatacttcgctcggaatgctggaatccgtcaatcacgaggtgaaaagcggacttcagttaacggacgaaacggaaaaaagcttccgggacatttccgctaaaacaagtcagattgccggtgaactgcaaaatatgaatgcaaccgtggaacagctttctgccggatctcaggaagtatcaaacgcttcagaggatatcgcggcagtctccagacaaagcgcggccggcattcaggacatcgcggcttcagctgaagagcagcttgcgtccatggaggagatcagttcctcagccgtcacgctggaaaaaatggcggaagaattacgcgaactgacaaagcgttttaagataaactcttaattaagtctaaaagactaattttgcaataggtaaaaagtatgtttcgttatatttcttctttttggatgtgtatatttacccataattgccgatatgaagggtaaacacgcaagaggagatatagcagatgaaaaaaattgtgcaaatcatcaagcagagatcgcttacaagaaaactgctcctttcttttttggccattctcattcttcctatttcaacgctggcttttatcgcctatcaatcggcggtaagcacgcttgacaggcagatgatgggaagcgcactagataatgtgcagcagattaacgatatgatcaacacaagcatcagccaaaaggaagacggaacggcatatttcagcgactggctcacaaaggatcggtacaagccgaaaaaccaatcgcaaattaccgataaattcacagagtacatgaagattaataaagacgtggaatccatctatacgagtgacacggaaggacatttcacacggtatccggatctgcagatgcctaaaggatataatccgcttgaaagagactggtataaaaaggccgtggaaaataaggggaaagttgttgtaacagatccttaccgcacggcttctaccaatacgatggtcgtgacggtcgttcagcagacgaaagacggctcaggggtcgtcgccatcaatatgaaaatcgatgagcttctgaaaacgacaaagaaagtgaacatcggaaaatcaggctacgcttttatcctgacgaaagacaaaaaagtggtcgcccacccgaaccgtgcgtcaggcacagtactaaacggggagtgggctgaacagctgttcaccagcaaaaaaggtgattttcaatacaaatacgacggccaggaaaagaaaatggcttatgatacgaacgggctgacaggctggaagattaccggaacgatgtatctggacgaaattcatgaagcggctttgccgatccttcatctgtccctgctcgttctcgtattagcgattgtcatcggaaccatcgtcatggcgctgattatccgttcaatcacaaaaccgctcaagcagcttgtgacatcatcgaaacagatcagtgaaggcgacttaacagaaacgatcgaaattcagtcaaaagatgaattaggcgagctgggcaaaagctttaacaatatggccgcttcactcaggtctctcatccatgccattcaggattccgtgaataacgtcgcatcttcctcagaggagctgacggcttcagcggagcagacaagcaaggcaacggaacatatcacactggcgatcgaacaattttctaacggaaatgaaagccaaagtgaaaatatcgaaagcgcggcggaacatatttatcaaatgaacagcgggcttaaagatatggcgaaagcatctgccgtcattaccgaatcctccgccacatcagcggaagtcgccaattcaggcggaaagctcgtccaccagacggtcggccaaatgaacgtcattgaccggtcagtgaaagaagctgaacaagtggtgcgcggacttgaaacaaaatcaaaagacattacaaacattctcggtgtcattaacggaatcgctgatcagacaaaccttcttgcgctgaacgcggcaattgaagccgcgcgtgcgggtgaatacggccggggcttctcagtcgtcgccgaagaggtcagaaaacttgcggtccagtctgccgattcagcgaaagaaatcgaaagcttaattatagaaatcgtcaacgaaatcaatacatctctcggcatgttccaatccgtcaacaaagaggtggagagcggactggatattacgaatcagaccgaaacgagcttcaaacggatttctgaaatgacgaaccagatcgccggagaaattcaaaatatgaatgcgacggtagaacagctgacagcaggatcacagcagatttcaggagcttctgagcaaatcgcgtccatcgcaaaagaaagctccgccagcattcaggatatcgcggcctctgccgaagaacagctggcttcaatggaagaaatcagttcgtcttcggaaacgttatcccaaatggcggaagaattacgtgatatgacgaaacgatttaaaatagattaatagatcatagaacacccaaatgtgctgtttgggtgttttttttagtttttttaataaatcttttgtcctatctgacgatattagatttagcttttcaaagaaggagactgaaaaaatgaaacaactgatacattggatcaaacagccatccatcagcaagccgctgatcgcggcatttttagccgtattggtgcttccggtcggcatactcgcctacttcagctaccaaacggcggggagtacattagaaagcgaactgacccacagcgcccagggaaatgtcagtgaactgaacagcgtgctggaaaacatgcttgagggtaagctgaaagcgattgactactacagcgaatcaatcacaaaggaaaaactgaacacgaaaaataaatcggtactgctcgacaatatgaagcagtatgtcaccgtaaatggcgatgtcgcgtcaatttacgccgcgtctcgcgacaaagcgttcgtgaaatatccgtccgctgacatgccgtccgattataatccgctcacgcgcgagtggtatacaaaggcggttgaaaaaagcggacagccggtgtttaccgagccttataaagacgctgcaaccggacagacggtcgttacgattgcccagcagacaaaagacggatcaggcgttgtggcgcttgatattaatctgggcgacctgctgaacgcttccgaacgcgtccagatcggtcataaaggatttgccttcattacaacgggggataaaaaatacatcgcccatccgactataaaagcgggaacggaaggctccggagagtggacgaaagaagtattttccaaatcaagcggatcgtttgaatacatgtttgaaggacagcagaagaaaatggccttcacgacaaacaaactgacgggctggaaaatcgccggcacattttttgtcagtgagatccatgacgcagcctcgcctgtcatgaaaatggcgctgatcatcctggcggtttctcttatcgtcggcggtattttaatcttctttatcattcgctcgattgcaaaaccgctcaaaaaacttgtctcgacatcagctaaaatcagtgacggcgatttaacggaagtcattgacatcaagtcaaaaaatgaattcgggcagctcagccaaagcttcaatgagatgtcggcatcactccggtctgtcatcggcgtcatccaatcatccgtcgaacatgtcgcttcttcatccgaagagctgacggcatccgccggacagacaagcaaggcgacagagcatattactctggcgattgaacaattctcaaacggaaacgaatcacaaagcgagaaattggaagaaagtgccgatcacctttcccaaatgaatgccggcattgccgagacggcgaatgtatcggcggaaatcactgaatccgccatccaaacctctgaaacggccggaagcggagaagaattagtggcgaaaacggtcggccagatgaaaacaattgatcgttccgtacagcaggcggaagccgtcgtaaaagggctggaaacgaagtcgcacgacattaagagcattctgaacgttattaacggcattgccgatcaaacgaatctccttgctttaaatgcagccattgaagcggcaagagccggtgaatacgggcggggcttctcagtagtagccgaagaagtgagaaagcttgccgtacaatccgccggctccgcgaaggaaatcgaaacgctgattcaggaaatcgtcaaagaaatcgccacatcgctttccgtattccaagcggtgaatcaagatgtgaaggaaggcctcgatattacggatcaaacggccgaaagcttcaaaaaaatctcagaaatgacgactcagatttcaggcgccttgcagcatatgaacggaacgcttgagcagcttgcagccgggtcgcaaaatgtgacaaacgcagtggaggacattacctcagtcgccaaagaagggtccgccggcattcaagacatcgccgcctcagctgaagagcagctggcctccatggaagaaatcagttcatccgccgaaacgcttgcgcatatggctgaagaactgcagcaggtcacacggaaatttacgattcagtctgaagacgaagaacagctgtaacgagctgtttcttttcctcatctgaaaaaagcgatacactaatataaaagaagggagtggcagtgatgagattagaaggcaaaaaagttatagcgcttgtcagtgatgattttgaagacttagagctttggtatcccgtctatcggctgagagaggaaggcgcgatcgttcatttaataggagaagaagcgggccgttcatacaaaggaaaatacggcgtgcccgcgacggcggattacgattttaagagcctgattattcaggagtatgatgccgtgctcgtgcctggcggctgggctcctgacaaactgcgaagatatcccgaagttttggacatcatccgtacgatgaacgagcagaaaaagccgatcggccagatctgccatgcgggctgggtgcttatatctgccggaattctcgcaggaaaaaaagtaacgagcacgcccggcatcaaagacgacatgacaaatgcaggggcacagtggctggatgaagctgtcgtaactgacggccacattgtatcaagccgccgcccgcccgaccttccgcagtatgcaaaagcgtttgctgacctgttagcgtccaaataaaaaacatccgcccgaatccgggcggatgtttttagttttgatcggcgggaaagacgattccgatttgttttctcgcttcttccataatgcttgccgtaatgaaagagcgttcaaatgtattttcggaagactcccgctgtccgtttcgaagaagattgatgaattcagccgtttcgtagtacatcgacggtttcagatcagggactgaaatgtcttccgtccgtccgtcacgatagcggatttccgcccgttccggtccgtgaatgctgtccagaacgatcgtgccgtcttccccctgaatttccgccggggcaaacgaatttgagattttcgaatgcatcagcaccgcttcaaatccgtcgtatgacagaatgaccgtgccttcgccgtcaacgccggatgctagtttatgaccggtcgcaatgacgtttttcggtttgccgaacaggacgacggccggataaatgcaatacacgccgatgtccattaacgaaccgttcgataattcaggcttaaacgcgttaagcaccgtaccgtttttatatgcatcatatcgtgatgaatattggcagtagcttgccgtgaatctcctgacgggtccgattttatgtaagtggttttgaagcatgctgaagttcggcaggaacgtcgttttcatggcttccatcaagagaacgccgttcgttttggctgcgtgaatcatttcatccgtttccctcgcgttagacgcaaacggtttttcgcatagtacatgcttgccgtgttccataaaaaggaccgcctgctctttgtgaaatgcattcgggctggcgagatacaccgcgtcataggctttgctttccgccatttctttcaggctggtgaaataatgagcagcgccgtgtttgccggcgaattccgccgcacgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctttttttcaaagaaacataaatggaaaaaaggctgccagctaaacggataggaaaaattcccatagagaccggttattatttttcattacaggaacgatagtgtacaatttaagtaaaatacatatgatggaggaacaatagtggaaacattgcaaacatggggcggcagatttaaacagtttttcttagacaataaatttgtcttgtttttgcttgtattgctgctcatcggtctcaatatccttgtctttatgaagacatcatttattttcacacccattatcgtcctgctcaaaacgattgcgctccccgtcattttgacaggaattgtttattatctgcttaatccgatcgtagatatattggaaaaaataagagtgaaaagagtctattccatcctgctcctttacctcattattatagggctgatttcgattacggtcgtttcaattattccgtttttaaaggaacagatcatgagcctgatcgacaacctgccgaaatatgtggacatcgttgaagatcagacgaaaagcctgatcggaagcgattttgtaaatcaggcgcaaaagacgatgaatatcaacatttccgatcttgctaataaagtatcggcgcaggcggcgacaattgcaaacagcacatttaccggggtcgggaattttatcggcgcgctgactgaagtgattatttcaatagtgaccgtgccgtttattctgttctatttgctgaaagacggcaaaaaacttccgatctatatcttaaagtttgtgcccacccgtctgaaagaacaaacgtatacgatgctgagtgaaatgaaccacagattaagctcctatatcagaggacaggtcatcgtcagcttctgcatcgggtttttattatttatcggctatctgattatcggacttgattatgcgtcactgcttgcggtcattgccgcttgtacgagcgttgttccgtatttagggccgaccattgctatcacgccggcgattattatcgcgttggtcacttcgccctttatgctgctgaagcttgcgattgtctggaccgttgtccagctcgtggaagggaaattaatttcgccgcagatcatggggaaaaatcttcacattcacccgattaccatcatctttgttcttttaaccgccggaaagctgttcggggttgtcggcattattttagccatcccggggtatgcggtcatcaaagtggtcacgacccatctgtttgattggttcaaaatgcgctcgcatttatatgaagaagaaaaaaatgatgctgtatcgaagtcataaaatcggaacggacatgatatttattataagacaggctttccttcaaaggagagcttctcttttgtaaatgatgaatgaagggaagaatgggatgacactatgggagatgttcacagcagccgttttgggaatcgtggaagggctgacggagtacgcgccggtttcttccacgggacatatgatcatagcggatgacatctggctgaaatccggaagcctgatgaatccggaagccgccaattccttcaaagtggtgattcagctcggttcgattctggcggtggccattgtgtttaaggatcggatattacatttactcggcctcaaaaaaaacgtcacgcgcgatcagcagaagggatacaggctgaccatcgcgcaaatcgccgtcggtcttgttccagcggcggtgctcggctttttatttgaggatttcattgaccgctatttattctccgtcagaacggtcgcttacggattaattgccggagccgtgcttatgcttatagcggactggatcaataaaaggaaagaaacgatcgatacggtggacagaatcacctacaaacaggctttctgtgtcggattattccagtgtctcgccttatggcccggattttcccgatcaggctcaacgattgccggaggtgttattgtgggcttgaatcaccgggcagccgcagacttcacatttattatggcgattccgattatggcgggcgcaagccttctgaagctggtgaaatactggagcagtctttcttatgacatgattccgttttttcttgtcggctttatctgcgcctttgtcgtcgccctcttagtcgtcaagttttttcttcggctcattaaccggattaagcttgtcccgttcgccatttaccgtgtcatcctcggcatcattttaatcatgctcgtgcgataaacgaagaggccccccggagggtcttctttttatgttcgaaaaacgtctcaggaaaatatgagcaaactgaattttctgcttgaaattcatagaagagtcgtctataataaaacatgacgttacagcacggggccatagctcagctgggagagcgctacgctggcagcgtagaggtcaggggttcgagcccccttggctccatacccgaatgaaaccgcggtatatcaacgttgactaaacgatgacttatccggtgactaaaacagcgtagcgcttccgattcggacagcgtggcgcaccgtttttcaatcgtcttccatacgaaatgggaggcgattttttatgcattcagaaaatcgaaaaggtaagcgtgtgaaggccggaagggcctcggtaaagaccacgcgaaaaggtacgtatgatctcgaatacatattcgatagactgtgcgatgccaagcgcgctgagaatgtcgtgcaggaaacgattgataagtacattcgtgcttgtcggtatttgtcggattatgctgaggagatcggagtgtctgcagacatacgccacattgacgttgactttgcgcgcgggttcgtatcgtggctgattaacgataaaataaagttcgacggccataatttcaaattggacgaacataagacgcaggggttatctccgcgatcagttaacgattatattaagaccatacgaactttctttcgtttcgcgattaaggaggcgtatgcggacgataatccgttcgaagaggttacgttaatcacgaacccggagagtccgataaatatcctttcacctgacgaaatgcgggcgattcttaatgcgatggatcagcgatctttcgttgaatttagagattatgttgcgctgacttgcctcatcgactctatgatgcgggtaggcgaagtgttgtcgattaaagagtcgagtattgatttcggctccaaaacgttgatactcgaagggaaagacgtaaagaatcgaagggggagattcgtaccgttagaggataaaacacttcgactgctgcgtgaacttataagagaaaacgaagaattcgatagtgactatgtttttctggcaaactatggcgagaagatgacgactaataactttaggcagcgtctgaataactacgcagatagggccggcatcaaaaagcgcgttcatccccatttaatacgacatacgggcgcgacgatgtttttagaggacggtggagacattaggcatttacaggtgatactcggacatagcgatatgcgtatggtgcaaagatatacgcatctatccaaaaaggcgctgaccaaggagcatagtaagcactcgccgctacttcagatacaagaaaataaaaataagaaacgaaaaactcggagacaatgactcggccacaaggccgggttatttttttgtccattttccgaaatctatacgcatctataaatgacagacgaaaaaagtttcgtaatccatgtcgcaaaattgacggtagcctacccgttatagaagtgagaggtgattacgaatgaccgacgaacatcagcggctcgtatccgtcgaatcccaatcggaatacaacatcacgtccggcaaggccgaaacgcgcatcttcgttaagatgtacgtcgacgccgtcaagaaaggtcttatcgcggacatcggggcggagcgttggcagactctttgcgtactgtcttcgttcatgaacgctaatggcgaatgctacccgacgcaggatcagatagccggcgcactaaatcttagccgggctgcggctaacaggcggatcaaagcgctatgcgaatatcggtggcaggagcggccgttagtcgtaaagcagaaggcgcgggacccgaagacgcagcgatgggataacgcaagatatacgattatgccgatcagtcagctcgcgatattcgatggagatacggaggagctaacgtagccatgtgacgcctagccatacacggcggacccatacacggctcgactttacactaactagaaccatcttttaactagagccattaataactagataaataatagcgctcaattaaaaccttttcgcgcagatacttattaaataataattctatcgcgataatgaacatccgcaagagtgagcgtaagcgaacgattgctaggttttattaacaaacgaaaggaaggcgttaatatggatatctacaaagaaggcgcccggctcggtttagataggccgttatccaacgaagagcggtccaacattgaatgtttagtgcggacttacaacaagcactcatacgttcatagatcgttgttcaggttattgtgcgctgaacgaaaagctaacgaaggaggcgacgccaaccatggcgattaatatcccgatctcacccgactacaaactgacgtccgactcgcttaacattattgtaaatgaacgctatttcaccgacccgactaaagcgccgaactggccgaagaagcttgcggagaacccgaacgctaacccgacgccgaaggaaaagtggcgtgaagtagcgtatcactcaacggtcgaacgcgcggtactcgacgtaatgaaccggcggctacgcgactcggatgcgacatcgctagcggaattagcacgattaatacgggagtttcgcgaggaaatagcggctttactggcggtcgagggcaatcggtagggtaagcggtaaaacgcgaaaatacacggagtggaggcggcgaaaacatgaagggaaagcgggtaatacgtaacgcaattagatgtaaacattgcggggacataatcgaatccaaacggtcacatgagtttcgaaggtgtaaatgcggaaatgtttacgtagacggcggactggattatcctcgtcgcggcttcccggaacatccggctgagaatcattacgaggagttgatcgagtatgaaaaatgaaatcgcagacctacgctgcactattgccggattgattggcgagaacgatcggttgaaagagggaaacgaaatgcttatcggagagttagcggctattcgcgatatgttgccggacgaatatggtttcgaagaaggaacggtcgaatatgcgataggatatccggaaggcgtaaaagacctcgtaaggcagacgatcgagcgcatgcaagcacgtattgagttcgaacagcttatgtacgaaatgtccgacaagaatgtctgtgatcttatggagttgcttatgaaatgtctaccggttttagacgagaggaatcctgcatttaacgatttatcaaaagagttacgtgaagaaattgcgtcattctcagtataaaggaggacgaataatgaagccgacaatcacgaaggaacaggcggaggcaatcgaatcagcaagaggtttcggacacgatgacgattggatgttgcggtcacatgcggagtatatctcagggtacgctcatcgctggtatgacgaccacactttcgatgatatggacgtcaccacattagcggccgcactgatcaacggatatgaagtcgaaggtacaccggaagaccgggtgcgcgagtatttcgccgaacttcaggaaaaggaacgggcggcgcaatcctggggcgttacgttcagtttggaatgcgaaagggatggcgttatcaatacgctcaatctactcggaatcaaaatcgaaggggtgaacgcgcgatgagacgaccaacaccgtacgaattaaacgaatcaatagcggcgctgaagctcggcgtacccgaacacctttatcatcacgtttggcggcttgtttacgaagttgaagcattacatgaggaggtcggaagatgagcggaaaactgacgaaggcaggtctcgcagaaattcgtaaaagagtcgaacgaattactgacgcggaatggacatgggagttggaaggatattatgcaacgtgcctttcaggagtggaaggaatcgccatagatgttgcggaaggcggaaagtatatcgagatcagcgaacacgatgcggagtttatcgaagaggctcctcgtgatatttcgggtttactaggtcacatcgaagcgctcgaacaagaggcggaagtactgcgggcgcacttagaaaaagccgaagcgcgactgcggattattgcgagatgcgcagagcaagggagcgatgtatatgtccgaaaaagtagataagccggtcgccaagtggaacacgcgcgattttcaagcgtatttgaaagcggagcacgagcggctctacggcgtcccttacgttcctatgcgcggctatcaagccgaagctggcatgctcggacgttgggtcggtacgaaacgaaagccgggcgaatacggaccggagataacgaaacgattcatcgacatgtgcttcgcggattataagccgtccatggattggccgggcgtgagtttcggatggatgcagacgtatatggggcgaaacttgcagcgggcggtcagcgcagttctagcggaagaggcaaggggcaaacggaatagcagcgtggatgatacgtggttctagcgcccatggcggctggacgccgagagttagcgtccaagaagagcgaaaataggttttctgaatgcgaaaacaaatgccgctgtaagagcgataactactttatcttcggttgatactttcatgaatcgaacctcctttcggtaacttaggtatattgtaccacataaatacgaatatgtgttcgatttttataaaaaattcgggagtggttgcggaatggctgaaacgaaaaagtatgcgcggattaaaaaggcgtctgtagacggagtgtggtatgcggataagatcggtaatgtttacgaggtcgatcgtgaaaattgcgtttcgatactaacaaagcgagggattcgcggactgtcctccgtactgagggaagacgccgaactcatcgtcaccgaaaagcgtccggccaaagttggcgagcgcgtgttgattacgaatcccttacctatagtaaagcgagcgtatgaagcaggagatgttttcgatgtagcgatcgcggatgatccgattccgggaggtgtaaaagttttaggtttgccgagctttatcgcctttagagaatacgaagtcatcgtcaataacgaagttgaaaacgaggaggctgacggaatgaaaatcgatttgaacggaatgggatacgacgagttaatggcgcacggggatgcggtaatggaagcgattaaaaagcgcatgtttcaggaaggatttcgaagcgctaaacagggtcagcgcaagttggcgaaaatgaagacgtctattaatacccaagtccgccgtgatgaaatcgttgagcaggcgaaggcggatgttgagaaactgatcgaggatgctggctcgatatgcccggtatattacggtaattatacgatgcggcaacgtatgagtcgtgtagatttcgttgttaaccgggaaaaacgtactgttgtcgcgctagttttcggaaaaataccgcggtttcgtaatgaattacgagaaaaaggaatcgcaaaagccgcacctgacgactgctttaacgcacatatcggaaaggcgattgcgctaagacgtgcgctaggcttggcggtgcctgacgaatacttgaacgctccgcagccggctgaagttcgtgtgggggacgtggtttatggaaagtactcggaggcttactaccagctctggtgtgaagacgaaatcggcgatgtcagctacgaagtaaagattaaagaaattgtggatggtaaataccgatatgtcggcggagggtacgattttatagatgacgctgacctaacgatcatcgacgactcacgcgaaggggtggtcggtgagtgactttaaaatatacgatgagtgaggcggagatcgtcgaagccatggtccagtggcttaagcagcgagggtacgtggcgacaaaaggaaggttcgtaatcaatcaatgggatacggaagtaaaagcggagtttactctgcgcaagaattaacgaaaggaggtccgcgaatatgactaacgaaaacacttgcgtactcgctgacggatgcaaagcggccgggaccgacgcatgtacgcggcactgtacgcatttcatcgcaatgcacggcgcatcaggcggaggggggcgatccggggcggcagggcttccgagggagtaccagctcgtcacgctgaaaaattcgcccgcgcgcgctgaccaagccgaagcttataagtccgccgaaacttatgcggcatcctttgcgcggcagttcgagcagagcggaccggttgcgccggccgaccgcataaaagacctgtatctgttcagcgaatcgcccggcaccggaaagacaacgacggccgccgcacttcttaacgagtggctgcgcgtccattatagcggctctttacgacgcggcctcgaacctttacagcggccagcgtatttcctcgatgtgaatgcgtggcaaaacgaatataacgaattcaatcgcccgcgcgttccggattcagtcgcagagccggcggccgcccgttattatcgcgcattagaagcggcaaagaaggcgccgtttgcggtgctggacgatataggggtgcgtgatgcgacagacggtttccgcggcgacctacacactgttattaacgcaagggtaacgaatcagttaccgactatctatacgagcaacattgcgctcgatcagctctggcaagtattcggtgaacgacgtctggccgatcgggtgggcgacctatgccgcgaaattgaattcgtaggcgaatcgaaaagggggatgcgtagatgaaaacggaattcaccttcggagatatcgtctcggttgccgggtatgaaaatcgaatcttctacgtcgatgcttggagcgaaataaagagaaccgaggagtggggcgtaagtgaatacgtcgagttcgaactgaccgacgcgattaacggtgaattcctcgacgcgttcgaaacggatctgcgtctggtctgtcggaagcagttcgcggaagattaccttttagagtacgacgagacgaattatccggagccgacgggcgcggcgtttcattttgcggactattttccgaaattgccaagcgtagaaagtgtcgcggagttaggtaaaggactcgaaaaggtggcgagtgatatgacgaaaaagaaagcgaaggaagaggcgaaacaaatcgacgggttgctggacgaatacaacgataacatgcgcctatacgagacgtttggggatgcggagtataaaacgaaggctgacgctgtgatgatgaaattgagacgggaggcgagcgaatgaactacggaactctactaatatcgaaagccatcgaagcgaacgatccgaacgccctgctgcgcttcaatgtttcggaagccgacttccaaacgcagggcgaacgtaaggccttccggtacgtcatggattacgcggagaaataccgaggccaagcgccgacggccgaaatggtcgcaaatgaggtgccggacttccagccggattttaatatcgaggcgagctacgattatcttgcgaaaaatctcaaggatcgggcggccgagcgcgagtttatcgagctgatgaacggccgtattgatccggaaaccaatcgccaagttcaggagccacagctcgaaaaacgatttattgaagcgcaaaaaagcggtgatatgggaaaatttttcgagtggttgacggggcaggccgaaagtcttaaaatgagaacaaacgttcgaaactcagtcggaacggaaatcaaacgagacatcgacaaatttaaaacggaatatgaaaaccgtaaggccggcgagtccttccggatctggcgaagtaagttcgattttgtcaataaggcgatgggtggctacgtttcatctaacgtgtacgtgatatacggaaagtcagggcgtggtaaatcggccatagcgttagaggaagtcattaactgcgcaatgcagggtgcgaacgttctgatatggtcgatggaaatgggctggtacgaagtgcttgtgcgcctgtacgtatcgatttccggaactatgggcgttacgactgcgactcttgacggcgtcgatatggaagccggctttaattcacgagacgttcgacaaggtaaactttccgatgaattcgaagcgggttttatggaattccttgatcggcttaacgaaatcattccgggtaatattacggtgcgagctgtcgacgatgaggactttggctcccgttcattgcgcgatcttaagtcggacattatcgaaacgaaggccgacgttgtgctcgtagatccgttttattacctcgactacgaagccaatacgtcaaagactgccggaggagatgcggctaatacttcgcaaaaactgcgccgtctggccgggcatacgaaagcgactatctttgcgctcacacaggcggatgaggatgacgaaaaggcgggcgacgatggagagcgagaactgaatttaccgcaacgtaaaggcgtcaagaaaacgaaagccctgctcgaagatgctgcgttgttgatcgcggttgatacgaacgccaaagaagggcgtggcttgatcggcttgaacaaagggcgcgacggcggcgaaggagaagtcgccgagattatctacctgccgcaaataggcgtcgtaaaacagccggaaacaggcgtcggggctgcggctcagttcggtttctaagctgattggaatttaccggatgatattgtcaacaattacatctaaatttttgaatagtttcgacaaattacgactgtaaatttcgtaacaatgtcgtaatataatttacaagtctcgaaagggagtgtctcgaattgccgatattaactttgagtggacgttttgtagacgtcgacattcggtatgagctcgaacaattcgactggacccggccgacgtggggcgatgaacgcctgctggccgccagtccattcagatacgatcggactccgagcttttacgtttacctcgaagacacagcgtcggcaaaagccggctattggggcgactcaggcgcctatgacgaagattttgcgcggggcgggttcgttaaactgctcgctttcctgcgcggcgaaaccgaagacgacgcaatcgattacttattggaaacgtatgcaccagcggctgaaggcggacgtatggcgcttcgacttccgaaattaaagcccgtcacgaagccggagcctttagcggaatcgatcctcgctgacacagcgccgggccctaacgcttatcttacgggccgaggtattacatccgcggtacaagaagaggccggcatagcgcttgccggaaatgcggtcgcgatcccatggcggcttcctaacgggcggttggctaacgttaaatataggtcaacgaaggggaaggcgttctggtacgtaaaaggcggcatgcctatccggtacttagtatacggaatggatatcgtgtatgcgcagcggattaaaagcgcggtgatatgcgaggccgagatcgatgctatggcgtggcggtcagcgggaataccggcgatcggaaccggcggcagcacatttaatttacaaaaggcggacataattgcgcagtcacccatcgaatatttaacggtggttacagataacgacaaagctggcgaaaagttacggcgggagattgagcgttatttgatcggaaaggtgcggcttgcgcacggttatattacggaggtgaaagacgctgatgaactacttataaagcgcggtacagaagcgttgcaagacgtgtatgatcgtgcggagatcgtgagaaatactttacgtttaggttcgggaattcccgtactttaggtcggcggaggttgtattaaccctccgtgttgctgtcggatacctcaatccattcgtacagctcttcgggcgcacagccgagcatcatcgcgatattgtaggttcgttcgatgctcggcaggttccgaagcctgacgtaatcagacatttgcgtttttgatactccgaccattgctgcgagttgactgagactaattccgcgtttcttgcatagttcgggtatccgacatttgccgaccttaaacgtaacaaacacctccgtactacatcagataaggtgtcacggaggaaattatagactatttccgtttaattttccacatcgtcaggaacaattcgaacaaccttctcgataggaacatcgagaaattggcatataacatcgatcgtacctatgtacatagtagcgtttttagtcatgtgctgcttcttaatacttgcctgtgtgtcaggagaaatgcattttcttaggtgactaggctttagtcctctttcttttaaagtctggtataagggagaaaaatcaaccattttaaatactccttttaaaaaatgtcggcactactgaacgaaaaatgtagacaccgctgaacatttatcgtatgattcaattatactctaaattgaaaataattcaagaaacggcagaaagggggctctccaaaattggaggcgataagacgagaactttgtgacttcatcgaggaccatgatataaagtattctcagatagcaaaagaactacgtgttgataaatcatcgatgacaaaatttaaaaaagatggcacgatcggctttagggcattagtagttatggcgcacttattatttccaaaagatccagacagtaagatttcgagctggtgcatacagttagacgatacctctaaagagatggttaaacaagcatttgagtatgctgcgataaccagaaacactaagctacttgaacacttaattaataaacataaggggaaatctcatctaaaatcgtatgtttctatgtatcgtactatattaaattatatggatatgaaaatatccattaaagagatgattcaagaaatgaacgaattcaaggcttcaaaagataaagagcttcacatactagctggaatttacaagtgttacggaaattacagtttgggggagtacttcctcgtgatttctgacgcgatggaaattggtagaagtataaataaaatgaatgataaaagagagctatttataaaggagtgttatatccataggtttgcggaaatgatagctcccacatatctcaaattaaataatcttaaaggggcggcacattacgcgaatatcatactacaagctaatatatctccaaaattaaaagcagatgccacgtatcttctaggaatgaccaaattacttcataatccagacgagtcaattaaatattttgaaaaaagttattctctaatgcgactaactggtgtagattatctcataaatgactcttataataacttagtaatggcaaaagcgtatcagtatagaagtgatacacaaaagttaagtgaataccttgaaactttagaggaggtggtttatttagaagaaggagacagtttttatgagtgcttaaaaatatatgaaaaagggggtgttgataatcttcttgaaggccatcgtaaattcttatataagtcaaacttctttatttcagcgcttatagcttcagatctactctccacaggcatacacccttatttattagaaaccttgagtagttacaaacacaacaaaaaggagatgttttattttgaagaaaattttattgagtgttttagtgatcgcagcgattttttcagcagccggacagcttaaagggtttgaatacgcaagcagtgataagaccttcggaacagctgaacttcgccccggaggttgataatacaagcagagccttcgggctcttttctttttgtctatacaagaagttgactaaatttccaaaatataaatatcgcaactttccgaaaaaacaaacgaatttttggtacgatatggtcatagaagaaattaataaaagtttttaaaaagaaatgtcgcaaaatcatttactgcctacccgttatataagtgtaaggcgaaaggagatatcaaattggaacaaaaacaatttaataggcttcagttagcagccgacagtggtgcgattccctacgtaactaaggaagcggaacgaatcgcccatctaattccggattttacctcctttgagcaggagtgctatcaagcgatcggaaggacgttagaaaatcttgcggaaaatggacgcgaaaaaaaggcgttgatacagcgaattattcgcgaaacccggcatagatttgtgaagaatagacgatcaagggacgaaattgcaatcgaagcaattaacgaagaaggaaccgtttgggagccggaagacactttggcgagtgttgaggacgcggttttgcttaaagaaaaagtcgccctgttggcgcaggacgacgaaagaaaaaaacttattctcgatacttggactcgcggatgtacaaacgatacggaagtttccacgttgttggcgcaacgttttggaggaaatgctccgtcacatcgaaagtttatccaacgattccgatcaaactgtcaacgcgaattaacagcttaatatttctgtcgcagctaggcccgaaggactttgctacgtcctcattgtattgcatattgtcaacaaattcaagggaacaattatgcgaacatgtcctcggcctagtgcgattatccttaaaataacggaggctaacgtactatgcatacatcgattttacccacatttaacgaatctcaaacgcttttagcgctagatgagcgcaaactcaccgatttcatttaccaaggcgcatggccgcacgacgaagacccggccgactatttcccagcaaccccgatcaaggcggtgcgcgtcggatgattactgccggtcaggtcaagttttcgcaccacgcacgcaagcgccttaaggaacgttacaatattacgaatttatacgtagcgcgtaattggattgcgcaaaagcttcagcacgcaaagtatctcggaatcaccgtagattctaacggcaaggaagcccgtatgtatggcggaaaaggggtcgttatactcttcgcgctgaatagcgattatgtactgaccgttcatcctcccgaaaagaatacggccatccgatttatcaaagaagcgtacgatacgatgaaacaaagcgtagaggctgcagttcagaataacgaaaattatgccgcggaacttcacgaagaaatcgcgcacctgacggccgagcttaaacgaacgcgagcaaaagcgaagaagatggcgtaccaagcacgaatcaatgcggttcagatgcgcattgacgaattgcccgctgagtccttcgaattaaaacgcaggcttacaaaagcggcgaaaggcgttgcggcgtatgtctgatctttcgtgggtgggaccgattgccgccgtcatcatcggattaatacttttcggaatgtggacgcaaattggcgaagacgacgcatcataggcgcgtctcgtcctcggagaatgtcggggcgtccgttaggtaatccgtgtcgcgtcgctactgccaagcgctggcggcgtttcgggcgcagataccggcattttgcgagggcgaaaagccttaataaaaacgtagggggaaaacgaatgacacaatttcaaaaaggcgcagcagcactaggggctttacaggcaggcggaaacgaaggtggtaacttaaatacaatcgacttcgcaaagtttagcgtaggttcttcctataaggtgcgtgtgctcggtacggaagatctgatgcaatatttcggttatggagtttacaagaaagtaaatacgtttgttgcgaagaatccttctacgcgtaacgaaaagggattcgtagtcagcgatcataatccgtgggatttagccgaaaagtatcatcgtgatcttcaattcgcagccaaagaagctggcaacgagaaagaagagaaagcccagagtaaagaagctggtaaatatcgaggaaaggaacggttcgctatgggcttcgttgatctggcaaccggaaaagaaatcgttgtagacttaacgcgcaatcaggcgctggacgtatacgaaataattacgaagtataaaaagaaactcggaaagcttgcgtttgaattaacgaaaacgaatgcgacgggcgaggcgaaagacaccaaggtcgcgctgtcacctttgattgattttgacgaagatcttaacgaaaaggaacgcgagaacttcgccaagtttgacggcaaggaatttgatcattcgttattcgacgggttgcttttcgaagctgacgaaaaaacgcagatcgaaaaccttgttgcggccggattcgatatcggcttgatcggtctgtcactcggtggcagcgcgacagactctaacgaacctactaccgaagaactaccgttttaatcgcgactattagacgaaaaggaggcgcttatatggcgcataaagcagaagataccggcaagtattcggaactgatcgctcgtgctgcgctgctggctagcggctggcaggcggtcagtacgtccgagacggaagaggcgttcgatattagcgcaaaagatccgttgagtggcgagtggaaaacgtttcaggtgaagacgatttatgatcggaaggagcgcggcagcctcatcgttcaggcgcggaaaagcgaccggacaccgtataggctcgatgaagtcgattactttatcggcgtgctgatcggacgcggttcggtacctaccgtttggatgttcgagaaccgcgagctcaccgagtattgggggccgcagtctaaggaaggcaagcgatgggtacggatggatttgaactttcggcgcgaagacgtagagcttacggaaatgaacgaatcggaggcggtatgatggcgtggtttaaatacagagatatgagcacgggcggctatgagaaaagtgattacgggactattttcgtcgaggctcacgatgagtacgaagctaacgatatctttgaaagcgagcttgacctcgatccttatggcgttgcttgcgattgttgcggtaatgatttttggatatcagaggtcgaagctgactacgtagagggttatgcgcaaagtgacgacgttcttgtgattaaaaaggaggcggtataaatggcgaaattaaacggcgttaagacacttgatatggtgaacggtgaaattacgaaggttgcgtatggcggtgcggaatatgtgaagacggaaggtttaccgaagatgggcgatttagtgctggcccagaaatgcggttacgacattacctacggcgctttctacaaaattacggaggatgccgaccatgaggaagacgttagattcttggacgacgtggacgaagggcgggttagagatgtcgacgattacgtactcttccgcaaagtaagcgccagcaccggtccgtccttagaagaacgcgtcagcagcgcggaaggcgaaatcgaaacgttaaaatccgacgtggctgcgctgaagggtgaggcggaatataagcggattgacgcagatgaggctaaggtgggcgatttcgttaaattcgatgatccgccgcgcttcttgtccgatgaagaatattacgaaattgtccgtatcgatagttatggagatccgatagtcattgacgatgacagagacgagtacgacgctagtaaccgtcatttcgaagtctaccgcaaaggaagcgccgcaagcgtagaagctgagccgaaacctgagcgcctgaaggtcggtgattatgcgaaggtggtcgacttgggtgagaataggattcgctttggcggtagcgttggggatatcgtaaaggtcgcagacgtacgaaagactcagattagaacggtggagttagacggcggatattataacggaaacccttgggcggaaccgagccaactcgtccgcgccactgacgaagaagttgccgaagttaaagacgcagcagcacgcgctaaattcaaaaaaggcgataaggtgcggttgctttcgggcggcggaaagcaccctttatgcggattcacggacggtaagatttacgaggttgtaaataataactacgatcaccctaacggtaaacggattcgaatcgaagacggattcgcaacgccagatcagctcgaaattttatccgaagaggaagccgccgagatcgaacgcaagcaagccgaagaagcgaagtgggcggaaatcggacgcgaggttggcgagtataagaaaggcgacgtggttgcgtacgtggattatcgttggtttatgaatagtggtatcggcgaagttgttggttttggacccgcaggaggcccttcgatcgaagcggttaatagcagtggcctcaaaacgtcgtattatctaaaacatacacaactcaacctcatcacgccagtcgaggcgcgctttgaccgctaagccggccgccgtctgcgccgtatgtaacgctaacctttacgaagggcgatccgcaatttacgattcgctcttcgaggtacatgcgtgcgggccggcgtgttggtcggagtggtacgtggctaacactgaggaatacacacgaagatggacggaggcgatcgacttatgaggacgtttagctacattgcaggcgtcgtgagtgcagcgtcactagtttattcgctgatggaaagcgattggttctacgcaggattaaatgcaattaacgtaatcatttgggcggctattaatcgtatgacggagtaataagtaaccacttcgcgaggaaggaggacgacggatggaaggcttacggttaaatatgaacgcgctgaagccggcggcaccgaaatcggacgtggtagaggcgacggccaagcggaaatcagaagcgaagaaaacggaaacgctcgacgaggctttcgaacgcatcgctaggacgtgcaagtttaacgacaaagaaagacgcgagtttgatgcggcatggcgagcgcagaagaacggcgatttagtccgcgtgaaaaataataaactgacgaaaacggaagcgtgtgcactcggtaaacagcaactcgcgaaagagaacgaggttttgcgacagaagcgaatggaagaaacagttcgcacaaagccggacaattactacgttattacaaaggacgaagatctggcgccaatgatcgagcggttgcgtcaagaagtaaaagcgcagcaactcgacccatggttccgtaaagtattcgatctctttaacaatacgcacatcagacgaaagctagcggaacgaggcattgaaatcccactcgcgatgtcatttaccgaatgggatacggagacatccggaactgatacgttcattgatatgtcgggcggctattcgttctggctgccgtgtttgaacgaaggatattacgtcgcatacggacacttaacagacgatgagcaatgtacgcgatcagttgcgttagaagtttgccgggctttcatcgaggacgctcgtcatatcaaagcgtttcataatacacccttcgactacgcgatgtttctgaacgatggtcttgagccgaaaggtttccgatatgactcgttagatgctgcgagattaatgaacgagcacgaacagtcgatgggtctgaaagagctcgtcacgaagtacaaacaatacatcggcgcagatcatctggacgatttcacattcgaggatcttttcggaaagggttctccgatggtctactcgcctgaagtagtcggtatatacgcgatcaaggataccgaaaaaggatggcttctaacgcgttggcaaatcgatatgatgctgaaggttgacgacctctattatccgtatttcgaaatccgtcagtatctctacgaagtaaacacgaccattgaacgtactggcttcgtgatcgatgacgaagaacttatgcgattgaaggccgaatacgaaccgcaattacaacaagcgatcgatgatatacacgaagcatatcagatcgatgacgatttcctttataaaatgtcgatgcaccttaagggcgataagattcgggcttggcaggagaaccgcaagaaacaaatcgctaaacaagcggagatgcttgcgaaatgtgaagcggagtttaaaaaggcgaatccaacaacgaaaaaatacgcgcagcttaaagatcgtatccgtaaatacaaaacgcaaccactggcgccagctattccgcagaacgcgccggattatattcatgaattcaacctcgattcagatcagcacgttcagtatctaatatacgatgtgcttggaatcgaagacaagacgaagatcatcgataagaagaaagagcgcgcggttagtaaggacgttcttgcgctctattttaaagaagagccacgtcttaaaccgatggcgactttctccgagttgactacgctgctagggacgttcattaaccgtatcccttacgttaaggatgtagacggaagactgcacacgcaattacagacagtatctaccggccgttacagctcgaagggatatacgggaaaagataacgatcattaccgcgaatttgtgtccgacgataacttcctcgaacacattcagcgcttagtcgacgcaccgaagaagtcggagaaaggtcggaacattcaaaacatcccatcgcgtaccgaacgggggcagcgcgtaagaatggcgtttaaaccgccggaaggttatacgtttattgggtccgacttatcatcgattgagccgcgtattcaagcccaccggatggcgacggagttcggagacgagatattcgcggatatgtaccggcgtggtcttgatccatacgttgagtttgccgcaattcttttcaatgttccgcaagagatatgtacggaggcttattataaatccgtaaaagggactccgggcgcagttccagcttaccgaaaagcgatgaagcagatgttcctcgcgattggttacggtcaggcgttcgatatgttctacaagggcgttatccctttcggaattagtgaagaacaagcgaaagtcgcctacggaaagtttgacgaaatcttaccgggcttcaaagggatggtcgaggctacgttcgcacatttacgcaagcatggctggaccgcgacgatcttcaaacagaaacgtcgttttccgggatacgtcgagaaatacaaacggctttgccaacttatgcgtaaatgtggcatcaccgacaaaaacgatccggagctcggtaagaagacgaataaactacggtgggaagaacggtctgaattctgggatctgatgcgatttactggcggctgtgaacgcgctgcctttaaccatacgattcaaggatcgggcgcaaatattcttcaaatgtgtatgattcgcgtttattacgaatgtgttttaggtcgcgaatgggaattccctctgacgctgcatgacgaattaaaatgcgccattcctaacgaacaattgacgcgagaagcaacggatttatttgacgacattatgacgaatacgttcgagctagttcttccattagattgcgatacggtaatcgagccgtgctggatggaagaatacgggccggacgagtggtttaaaaacaaggaggcggtttgatgagcgaaatgaaaaagtatacgaatatcgtgcgtcttggtcatcgtactactgagggcgttctaactgagaatgattacgtagttgtttacgaaaaactggacggagcaaatgcatcgttcacgctcaattctgacacatatgaaatggaagctttttcgcgtaataggaagctagacagcgagaataacttacgtgggtactatgattatacgcagaaaatcgacccggaggacctcaaccgcgattacatctacttcggagaatggctcgttaagcacaaggttgattacggtgttaataagaatgaattttacctcttcgatatttacgacaagaaagagggcgtttatctctcacatgtggctgttgttgcggaggctttccggcttggtcttactttggcccctattctttacgcaggtaaatatcgcggcttcgatcatttacaaaactttgttgggagcagtgcactagcgaatgaattggctggaggcgagggagttgtcgtaaagaacgtaagctaccgcgacaatttcggaaagcagcttttcgtaaaagtcgtcagtgattcgttcagagaaatgcagccgcagaaagctccgcgcgatcctgcgaaattaaacgccgagcaaacatttgtaagaacgttcgcaacgaaaggacgcgtcgataaactcctgcgaaagatggttgacgaaggggttatcgaagagaaattcgatctatcggacatgggcgtaatcctctcgcatttaggcggccgagtatacgatgaccttattaaagaagaatccgacagtttgccgcaggatttcgaagaaaaagctgtacgtaaggcaatcggaaaattcgttccggtgcttgtgcgtgagattatcgaagaagaaacaaaacgggaggcggtttaatatggtgaaaacttacgttgtgctcgacttagaaacgacaggactcgattatcagtccgaacaaattacggaaatcggcgcgattaagattgacgaaagatttaacgaaattgatcgctttcatacgatggttgcgctagaagaaggacgcgagctgccggaattcatcacgaagctgaccggcatcacagcggccgacctcggaggtgcgccgactgaaaccgaagcgctagagagcttaaacgaatttattggtgacgctatcgtagtggcgcaaaatgctccgttcgatctgtcgtttatcagtcgaggcggaatcgagcccaaacggttctattgtacgcgagctatggttcgtttcgttgagccggaattatcggcgagcctcaaggacgtagctaaccgtaactgcatttcgctcgaaggacaccaccgagcgcttaacgatgtagaagcgacgatcgaagtattccgcctttatctaccgcacgtaaggtcgcagattaatgagttcgaaaacatcgttcaagactccgcagaccgtccgctgaagtttaagcctaagaacgcaattgtccgcaaagttcatatggtcgcgttggataatacggacttaattcgtttggttcgagcgtttccggaagaccacgatatgttcgccaaactcggtaatattatcgatcgcacaatgagagggcgtgattaattgacgaacgcaaatgcacgctcagctgcaaactcactgcgcgcccaattagcgccggcgccacccgaaccgaccggctatgcgcagcagattgcggatgaactcatcgaatatctaaacgaatggcactcgcttccggaaacgtgggataacgccctagacgcgcagattcaccgatggtacgcagatgctccgaaagtatttccgaagaagccgtatttctcgccgtcatctgcaaacgcatgtccgcgcgagctctatcacaaagcgatcggatctccgaaagacgaaacgcgaaagcctccgtatcaaggtcgctggacgcgcatcgggacggcgatcggcgatatgatccagcgcgatattctctttatggaaaaacacttcgaaaagaaaaccggccggccatgtccgttcagcatcgaacgcaacgaagacggaacgccgatgttcgaggacttcgcaaaacgtagccaccgaatcgagcgcggcggcaagacgtttcatctcttcggaacttgtgacggcatcttgcgctatgtaaccgaagacggcgaagtattgcgcgtgggcctcgaaatcaaatcgaagcaaacgagcgcagcacgaacgtctttctattcgctgaagaagccggatgaaaaacacgttaagcagtgcgtagcttatgcggagatgtatggcgtcgacttatacgtaatcctctacgtaaacgcgtcgaagaaggcgtgggagtacgaagagggagaattcgaaaagtcgccggacatccgggcgttcggcctcgaaatcggccgcgacgacatcgacgtgctgctcgatagattcgtagaaattcagaattcgattgatgacggcaagccaatggcggtcgatcttaacggctggacattcaacggatacaaaacggctattgcgcagtcacttacggcggccgaactggaagccatccgcgataaggtttcgcgagtcaagcggtcgaacgtctttgattctacgaaaaggcaatacgccggggcgctagagtttatcgaaaaagtacgcaaaggggaggcggtttgatgggttactatacacaatacgaagtcgagatggataaggacgcggaactggttctcgaatatgtcaacgaaaatcatgacgagaacggatgcttgaccgcagttttcaacggttggggagacgagatgaaatggtacggacacgaagaagacgtgcgagaagtatcccatcaattccctgacgtgctcatcacgcttacaggggaaggcgaagatagcggcgatatgtggcgtaaatactttaaaggcgggaagatgcaggcgtgccacgcgaaaataactttcgatgaatatgacgaaaaggagctccgatgactagcgccaagcctatccggtgcctcgcgtttgatacgtcgatgacctgccccggcgtcgcgataatcgaggtgcgtaaccgaaagcctacgatcaaagcgctatcccacgttaagccgaattccaaccgatcacatgcgcaccgggcggaagttatcgaagggtgggcgatgatgtttctcgacaaaaactatccgcgggatggcttcgactatgtggtgcgggaggacttcgcgggcaagacgtcgacttcgaactatccggtgctggcggcatggaacgcgtgtgaacgggcaacgtcgcgattcgagctgacgttcgataagtattggaagacaccaaacgcaaagcagccgcagctcggaatatcagcaacgcgggttaagtcgttggttgccggatcaggtagcgcagaaaaggacgcagtaaaggcggcggtacggcgcatgaccggatacaccggcgagttcgctaatttcgatgaaagcgatgcggctgcgattgggcttgcgtggctgattcatgaaggcgtaatagataaaccgggggaggcgaagtaatggatcgcatagtaaagtgggcaactatctcagtaattgcgctggctgtatttgcgttcgtggtagcggcgccggcgtatacaattgcgtcttaccacaacgaaaacacttacgtaataaaggttacggataaagaaacgaaaacgtctagcgattcctcgaaatatctgattttcggagatgacgagaaaggtaacgcaaaagtgttcgaaaacacagacgcaatatttgcgcgcaagtttaattccagcgatctgtacgcggaaattgaagtcggtaagacgtacgagttcaaaacgatcggcttccggattccatttatgtcgagctacgaaaacataatgacagtaaaggagaagtgatgcggatggaagagattcgagatatgactattaaacaagaggtattcgattcccttatcaattcgtcagttgctttaactcggcaaatacaagcgaaacaaggtaaggagaatgaaattataacgcaagaagaggccgattttgttaatgcgtttcttgggtatgcaaaggaattagcagacaccttacatgaacggtacaaagatgagttaggaagtgatgcgaatgtttaagcggaggttactcgaaacactttcgtggatatgttcaggtgcggcgtatttggtgttcgttagcttaatgatttggtccgcggagtttcccgtagcaagggcgatccttacggtagcagccgttttcggcctgctcctcgtcggactttacggaatcatccgttttattttatggctgatcgtcgaaccttaccgcgcacataaacgcgagaaggcgagggcggccgaatgatttacggagcgaccgacgaaggtttgcggaatatgagacgatggcttaacgaaaaactgatcgaaagtgataccgccattagctttcacgaccggaaattgatcgaagagcgcatcgaacgcgaacggacgcaggcgcgactggacgaagttgaggcggaaattgagagacggaaggggtagatcggatgtataagcgtgaagaactagaaaatgcgttatcggcgttggaattcgaactcgacgcgaaggaaagcgaacttgaagatctacgcgatgagatgcaggacgttcaaaacgatattgacgatatcgaagatcaaatcgctgacatcgaggacgaactcttttggttaaaagacgaagaggattccgaatgctaatcgcctactattcgctgaccggcaacgtccgccgtttcgtcgcaaagaccggcctagccgccgtcgaaattaagccgggactaatgctcgccgagccgttcgtatgcgtgaccggtacgtacggcttcggtcaggtcgccggcacagtttcggagttccttgcggataacagcgactatcttgcaggcgtggctgcttcaggtaacagggcgtggggcggtaacttcggaaaggcggccgatgtgattgcggcgcaatacggcgtgccgatagtcgggcgctttgaactggcgggcacggacgcagatgtacgacaatttatcgaaagggtgaatgtgcttggcgaataaacacgcaagctatatcgaacttaataacgaaattatgatacagaaggacggccggttccagttcgaaaaggatatcgaagccgtccgcgcttattttatcgactacgtaaaccaaaacaccgtatttttccacgacttgggcgaaaagctcgactatctgcgcgataacgattactacgaaaccgaattcctcgacgcctatgctttcgatgaaattaaagcggtttatcaagcggcctatgcgcacaaattccgtttcccttcgttcatgagcgcgttcaaattctacaacgactatgcgctgaagacgaacgatggcaaaaagattctcgaacgctacgaagaccgggtcgcttgctgtgcgctattcttcgcgaaaggagacgcaaccaaggcgatagagtacgtaactcttatgatgcgtcaagaatatcaaccgtcaacgccgacgttcttgaacgccggccggaagcgtcggggcgaattagtatcgtgtttcttgctcgaagtgggcgactcgttgaatgacatcgaaagggccgtcgggatctcgatgcagctatcgaaagtaggcggaggcgtgtcgttgaacctatcgaagatacgcgcgaaaggtgaatcgattaaggatatcgagaatgtaacgaaaggcgtcgtcggagtaatgaagctcctcgataacgcgttccgatatgcagatcagcaaggtcaaagacaggggtcgggcgcagcgtatctaaacgtattccatgcggacatccacgattttcttgatacgaagaaaataagcgcagatgaggatgtgcgtgttaaaacgttatccatcggcgttgtcatcccggataaattcatcgaactggcgcgtgagaatcggccagcttacgtattctacccacacaccgtttataaagcgtatgggacgcatttagacgaaatggatatcggagagatgtacgatcagctcgtcgacaacccggctgtccgtaaagacaaaatcgacgcgcgtaagctcctcgaaaagctcgccgtactgcggtccgaatcgggctatccgtatatcatgttcgaaggcaacgttaacgcggagcatgcgaacatccacgtatcgaaggttaagttttcgaacctctgtagcgaagtgcttcaggcgtcgcaagtatcggaatacaccgactatggcgaagaagacgaaatcggtctcgatatttcgtgtaatctcggatcgctcaacgttgcgaacgttatggcaaacggagacttcgaatctatcgtcaagctgtccgtcgatgctctaacgcttgtctcggaaacttcgaatatcaggaacgcgccggcagtcgcaagagctaaccgcgagatgcgttcgattgggcttggcgcaatgaatttgcacggttatctagcgcagaacggcatcgcgtatgaatcggaggaagcgcgcgatttcgctaacgtattcttcgcgctcgttaattactggtcgcttgtacgttcgaatgaattagcgcaacagaccgggaccacgtacgaaggattcgaagggtcgacgtatgcggacggtagctacttcgataagtacgtcgcaggagatttccgtcctaaaacggagaaggttgcgcggctatttgaaggcgtgattattccaacgccgatcggttgggctcggttggaagataacgtgcgcaaatacggtctttaccattcgtacagacttgcgatcgcgccaacgggctcaatttcgtatgtgcagtcggctacggcgtcggtcatgccgattatggagcgtatcgaggagcgtacgtacggcaattcgaaaacgtattatccgatgccgggattatcgccgcagaattggtttttctacaaggaagcgtacgacatggatatgttcaaagtcgtcgatatgatcgcaacgattcagcagcacgtcgaccaaggcatctcatttacgctgttcttgaaagatacgatgacgacgcgcgatctgaaccggattgacttatacgcgcatcatcgcggcatcaaaacgctgtattatgcgcggacgaaggataccgggcaggattcgtgcttgagttgcgtagtttaaacgaagaggaggcggagacatgcggaaggttaaaatcgaaggttacgtgctttataacgaggatgagttaattcatggatcttgtgtaacggatgaaatcgatcattggctgttcagtcagacggattttccgtatgagtggatgttcaaggctatttcggacgaagaagtatctgttgaaaaggaggacgaataattgacgaacccaaacgcaatctatacagcggccgactggtcgcgccacgaagacgaattcacgcaaatgttctacgcgcagaacgttaagcagttctggcttcccgaagagatttcgcttaatggcgatctcctttcgtggaaggcactaaccccggccgagcaggatacgtacatgaaggtgctcgccggcctgacactgcttgatacagagcaggggaacacgggcatgccgattgtggctgagcacgtcgaaggccatcagcgaaaagcggttcttaatttcatggcgatgatggaaaacgccgtccatgcgaagtcctattcgaacatattcatgacgctggcgcctaccgaaacaattaacgaagttttcgaatgggttaagacgaatccgtatttgcagcggaaggcggctctaataaccggcttatatcgcgacataaaagaaggcgatgccctttcgctatataaggcgcttgtggcatcggtttatctcgaaagcttcctgttttattccggcttttattatccgttatatttcgccggccaaggaaagctaacgagtagcggcgagatcattaaccttattattcgcgatgaggcgatccacggcgtttacgtcggcttactggcgcaggagatctacggaaagcaagatccggacgtccagctagagatgcgcgactttgccgtcgaactgctgacggagctgtacgataatgaagtcgcatataccgaggatctatacgatgcggtcggcttaacgcacgatgtaaaacgattccttcgttacaacgcgaataaggcgctgcaaaacctcggctttgatccgtatttcgaggaggaacggccgaatcctatcgtcatgaacggtctgaatacgaagacgaaatcgcacgacttcttctcgcaaaaaggaaacggatataagaaggcgacggtcgaggcgataaaagattcggatttctatttcggcgaataagcatccattttccggagtagattcgcagttatatacgaaaggaaattatctggcgatgtcgcaaaaatggcgattacctacccgttatataagtgaggaggtcatcgcctatgaaacgatttatcagcgccacggcaacggtcatcgccggattacttttcgtacttccgtatatccatacgataggatttcggtggttttcgatagttgccgtgttcgctttcatcgcgatattaacgaaggaggaaacgaaatgaacgtaaatataaaacgattatcaccggacgcacagattccggcttatgcgcacgcaacggacgccggcttcgatctagtggcggcagaggacgttattatcgaaccgggcgctaccgcgtgtgtgccaacgggcttggcgttcgaaattccggaaggctttgaaatgcagatccgaccgcgatccggcattacgctgaagacgcctttgcgcgtgcagctcggtacagttgacgcgggctatcgaggagaagtccgagtaatcgtcgacaatattgcgagggagcctgacaattacggatgccatatgttggacgttacgggtgggtatgtgccgacgtttgactactatggcgtatatagaggctttccagtaggtacgtacatcatccgcaaaggtgatcgtatcgcgcaagccgtaatcaagccggtcgaacaggcggtgtttatagaagttgatgcgctcggcgatagcgatcgaggtgcgggcggcttcgggagtagcggggttactgcgaagtcttacgaaaaagctaacgaaagaaacggcagtgcgttagagagattggcgaaggaagaaacgcatttaaaatctagcggacgcacgtttgatttcccgaaggaagacgaataaatggagcaaatatacgcgtgctttctaaacggtaagctatacggatgtggcgacatcgagtatatgaacgacctatttcgcgattacgttgttaactgcgagatgtacggaagagatgactgcacgttccgaataactacgaaggagaaagctcgtagattagtgattaacgaaactatttgcgaaaaccacgaagcattaaaacgattggaggacgaatagatggcggaaaccaaaatgaacgcacagctaatcgcacatacgcaattgaacgagaagttctatcgatctctcaattacggaaactatgacgttattctcggatgctttgacggtaatcatgtcgaagattatgacataaccgacggtcaagcggtcgccctaaccgcaatcagatcgtgctatagcgccaataagcccaccgaaattgtcgcaaaggaaggcgccaagtatttcggctccaaagcgtcagacggcggcgcaggcacggacgccgaccggctattccgacacatcttcgcatccaaacacacgtcgaccctcgaacacctaacgttcacctttgcgattgaagacgtcagccgggcgttattggcgcaacttacacggcatcgcgtcggatttagcttcagcgtccagtcacaacgttatgtgcggatggggagcgatgataagatcggtgggttcgattatgtggttcccgataaagttacgagtgataaaacggcggacatgtacgattttgagtacggtatgcccgtagaggaccgtccggctacggatatattcgcggaggctatggaactatcgcaactattctacgataaattgcgagaggccggagtgcccgcagaagatgcccgcgccgtcctaccgaacgcagccgcaaccaatctcgtaatgtctgcgaaccttcgggcgcttctcgaattctatgcgaaaaggaaatccggaagaggtgcacaggcggaaatcaccgaattagccgaagcgctaagacgcgaagtggtcgccgtggaaccttggaccgcgcaatttttcgaggaggtgtgacaatgagatgcacgttaagtattaatccttacgtacggcagtcgttttcaatcgttgatatagatcgcggttggctcttttcatccgaacttgaggacggagtacatcttgaatatgcctgtattgcggaatcttcatcgaaggaatcaccgtatattataatcttcattgaacgattcgaggcgttgaccttcccagataaaggcgctttaattgactacttaaagagttcgctagtcgtcaacgaagtaatttccccggacgattatagcctagaaatgtcgttaaatttacgaatataaaacggaggtgtaagcatcggtatattaacgaatctagcggtgtcaacgcacttacttacgaatccaaccgccaagccgccggaacctccaccgccgagtccgccgcgcatcaccgaggaagaatatgcgctccaagaggcggaagccattatcgaaggcaaggacgctgaactggcggccaaggatacgaagataaaagcgctcgaatccgagcttgcttccgtaaaagacgaagtcaaggcgcgagttaacgaaaagcacgtgaagtctccgcataagcacgaagagcctgccggctggcaaacgttcgaggcgtccgcgtatacggcttattgcgaggaaggttgtaccggaaccacagcgaccggcctcgacgtcagccatacgatctaccacggaggcaaacgcattattgcggtcgatccgtcagtaattgcgttaggctcaacggttgaggtgcggcaggcaggcggcacgacgtttgaagctgtggcgcaggatacgggcggcgcgattaagggcgccaagattgacgtattagtttcggacgaagccgacgcggttcagttcggacggcagtcggtgaaggttcgcgtaataaattaacgggagggcgatcggatggaattaaagataagtcaggcggaggtacagaacgcgataaccgattatattcgtaagagaggactaaacatggatgtgaaacggattgaatacgtcggtccgtacggagactttctaaaccatcttgattatgcggtagtagaattcgaaaatggggaggcggaataaatgacggaaactaacgcaagtatccacgtactggctgacgaaacacttggcggcatcaagcgcgaatacgtagaggtcgatcggaaggcggaggtcggcgagaagatcgtcatcgtaaacgcagacgttcaatgtgaagagccgtatcataacggatatagatttgaggtggaaagtttactcggttgcagtaggggcatacagacggcatgtcatcgagatatcttcgattttgaataccacgtactcgaaccgaccaacatcgtacacattgacggtcgacgctacgaaatgattgataggaaggcggaggtgggcgagaggattatcattgttagacctgacgaatgtatggggaacgctaaggaagccggtatcgtaggtacggttggatcgctctattctgccggagacgtatgcgtaaaagatatcggctttgtacttggcacagagtatcgcgtcctcatcccggtcgaagccgccgaagacgaaccgaagccggccgacccaatcgacgttatcgccagtttagcgcaagaggtggcggaattgaagcgtaaggtgagcgacctagaaacggttgtggaacgtcatgagcgcataaatggtcgtcataattgcgaaatcgacacgctccacaaagacaatcggacgcttggcgaagagttggcgcgattggccgcagaagccggaaaggaaacggaagtaggcgcgaaggcattggcggaagcatttgttgcgctaagaagggccggcctatgacaaacgatgtgatttacgttatctatatggatggaaagcggatgaattctaacggaaggaaagtcgcttatctatcggaaggtgcggccaaaggcgtgataacttcggaagtaaactacttagtccgctacctaacgcctagttactttgatatgtcgggggtcgaacagaacgctgctaaggcggagattcgcaagcgctatgagatcgtcgaatacgcaccgaaggaggagcgcccatgaagctcgccctaacagcgccattacgcgcaggcaagtcgcaggccgccggctatctgtcgacgtattacgatttccaaacgttcgccttcagcgacgaattaaaggcggctttccatcgcgctttcccttccgtaccagaaaagccgaagccccgcgcgtattatcaagaattcggtcaggcggtgcggaagatgctcgacgaaaacgtatggatagacgcatgtatggcgaaggttgacgcatatcaggcgctctttgctcgcgaatgtgattgcggcttatctccgtccctaaagaatcgcgtactgatcgaagacgttcggcagcagaacgaatatgatcggctgcgctccgaaggttttacgatcgtccgcattacggcgccggaagtattacggatcgaacgagcacgaaaggccggcgacgacttcgatttagcagcgctcgatcatccgactgaaaaagcgctgcaaactttcgaagttgattacgaaatcgtgaacgatggtacgtacgagcagctttacgcgaaactggatgcgctggctgccgagttacttggccgagcttaagtcgaaagcataaacgccagaagggtacgccatatacggctgcttcgcggcttcatcttcgccaatcatctgaaaacgtagcggaaggtcctcgtctttgaagccggccgccttaattactttgcttgcggctttattatacgaacgcttatcgaatttgaacggagtcgcatcggcctttacgctttcaggctttgcgcaaacgagccgattcgcttcatcatcgtagccgatcgtcaggtaaaacggtgctttatcgggcaggccgatgattttacgtgcgccggacgaaacgtatattcttcgctgtttatcaagcgttatgtaagcgtcattactttgcgctgaaatccagttaataaccacgcaattcacctcgattatacattatacggaaattatattcgcttttgggacgaaagtcaaacgaaaggggacgattgttatagggaaagccgatcgcaaacgatgggaaggcaacgttaaatccatggaaatcatcgcgaaggatcgcgaccaaataaccgaagaagatatcgaattcttacggcaaaattatacgtcggcaggcgggttactaccgaatgcctttagcggtggggcctttttcacgcctactcacattgcaaagttcgtatgggatgtattaaagccgcagatgcctgagactccaaaggttctggagccttccgttggtgccggcgtctttctcgaacatgctccgaccgacgcagaaataacagcgttagaactcgataaaacaagtgcaaaagtaacatcgctgttatatccagacgctgagattatcgaagggaacgcgctagtacacggccgccgagattattacgatctagtaatcggcaacccgccatacggagtgaacgttaagttcgagcaacaagaagacgaggaatggcggtcaattactaaaaagaagggagaatacggaggcaagtcggaggtcgcttttatcgaactcgcaatcaaagcagttaagcccggcggttacattgcgttagtacttccgttaggcatatccttcgctaactatgcatccaagcttcgaaagctcatgcacgaaacgtgctggcaggtcgcgactattttacttccgggagaaacgttccaacacgtaggtactacgatttctacgcagatattaatactgcggaaagcaccgcctagaacggagttaataccgccggcaactacgaagtggcgctctaattttaaacgaggcggagacaccgacattacggaatataacgcaaaatttctcgaaggtcagccgcctgcttatttcgcacaagtaacagatattggatgggatgcgaaaggaaagtcaacagatgcgtcgggtgatggtctgacgcaacttgacgaacttgttgacgattttactgacgataaccttatgcgcgaaaatctatacccgcatttaccgagctggcacggaatcgataaaggaaacgaggcattcttcttctcgcatggcaacgggcagtgtgacggcttaagagacgcagaagccacttttccggaaggtccttatcgctggaatgagctaacgttaggcgctggtgacgagatcgaatggaatagacgtatggtgagctcgcttgatttcgattggcaggaagaaatcgttcgcaattatttcgatagatagcgcgattactagagcgcggaggaggttttacgtatgggaacggtcaaagtcgatctacaccgaaaggatcgcgaattccacgcagcctatgcgctagataacgcggagggcgttaagttgctgctcgccgattaccagaagttcgtcagccggaagcgatgcggcgactatgcggccgtggaagtgctcatcgacattcacaaggcgattgagctcgccggcttaacggatcggcaacggcaggcgatcgagctcgtttacttcggagaattaacgcaagctgaggcaggcgaacggatggggattgcgaaagatgcagtaagccacttacttaatcgcgcatccgaaagccttgcggacatttattactattgggacggtcacggcgaaggatacaagacagggggacggattgatggataaaacgattttgcacgaaacgattacggaaatgtacgcacgcactaaggccggtaagatgtctcggcaggagcgaattgaggcaataacggccctgtcagacgcttattacgactctactggagagcatccggagccatcagcgcttgagcgaatggccaatatcgtactctacgaggaactttccgactcgcatccggacaaggtgacacgcgaagagtatccgatcatgagcgaaacccagttcgaagagcgatataaacgagaggcttcggataaattggcggaggaatacgaccaaaccggatcttataaaggccggccgatccgcaggccccgttcttcctatgaaaataaattactggacagacgcgctaaggcacggaatgcagagcgcagagaacgatattcggcgttcgttaacggaaggtcagacggtcagttcaccgtaaatatcgcaaccggcgaaaaagtttatcactaatacccataatttaccgcgttagttgtctatacgttatgagggcgcccattcagcgctcttttattttgcgaaaaaggggacgatacaatgaagagattacgagttatcaatacggagacgggcgaagattggtcggaaatgtacacactgcggcaccgaaaccaagacgccgcctttcgtcagcaacaagaaaaaacggccgatcggcgcgatttctcaaacgccaatatgtctaatattcacgaagtatatgacgctcttacaacggcacagtgcggctatctgatgctgcttcagtgctacgtcgattataacggggtccttataaaatccagccgcaataaaatgccgatgaccactgcggacatgatggacgttttgcagctcggtaaaaaacggatgaccttttacgacttcctttccgcatgtaccgagcacgacattatccgagaagaaggcggccgctacagcgtaaatgagcgctatcacttcaaaggtaatttcggtagccagtacgtcgtcaagctttacagcgcgaagattaaacgtgtgtacagcgaagtgaaggcgactgacatcggactgatctatcgaatgctgccgtttattcacttcgaaacaaacgctttatgcgaaaaccctttcgaaaagaatccgaagcgcatccgttggttcaataagaaggagcttgcggcggcgatcggtgttacttcggatacacttggccggcgcctgaagcaaatgaaattcgacggtgagtacgttgtcgcgcgcattaaagtcggcagcgagccggagcgctacacgtttaatcctaacgtattctatcgacaatccaagacgccagacaaaacgctaattgcgctgttcaacgttaagaaggtataattttactatatcggaggtgagacgaatgggcgaaataagaccgggcgcgggtccgcaattatacggaatgccgcgaggagctagttcgctagaaagcattatcagaggcgcaggcccagcggaaagcgcatcacgcggagcataaaaagaaaaaggacgccttatacgggcgtctttatttttgcgtttatagccacgaatcaaacgaaggtatccgcagccatccttcgcgcattggaaaactcattttgatgttacgtcaaaaaacaattcctttaaaatatgatctagtaaagcttcaggagacgttttgtctaatgggacctcctgtgggctaggatatccgggagagtgagaacttagtgagttttcatcctcaactacgtaggtaatagcggcctcaacagatggttctagcctctcacaagaaatcacattagaggcatcctttaatgatattcttgctcttttatcgtctagggttataagtaaatttctaggtccgtcttcgctcaattggatatagctatgagacactttggaaatctcgtcaatgtcctcccttaaagtgctaagatgttcctcaatgccctcaaaaatcttaacagcagctaattgttttctgtacttttttctaagaacttcgattttgtccactatgcccattttagtaatcctccttaaatgttctttttcatcccacaccgccggcactcccgaagaaacttcccgctcttcaccgagcttttaaaaagcgtatagtcgcagttatcacatcgtcctgcgcgcttatccggaaattccttgtattcgtaagtgatcgacgtatcgatgccgttagtctcgtatttttcctccattttcgctgtgcctccgtgtcctacatcgttgtatagaacgattataccacgaaattacagcaagagagccgcttcagacgcgttcaggtacgataggtatccgaaagcttgaaacggctcatttcgttcattatttaacgttgaatttcgctgactcaaacgtgccaacgtatttgcgcttgcccgaatccgaatagcagtcgatttgaataacgtatgtgcctttgccggtcttgctgcggatcgacttcgcactaaacgacttcagcggcgttgatgtcttgaagcttccgcgctgcaccaagccggtatccgtcagcccgccaccgcttcgctttttataaacgccggccgtgtagtatagcgttgaggcgcctttcttctcggctttccaatcgactgtgcttgcgctggctgtgtacgtggtagcgtccgtatatactcgcgccttgtgtccgaacttttccgtctgccatcccgaccatgccgcgtcagcttggggagccagcgcaatcgtgccggttaataaggttgcggtgattacgagcgatttaactaaacgtttcatacgatttcctcctcgacttccagccgcgtaccacacgtcggacagcacgcgtccggcttgatttcgatatctaactttgcgtaattgcaatcgtggcaagtgtattcaatcatcgttctggttctccgtttccttttcgatacgatacccgaaatattgcattagagtattgatcccgatttggtaagcgcgcccgcatcgaccgaaattggcggcgggacgcacgtataattcgaggatctgcgcttcctgctgcggtgttaatgccggtacatccggccatactttacgaatcataagctgttccataccgttatcgcctccgttttagtgctacgacaagacccgcgattgctacgatcagggccgccgccgtaatgccgatggttaataccgttaacatggcgcgctcgcctccttgtgtttgcattttggttacggtactataagagacacggggcggactctccaatcaaccccgtatcaatgttctggcgctagtcgtttttgcgattagcgttttttgcgttaacgcaggcggttgccagattcgttaccgcaatgacgaagtttactatcgccgttataattagtaccgtttccgcgttcaatcgtttttcccctcctctctataaatctattatacgatatcgtataacgtaagtcaacggttaaattgaaatattattcgtttctatatcggtttcgttgagcgcgagggaaccggctaccttatttccgatgacccgcgaattaatagaaccggaagtcttaatcggattgtagagcgcgaaagagctgacggagtgtacgacgttttcttttactaaggcaccgtcggtgttttttgtttgaattccgtaacctccggaagacttcctgttaaacgttatgtcatttccggatatttcagggtttttaccgccgacgacgtaaatcggtatcagacatttcgcgtcagtgatgtcgttgttcttaatgcgaacggttcgaccttcggcactttctccgtaaatagccatgtttgccgattttggtatgcggctgtatttgatatccacgtcgcttcccttatcgaaagatatagcgtaccctgccgcgctagggtagtcggtaaggtcaatgtcgttatctatcagtttcgccgaagaccgcgtaactacgacgccttgcttactgcgtttaatatcatttgacttcgctttaacgttaatggaatcggcaatctctatcgcagctatatctgaatcgtggagatcgttaccttcgaacgttatatcttttgaattgcgcgcactacataatttacccgggcagtgatttacgatgttatccgaaaacttaacgttcttggcttcgaaagtagctaatgcggtgccgtcagcgctaagctccgaaattgtattgccggatactgaaatgtctgctccgcgaacgtcaataccgctactgaagccttttatcgtatttccggtaattgatatattatttccgctaaagccagccgacacgcctaggctcgtaattgcggtatatttcttgtccgtacgtacaaacgtattattcgagatagtggtgtcggttccgaatccgtaagagatcgagttatccgaatagtttccggaaataacgacctcgtatccgctgaaattacaaacggactgcagcacatttcctttgaaagtattgttcgttatcctcacattgcgaggctcttcgtagtcgatttcgccttctccgtaaccttcgatatcaatgccgaacataggcttgcagccatcgtttatgccagcgttggttattacgtttttatcgatctttatatcttcgccgccagtgaccgatatattgtttcgacgagcaccgtctaatttacaacgctcaatcgtaatattgcgggcgggtcggtaagtcgtccacggcacgtttaacatgccttgagcgttcaccataatacaatcgcctgtgcagtccgcaatatctacgccctcaatcaggacgttcttggctccgtgtgcgtttattccgtagccccattcgtgtgtttctttctttatacgatcaccatgtccggtaaagtcgtgctggtaacgttcgccgcgtatcttgccgccttttatcgccacattctcgacttctccgatatagaagcacgtatagccaaacgagctattcggctcgacacggaactcggcttccgggtgcaaatttaacgtcatgttggacggaatgataatgcctgcgtgttcttccggcttattgacggaatttttattaactccgtcgatcaagtatacgccacgcggtatatcaacctcgcaaatgcccgcctctgatgcgtccataagcgcctgattaaatcctgttgtagtcactgccgcctcagtcccatcgctacaaataccgtacttttcgacttccaacgtatatctcattattcgttacctccaacgttatagttttcgttaatgaactccgacagcaacccggcaaacttatagaacgtcgcggtttcagttccggcgcgtccgtttagcgagaacttaccgaacatgcttttacgcaaaccggtactgagctcgatctgtaggctttcgccggttatgcacttattcgctatgttcgcgctacttgcgcctgcgaatcgatgccctgcgcctacaagttcggcactgaagccggcagcgttcaagcgatctactaacgactggccgcgaacaggatcagtgccgcctacgataatatgctcggcgctttcgctatagccgtggagagatataacgcgttggtgtcgcgaaactaaggcaagtgcggttggttcgtcgaaatgggtactcgtgatgtggaggtcaaagccgttcggcgttttgagcgattcgaatagatacgtagaatagtcgttactgagttcgcgagcaagttcgctagttccgccttcaatattgccgccgtgcggtgcgagtatcagaacgggcgaagtgcagtcgattgcgaaaatgttgtagttcgtctcgggttcgttggcttggagttcggcaaagttgcggtaaacgtcggtggcttgcgcggtgactgcggtgaatgtggataacattgcgcatagaataaacgctgtgatatactggaagtgcttcgttcgattcggacggtgcagctttgctttggtcggtggggctgcgcctccgtttcgttctttaatcgccttattcagttttcgtggatcattaatcatttcgttacccctctcggattttattaacgagggcccttcgtcgtcctaaatatacgatatacgatattggatgtcaacggatttgcggaaatttattcgatatcgtataatggtcgcagaggtggtcgaaatgaaactaaacgcaacaccgcgcctaaacgccgttatgaaggcgaaaggatggacgcaggtaagactatcggaggcatcgggcgtgccgcaaggttcgatatcgcgcttcgataagaatagtcgccacgaagactggcacgttttttcgattgcgaaagcgctcggcgtagaagtcgatgagctattcgaaattgaagaagccgcagaagaggacgctgaataaatcggcgtcttttttttgtcttgaaattcgagcgcgcgttggtataattatcctatcgataaaagtacgggaattcccgaactgaaaggacggttataaatgaatccgaaaatgagcgttattataccggtatacaatggcgaaaagtatctttgcgattgtatcgacagcgtgctcggacagacgcttaaaaatatcgaagttttggtcgtagatgacggctcaactgatgcgacgcgcaatattttgcggtactattctacgatagacgaacgagtcaaaccgatctatcaggcgaatcaagggccgggcacggcgcgtaataccgcactgagggaggcgaaaggcgaattcgtagcgtttatcgactccgacgactggattgagccggaagcttacgcaattatgtacgaagcagcccgtgaaaacaacgcagatattgtatttacggacatgcggtgggattacgaagatacaacgaaaagctttacgaaaagttatagcgcaaaagcaaatgagccgatcagacgggacgagattaaggcgactatattaacggatttcttatacaacggatcgtacggcggcgtcggcaaggtggtccgaaaaagcatcctcgatacgtataacataacgtttcctgacgggaagtacctcggcgaagattggctgttcaacatggttttttttttcaagcagaagacggcatacgatatcgataagccgctgtaccattaccggcagattaatgacgctagtttgatgcgcgaatataatccggagctattcgattcgtacatcgatagcgatacgcttgaacggtacgcgaaacggtggggcttacacagcgagaaagttgcggtagatctggcgcggcggaaatgttatatcgcggttaacggctgcatacaaaacgaattcaagccgggctgccgtaaaacagtgcgcgaaaagttgacgctgattaagcgcatagtcgaacatccgaacgtagggaaggcggttgtgttggcgttgcagcacgaggagagctggacaaggcggatatacttggcgatgctaaaacggaaggcggtcgttggattgtttctgacgggaaaaatactgacgttgaggcgctgacgaatagttggcgtcttttttcgtggattcgtttatcatacgattctcaattatgataacctaaatgataatgaacacgactttattcgtacaaatcgggcaaaaacacgactttattcgtacacccgaaaagcgggttcgcgcttagagccgcaagggatacagccgttttagcccgtcaatcacttcttagtcttgtgagtcacaagcctccggaactacggctacgccttcgtccggtgttaacgcaatcaatatatctattaatatctgcgcgtatgtagggaacgaagtgaccggaattagcgctatgtttaaatacattcggatgtgagtacgtaggatagacgttaatagagcgctaacctaacgaaataaataacggtattctaacgataagtatcaacatttaccgtcttagctgtctatacgtaatagaaggacgtaacataccgtataacctagcgataggcaggcgggatactgccggtatacatacgctatatgtaacaccgtataggcatacgtatagttatataggaaggaaggcggcggggagacgtccggttgcgatgcgtgatgaggcgaacagcaacgggccactaccggaggatgagcccttccgaaactcacggggtcaaaccgaatgaccgacgcaatatgcacgatcctatacatagcatacggcacatggcatgcggtagggtgcaggcgtggcgcgggttctcgaatgcataaagaacatacgattaattgcgatgagtaaacgatgacgaacgctatcatatcaacgtttgtctattgattcgaatgtaactcaatttacttctgttaaattcgttattcataaatatgtatttaatatacgatgacccaaacgaagaatcgcggaaacgccgggcccccaaccgcccccaaaaataccggcgcaactgctgtccagaacttgcgcacaatttttcgaactcggggcgtcaactaaacggaggtgatcgcggtgtatatacctgtacacagtcttacggacaaagaaaaagagtacttgcgcgaaaggtttacggaacttctcgatgggaatggcgagctcaaagtttcgataaattgcgatgattcatacggccgtgctgttccgtataaaacgacgtgttttgagatatcggaatgctaaacggaggtgctaccgctggaaaatttcgaaattatatgtaagagttgcggatcaaagaacgttgtagctttcggaaacttcgacatgtctgcgtacttttattgcgaggattgcgatgcagatgaaatagaatacgattattccacgaaataagcacgccacagccgttttaatccagacggagggtattcggtagggtaagcgttagatacgctaatttcgtgtgatttttccgggcgggttagctcgcaaaataagcggaatggtttttgagcgcctgatcaacgctcccatatccgcgcggaagggttattttcggtcttaccttccgatcctatttgcgcatgtaccaagatgtacaaggcgttcctgaaggcgataatatttcgtcttttgcttcgctcgttaatatacgggcaaatcacgcatatataatgcgattcaatccgtgcgaatcccgaacacgttaaataaaacgggaatatgctccggtccgcgtaagcaggcggttaggataagcgcgaagattcgtcattagacggacggcaggcgtatatttgcgccaactatacatccggcattgtccggcagaaaacgagcgagcaaaggatgcgtcctgacctcggtgtataaacgcaatcagaacgaggcttccgcaccctacggcggcggtctttttgtgcttgcgtaaagcgagcgaataagaaatgaaaaggagacgatgtgaatggcggacaaacgcgaatcaacaagaaattcagtaatggcgggggcggctctaaacaaaacaggctactccttattagacggatatcaagctccaaaattcagcctagaatctcaaaccggaaatatctacgcaacaggcgacgttagcgtaaaagtagccgtagaggtatccgaagctataaccggcctcaaagcgctacagcgcgaagcaaaggcggcgacacaggcgctagctgaattgcgggaggagcaggcgaaacacggcggtggacgaagctatgacgaataagcaaacggaatcccaatgcgccccatccaattgttcgcgccatttcgaagtatgcgattgcaagtcgatgtgtctgctgcggtatggagaagaaatacgtaaacggcaggaagaagtcggagctgcagccggcgtatacgaaaaaagacgagcacacctacgttggctacggctcaaacgttggggcgcccgtcgtcttatagattaacattcgcgtatacttcgtcgatccggtcctgattgattccaatataccgcaacgtgaccgactgcttcgaatgattgaaaatcgattgaagtagcgtaagatctgtgccgtttttgtacgcgtggtagccgaaagtcttacgcaatgagtggcagccgattgtgccgagtttctctgagaggccggcgcgctcaacagcttcgttaaggatgccataggcacgaacgcgggtaatggctttcgaacctttccgagaagggaaaagccagtcgtcatcgtttgcttcggccggaatcaggtcggcaacggctttcttgatagtggcattgaagaagaaacgttttgatttcttagttttcccttccgtaatcgcaacaaagtcctttccgcgtacatcgtcgactttgagcgcaagtatatcggaaatacgtaggccagaattaatgccgatcgtaaataaaagcagatcacgcccgcgaagggctttttttattgcgtttatttggcgtttttctctaatcggttggacttcgttcattcgaatttcactccgttctcaatatgttaaattcatattaacgaaaataataacgaaagtcaagcgaaaggagggcgataatttggcatatattaacggaaaatggttggatcgtgaagaacggcaggagcgtatcgacttattgatcgagagtgtgcgtcgattagcggccctcattaaagcaaaaaaagccaccgactaccatatcgatgtgttccggaagaacaaggccgaattaattaaactgaagcgcgttcatcgtgccgaggtggatatcgcatatttcacctacgagtatttgagcgacggcctaaacccggaaaacgaggataatgtcgtaaggaattcggatgatgggacgcctcacgatggcatcgaagatatcgcgaagatccacgaagagtttttcgagctttgtgattacgtcaacgaagagaaaaggaacgcgcggcttgcaatcgcggctgcccggggccactctaaatccggtatgttttcgaacgcccttccgttacaccaagcggcttatagaaagcgcaaatatattctcgttatatctgagacggattctctctcgaaaaagctcatcggatgggttaacaagcaaatgaaatttaacgcaaagctgcgggaagacttcggccctatgatgcacgagtcggcgagccgcaatgaaaaggataacgaagaggcgttcattacaacgacgaatatccttatcgagtcgtcatcctccggtaagcagcttcgcggtaaaaggcacggagctgtccggccggatctcgtaataattgacgacccgtcatcgacaaacaatgaaggaaccaaggaagcgcgggaaaagcttgttcattggtttaactcggtcgttgttccgatcgggtccaaggcgacggcgatcgtgttagttgggacaatggtttcggcgaccgggcttcttaaccacgttctgaagcgtaaggatttcaaggcgagctttcacggagcgatcataagcgagccaacacatccggaattatgggacaaatactgcgaggtctatgcgagagcggaaacgatcgaagaggctgacgaattttacgaagcgcataaagaggcgttggaggacggcgtcgaactggcgtggccttggcgctggacctatcgtgagctcatgcacgagaaagtaaacatgggaacgcgcgcatacaattcggaattccggaacttggctttcagtgaagacgagcagttcttcttcccggataactacgcttactatcactactaccacgagaacggaacagcatacgtcgtgtacaacgaattgaaaatatcggtcagcgatcttctgattgttggcgcgtgggatatcgcgcagggtaagaatgcgcggtcttgctataactcggttattacgctcggcaaacacgagccgacgggatacattttcgtacttgatgaatacgcgtcgaaggagccggcgcacgtatacattgacgtcattattcggaagatcaaacaataccggcatcgttccttcaatgtcgagacaataaacgcgcaacacgaatactaccgtcagcttcaggaacgggtccggcaggaaggtctttatacgtgccgcgtgaacgatgtgaaatcgcataagtcttcgaaagatgagcgaattcaatcgatggagccaatgctgcataacaaaacgctaattctgaacgataggcacacgatgctcctcgatcagatggcgcagtatcctttcggcgattacgttgattcacttgacgccctacagcaagcgctcgaatccgtattcagaccgaaaacaaggctggtgaagaagccgggatggctataagaaaggaggcgataaaatgtcgcggatgaaagagctggaagcaaaactaacgcttcagcaacgtaaggcagcgcaagtcgttgcgagtaatgaagtcgcgcctgaagacgggaacaaacgaagtcaggacgaactagccgaagaaatcggtgtaagtcgcatgacgctctatcgatggcggtttcaaaatccggtattcatcgaatacatgaatctattagcggacgacatgctttccgggcaccggtccgaggtatacggacagcttatgaagctaataaaaggaccgcagtcctcagtaaaggcaatcgacctatacctgcgtcgttacagcttactaaccgatcgtcagataacgaccaatgaagcagacggaggcgcccgcagtaacgaagatatcgagaaggaactcgaagaactagctgacattatcggagaggaggaatagcgttggggtttttcaacttactaaagaaacacgaccagccttcggatgaatacacagtcaaaaagacatacagtatcattcggcaaggcgcgcaatttcctccggatgattcaatcgagaggttggcgaagtataagcgtatgcgtaagctcttcgaaggaaagcaccgagacgtgtacgaaagggctacggacattttaaaagattcgccacaatcgaaacagcttgaaaagctctacattgcggttaatctggctgacatactcgtcaccaagcccgcggatatgctcgtcggagagccggttcattttgagagcggactggacgacaccagcaaagagcagacagctctcaaccgatacgtagaagaaaacgatctcaatcaactgctacacgagagtgccatgtcgaacgggtatcgcggtgacgcttggattaaggttcgatttggataccgtcaagactactctgaactcatttcgaggggattaggtattccagaagaagcgaaaatggagtccgttgttgagcatgttaatgcgaattgcgttttccctgagttttcagccggaaatgttaagcagatcaaagcggtcaatatagcccaagtcgaatgggtagagacggagcagacggaaattcctttcctaaacgtagagcgccatataccgggacatatcttttatacgcgctacagactatatcagaatggcgtcgatgtttcaggcggcgccccaatcagcgttttcaatataggcgaagaggtaccgacgggtcgcgaagaagatcacgaagaaacgttcctcccgcacattccggtctttcacataccttataaatcaatcgatgacagctatttcggtattggcggattggagaagattgaaacggtattcgcagcgatcaacgaccggcttgttcagatcgattatattctttggaaacacagtgaccctacagcgtatggtccagatttagaaacgactaacggagccgttcagtttggtggcaaatacattccggtaaataaagacgacccgacgcccggatatatggtgtggcaggctcagcttgatgccgcgttcaaacagctcgacatgctattgagtattgtctttcagatgtctgagactccgcaatggcttttcggaacaacaatgtccggagataattctggtgggaccgggacttcgcatacagatggcgcggcgataaaagctcgattcatgcctatactttcgaaaataaaacgtattcgcgcccattacgataaagcaatacgcgatgccctttggacgtgcatgctgctcgaaaaagcagtcggtgtcatcgacgttgaaaatgcggtttatccgcgggctatttggagcgacggacttccgaagaatgaaaaagagctcgccgaaattatgcaaatccgtacaggcggcaagcctacgattgatgttcgcggagccattaaacagcaggatgacgtggacgacgaaaaagctgacgaaatcattcgccgcattgaagaagacgaaaaaacaacgagtggctttgttgacggatcaatttttaataaggaagagccggaaaagagcccttcagacgaggataaagaggaaatcgcagaggaggacgatagttaatgtctcgctctcctgagcctcaatacgattatcagacgaatcggcttgctggatattatcaggaagcggtacgagacattttggcggagcttgaacgaattgatctcgataattttcgaagggctaacgcgttggcgaccttgaaatctattagcgggattctcagcgatttagacgaaaaatcttccgcatgggtcaaaaagaatgttccgaaggcggccaccgatggcattgcgcgagcactggtcgcccttgacgtagcaaagacggtagctgacgcggaaaagatcgtttcttttaacgaggtaaacgagtacatggttgcggctgctgtagcggatacgcagtcggatttattagcgatcacgcaaaacgtcgataggaagacgcgggccgccgtgaggaaagccgtgtcggattcgatgcgccttaatatgaccaaagggacgaacggacggcgcagcataacggatctggtgcgcaagtctcttcgggcttcagtgagtaccggcattattgactcgaggggaaatcgatggaagccggaagtgtatgcggatatggtcgtccgcacaaagatgatggaaacctatcgggaagctcatacgaatgaggcggtaagccgcggagcttattatgcgcaaatttcgtctcacggggcgaaggatttatgccgtcttcacgaaggacaaatcattaagctgaccgacgatgctcccggcaattacccgacgtatgatgaactcaaagcgaccggggagatatttcatccgcgttgtaagcacgtaatttccacaataagaaacccatcaagcgccatgtagcgcttttttattttgtccgaacgttatgacgttaaaagaaacggctgcatcactcaatagccgacgggctttaagcggtggagggactatatgagcgaagaacttaaagaaacgcaaacaagtgaagttaccgatcaaactacggctgaggtgccggaaaataaacctgaagcgcagacggtgactatgacgcaggaggagtttaacgctgtaattgctcgcgaaaaggggcgcgttaagaacaagtacgctgactatgacgaagtgaaggcgaaacttagcgattacgaaaaagctcagaaagaacgagaagaggcggaaatgaccgagctggaaaagcttacgaaacagctcgacgaaaaggccgaagctgaagccaccttcataaagcagatcgaagatttaaaagcggcagctgaacaggaaaaagtagcgaacgaatttatcaaggttgctacgagcaacggcatcgcctacattgacgacgctttacgtctggctgacctatccgcggtaaaggttgaggacggaaaagtaatcggcatggaggacgttgtaaaggggctcgttgacaataaaccgtacttggttgcgaaacagcaaacgatgaaaccgatcggccagccctctaatagtggaggagaggcggacggtggcgaaatcaagacgttagaagcgcaactaagcgaagcgaagaaagaaaagaatttttcgaaggttattgagctttcaaacaaattgaaatcacttttgaagaagtagggggaaaataaatgttaactagttacgattttaaagatcaggtacgacagcttgacgccggaattgaccttattattcaggatgaaccgacattactcggtctgatcggattaaatggagaggcgctctatcagactaaattcgagtggatgtctgatcgactgaactcaaacctcgcgactgttaaatcggtagcggaagacggaaaaattactgtggcggaagatgacggagagaagtttcgtaaagatgccatcgtcgtttttggcgaagagtatctgaaggttactaacgtgtccggtgatgtgcttactgttgtccgtggatttgacggaacagttcaagaggaactcaaggcaggctctgagctgcgtattgtttcccgtccccaaaatgaaggtgccggtgttggtatcgatgaagggcacgaccgttatgtagattacaacttcacgcaaatcattgaaagatatgctgccgtgtcgaacactcaacaagcagtccgtactcataacgtatcgagcgagcttgattatcaagtgcagctacgtcttaaagagatggcgcgtgaatttaacgactggttgatctatggccgcagaattgacggcaagcctcgtatgactggcggcttacttaactttgcgaacttgaagggcgctgccaaagctaacctgaaaggcgaagaagtaaaagcgaaggatattaatgcgctaatggaaaaagtttatcagcgcggtgggtcagcaaatacaatccttacaaataccgcgggtgctcgtcaaatctctaaaatggcaacagatactattcggacagagagaacggatgcggctaccggccaccgcgtaagtacattcgtttctgatatggttggcggcggagtcgcgactgtagtcgtagatccgaacttccctaaagacaaaatcgcactcttcgaccgtagtattctatctctacatccgctgaacggccgttccgtctacgatactgatgctagcgtaaatggtgccgactttgttgcgcgtcagatccgtggtgaatacggaattaaggtcaaaaacgcgaacgaaaaaatcgctatcctcgaaaatatctcgacaactgtatcttaatggaaatcgacgggcttcggcccgtctttttaatttgaaaggaggccaacaatggcaattacagatgaccagaaacggagattaaatgaatctatgccggtcgccaacgatctaaagctcggtgacatcattaaggaattacaggaaggcggaggcacggccggtccgaaaggcgataaaggagacaccggacctcaaggaccgaaaggcgatacaggaccaaaaggagcggacgggttcggtaccaaggcgcagtatgacgacatcatcgcgcggcttaaagcgttagagggagctggctcgtaataatggccgtctataaggcttcaccgttttattccgtaggcaccgaccagacgatcgttttcgaccataaaggcgtttacgaaaccgatgttccggccgaaattaagcagttgaatgcattatgtccgcgatggattagctgtgttgtgtcagacgatgagacggaaaaggcggaggcaaaggcgccgaaaaagcctgcacgtaagtcctccggaaaataaggagggctgtgcgtatggctttaagcgtagaagctgcaaacgaatatatcaaccgaatgacaatcgataacgaggattggaacgactatgacgccgcaaagcagcagcgtgtactaaacgtagccgaggacgtcttggctcgaaagtttcgtaagtacgtcattcctgacgacgcagtttacgagtttacgaatgtgcttgcgactgcttataacgatacgaaccgcctgaataagcacggcatcgcgtcttactcaatcaccggcgtcgggtcgtttacgtataaggaaacgcttcgagctgacgatgagtctctcataccgaaaaagacgatcgaccttatcgaagaagcgaacgacgtgaaacttagcggccggaccgtgaaagcgacggtgatgtaattggcgatcataccgatgcgtcagaccgtgaccgttactcgtgcttcagatgagatagacgtgtggggaaaccccgtggacatcgagccgtttgaaattaagtgccgaatcgacgaaggatctactattgcgaattcacgttcttccggcgttgtgaagagcgaggaagtcgtagctacagcgcgtatcttggtcgataaattagccgacatcaggtatacggatacactcgcattcacgaacgaattgggcgaaaccattgaacgtaaaccgaaggaaataaacgtgaagcgacatgtcagtggtaagctgatactgaccgaggtggtcgtatgagttttacgctggatgctggcgattttctatcgttattggatagccgagaggtagccgttgagcaggcagcaaaaacagcgatgcatgataatactgatgacctcgctaggcttgcgcaaaatatcgccccgatcgacaaagccacgctccgacgcggcatgaaaaagaaggttacgttaaagcgcgatagtctgatcggtgaagtatcgttccgggccgttgataaaggctttaactatgcattatggactcatgaagcggaatacaacctcggaccgaattcggcaagtgccggcggcattagcggctatccggtcggtaacaaatatctggaacgtccgctgaaaggtgaatcgcagaaatacattaatcacgtagcagacgcggtgagaagggagttgtgataatcgttgaagataaccgaattaatctcgtttatacagtcgcgggttgacggcgtttattacgcaaacggattcccacggaatgcagcagacgaatgtacttatgtgcgatttacaggcggatttcctccgtctcaatggaccggaaagagtcagccgtcgtttcaaataatcgtacgaggaaaggcaaggggcgacgctgactgcgaagaaaaagcgtatcagcttcaggaagcgttaacgaaccttcgcgaagtatttatcggtaacagctcgatcgttgttatccgcgcggccaattcggtgccattatttatcggatacgacgataatgatcgtcctcaatactcgttaaatttcgattgtgtagtgcgccctgaccgggcgcttttttaatgcaaaaataaaggaggaaaacggatggcaggaattaaaacgattcaagttcctatcggccccgcaatcgtcgagtacggcgagggtaaggatatggtgacgtttgacatcacgaagggcggcatcgtttttaaggcgcagatgtctaagcaggatacaacggtcgaccaatacggtgactcgatcgtaggctcacggacaaagggtggaacttgcgaatgtaccgtaccgtttgcgatctatgatttagaaaagattcataaggcggtgccgaacagtaagtacgtgtctgacggcgacaaaaagaagctagtagtcagcggtaaagccggatatgacttactgaaggacgcgaagcctttacgaattaagccgacagatccggaagcgacggccaacgactggctcacgattccgttagctggtgcgtcgactgacatcgaatatacgtatgattccgataatgagaggatcgctaacctaacgtttaccggttatccggacacgatgggagacggcgatctttttattatgggcgacgaaacggccgggacctcttccggaaccggtagcgaataacaaacgaaaggcatcgtcgaggggcggtgtcttttttaattaacgaaaggagagtcgcatgaacattttcaaaaagaaacaggagactgattcgatccagctcggtaagtatccggtcgaggttgcgaaacttactccggcaaagtggaaacagcttttcgcagcactcgataaaattccatttctcgttctggaagtctttagcgcgcctaaaacggatttctactcgtatttagtaagcgcgattgaggtcggtatggatgagatcgtcgagattacagcattattgagcggcgtagattccgagtacattcgagaagaagtcggtacagacgaaatcatcgagtacatcaccctcactgttaaaaataatcgtctcgattcgcaagcaaaaaacgtgaagagccttcttccgaaactcgaaaagtagacgaagggggcgatccgtatacgattgacgactatctgatcgaagcggctatcagtttaggcgtcacgcagcatcagatagaaaacgagttttatatggtagacataccgaaatttgtgcgcgctaagacgaaacaaggcgcagtaaggcgtatagaagacattcgtgtacttctggcgacgaatagccgggcaagtgaggacgacgagtataaacaactcatgaatacgttgagtcgagcggcaggacttcgccctgaagtgaaattcgaccgtgataaattcgagcaactacgggctttacaggggaattttcggaaaggaggtaaatagatggccggaacaacagtcggagaaatccgggcgcgccttgtattagacatggcggactggtcccgtcgatctcagcaagctcggaacgatatggatcaaatgggccgttcatctgcgaatctctcgaagcaaatgggcctcatccaaaaggcttcgcttgcagtcggaggcgcagtcgtagccggtatcggcgtttccgtcaaaaaggcggctgacttcgaggaggccatgtcgcgagttaaagcgatcagcggcgcgaccggtcaggacttcgaagatctgaagaatatcgcggctaagatgggcgccgaaactaaatatacagcggtagaggcggccgagggtcttcaatacctcgcgatggcgggtttcagcgtaaaagcgcaagtcggatcgttgccggccgtgctcaacttggcggcagcttcaggcgaaggactcggccgttcagcggatatcgtttcgaacatcatgaccggcttcggcattaaagcggaagactccgggcacgccgttgacgtactcgtaaaagcgatgacaacggccaacacggatctgccgcaattaggcgatgcaatgaaattcgtggcccctgtcgcgcactctctcggatactccatcgaagatactgcgacggccgttgcaaaaatgtcagacgccggtattcagggatcgatggcgggtacggcgcttcgtgcgtcactcttacaccttacgaatccggtagggcagtcggccaaggcgatgaaaaagtacggcatcgaagtaaaggacgcgcacggaaatctaaagccgataccggaactcgtcggccatatttcgaaacaattcgaagggatgacgtcggcgcagaaaacggcagcggcggcacagctcgtcggagttgaagcggcttccggattcgttacgcttttgggcgtcggagaaaagggactgcgcaattattcgaagacgctgaaggaagccggcgggactgcggataaagtagcgaaaacacagatggataacctcaaagggtcattcgaacagtttacgtctgcgctcgacggcctcggaatcgcgatcggtaacgagtttttacctactttccgaaaaattgtcgatactggtacgaaggtggtcgagttccttagcgaactgaatccgggaatcattacgacgggcctcgaaatggcgggcgcggcggcagcagtagcgctggttgcgtcgtccatgatgaaactcggaatcgcagtacgcggtttgttcgttgcgatggggcctgccggatgggtgattaccgggctctctttattagcgggagcacttgtcggggtaaaagtggggtacgatcagatgaacaccgttagcttagaggcggccgagtcgaagcagaaggaaattgactcaatcaatggcttaacgaaagagttcgataagcttcaaaataaaacgaagctgactgccgatgaattcgtctactacctcgatttgaatgatcgaattaaaacggagacagatgccaattctattaaacggatgaaggaagagcaggaagagctgaggaaaaaatcaggtcttacaaacgaggaatttaatcgctacttagatttaaacgataaggttatcgcgaaagctccggacactgcggctgctatcagcgagcaaggaaatgctgcagcaaagaacacggacgcattaaagcgtcttaacaaagaaaaagccgaggaactccggctggaactggaaacccaaagggctaaagctgaggccaatatgtctaaatatatagccgaagaagcgcgactaaaagaaaaagttaatgcgttgacgagagagcgatccgatttagagcagcaggtatctgatcaattacaagttgtggcagctaaagagagcgaattggcggcagctaaagaggctaaagatacagcacgggtggcaatagctgaaaatgagctcaacttagagcaaacaaagttgcagagattacgagaacagttttctacaaatatggaaaacctgagctctaagaatcaagagctccaaaagacccgtgagaatatcaatcagctagatgtcgttaatcagaaaatgatcgaccttgagctacgtcaagttggattaaacgccaaaaagggcgaaggcgtgagagtgatcgataaggagattggacgcttacaagatgcgaaggcgaaccttaaaaatgttacgaatgttgccgatcgtaaaacggatgagtaccggaagtctgttaaagcgattgacgacgagatcgcaaaccttcgtactgcaagaggtcgggtcgcggatattacgtcagaagcccaaagaatgaacgctgctctaagtaaggacatcacgaaacgcatcacgacaattacatcggatgtttctatgaagacggagcgtgccgtaagtcgcggaaaagggaacgaaggtacttaccacacgggcggcgtcatcggccttggtcagatcaataaacttcatatcggcggtctagcgtctcaattcgctaacccgatgagccacgaagtcgatatccgggccctacgaaacgaaatggtgcttactgaagcgcaacaggcgaatcttatgcgaatgatagacgctggacatacgtcagggctcggaggagaatccggcttatcatcggatatgctgcgcgcgctcagttcgattgagcaggcgattaagacgaagggtggcgctcctatcgtgatggatagtgaagttgttggccgtattgtagagccgcacatcagtcgcattcagcaggacggatatgatctagaacggatgagagacgggaggtggtagcgtttgagtaatacagattttataaagaaaatcgccccggatgcgcagaagatatttgtgaattataaaattctagcaagccttgtaatcgcgcagggatgtctcgaaagtgcgtacggaaccagcggtctcgccgttaacggaaagaaccttttcggagtgaagggcgaatataacggaaaatacgtcatcatgaaaacgtgggaagtaatcaacggaaggaacgttcaggttgacgccaagttccgaaagtacccgacgtggtatgagtcgatgcaagaccttgcgaagctttacgtaaacggcgtcagttgggacccaaaccattataaggcggtcgtaggtgagaagaattacaaaaaagcgactgctgcgctggtagacgccggttatgcaacggacccgtcttacgcgtcaaagcttaacagaattattgaaacgtacaacctgacgaagtatgacaccgccccgtctccgtcgaatccgtccactccttctacgccggacacaaacaacccggctccggttgtcgttgaagagccggaggtatctatcgacgttttttcaagcgtttatacaacgcctccatccggtgtccctattacggatagcaacttccggatactttacaaggatggacgcataatcgatatggctcgcgatttatcggtccttgtaaggagcttcaaaattgcatcgcccactcccgatatcgattacgaaacgattccgggaagggacggcttagttcgagtagggaaaaacttcggagcccgaacgctgactgccgaatgtcttttgctcggagcagatgacgttgattttcatttattacaagcggaactctttcacgcgcttcatcgcgaggaggagttctttttagtttcggaagcgacgccgaaaaagcgatggcgagtcgagttaagcgcatctttcacgcctgaccgaatcggtagctttggcgactttacgcttactttccaaagcgcctcaacttattgcgaatcagtcggcacaacgctggatgcatttacgttcgaagcgaacaaatggcagataggcgaggggttgacggacgatatcccttcgtacaaacacaagacgaagactttccgtattttcaatgcgggagccgtccggttagatccgagatacatgcctttaaaaattacgtataaaggcgcgtcaagtaaattgtcgatcaaaaacagaacaacaggcgaccagtggacgttttccggcacttcctccgcgaaggaagcgattcaactttccggtgttacatcgaaaaaaggaaacgtcagtatattggggcagacaaatttcggacttattacgttagagcccggatggaatgattttgagctaaacggaacaagcggggattttgagatcacatttgatttcagattccactattacgcgtagggaggtgcgccatgtcgagtctgcttgtaaaaaatctcgctaatcaagtcgaagcattaacggacttcaacgtaacgaagaaagatgaaattgagaacggtaggtctattgatgtaacggtttgggagacggacagaaacgcgcactcttttccgttaattcaaaatgaaggttcccttttttatgaagacgaggaattcgtcattaggaaaacgcggtatgttcctattagcggcaagagactgaaggtcgatatcacggccttgcaacgttccttttcggatctcggtgagaattacgtatatgaaacatccgggaaaaagaaaaaactttacatcgaggatatgctggacatcgcattaaagggttctgggtattcttacgaggttttaccggaagggctaggtgattcgtttgaagtggaggattttggaaacggctactctctcggattactaagcgatataaaggaaaagtattcggctgaatatgagtgcattgggaagaaagtctatttcgcgaaggagatagcgcgagacacagactacatcatccgcgaccgtgtaaatgtaaaagacccttctcaggaaatagacacctcttctataaaaacgtacattaaaggattcggaaagaaggacgaaaagacaggaaaatacgcggtggaagctgagtacacaagtccattagcttcagtctatgggatcaaacatgcaaatcccgtatttgatgactcgtacacagcaaaggatgagggaaagctcgaaaaacggttagaaaaagaactgaccgataaaattgaaatctctatcagccttacgtatatagaggttaaacaattaaacatgcaggatattcgcaaaggcgattatgtatggtgcgtattagagccctttgatttgaagacgaagctgcgtgtagtcagtgtggagacttattcagatcctaaaaagtctccggtttttactttcggtaaggttcgggcaaatatcaaaaaaacaactgctaaattagggcgaggacaaagctccgtctctaagcttatcgatacgtcgaccggaaaggtgaaaggaagcgccataagcggaaacataaccatcggaaaagacgcgatttacgaagacgggtatgatccgacaaagctgacgattcctacgtacggccgggcaaacgcaacaacggacgggcttatgagttcgtcggactacgtgaagctggcgagtatcgtcttagggcccgacggtcaagtttctgtctcgctggctaccgaaacaacggacggcttaatgagcgcatctgacttcacaaagctgaagcgcatcaaggtcggtacggctacggtggatatatcgacactttcgcaacagctcgaatctataaacaagcgcctgaccgcgctagagaataaataacgaggaggaatacaatgccgaaatttccgtacagaaaggccggggcagcgtgggaccgtgtttttcgtaacgaccacaaccaaaacctcgatgatattgcggacgatattaaaggatcatatacgggattggccgcacataagaacgcgaaaaccgcccacacgtcggagcaaatcgaccatggcggtttttctttgcgcacatatatcgacggcctgtataaccgtatcagaaatctgatccttaacgcggacggtacaaacgtaaaagaggtcgttgacgctcgtgtagacgcggaaggaaacatcgcgcctttattgaaggagcgactcgacaaagagtataacaagcttttacgcaaaattgagcgcgatgtaaacgtagacgactacggggccgacccgaccggagagacagacagcacagaagcatttaaaagagcgattggaaacggaaaggttcggctcaatctatcagccggcgaatacgtgataaggggcgtaaagctgccgtcatggacgtatttgatcggccagggcatgggcgtcaccacgctaaaactgcacgaggacacgccggccagtgagtgggttgtcacaaatgctgatcatggcaaaggcaaccggaatatcgtggtggaaggtatgtcgcttgactggaatcctgatcgtcagggcggcgttagttcaacgggcggaatccattcgagctgcttaacttttgcgcaagtgaagttcggcatcgtccgggaagtcgaaggcattaatccggggctccactgtttcgacgtatcggccccttcctacgatattactgcgaaggattataccgcaacaggtagtaagtacgtctggatcgatcgatgcgtcggctatggatacggtgacgacggaatcactacgcactacagcgaatatatcttcatcaccaataacgtaatgacaaatccgcgcggcacagcccaccgtaaaggcggagctaattcgaacggtatcgaggtcgatgacggatctaaacacgtatggcttcttgataactataccgaaggaaatgtccgcggcgtagaggtgaaggcacatacggagtggccggcgccgtgcaatgtccacattcgcggacacgaatcttttcgggatgtgcgttcgttcgacttgcggcatatcggacaccacttagcgactgatccgtggagcgagacagcaagggacgtaacgctgatcgactgtacttcacgagagccgatattcaattcgctttatgaagggctggagccgaaagcgctagttgtctcggcataccaacgcgtgaagataatcggttttactgcgatcggtgatcctacgtatgactataaaggaaaatcggtgattgcctttcaatacaaaagccggaagataaccgtaactggtctgcaaatttccggttttaaaaaggccggctatgatatcaacattaccggaggtgaccagcgcacagatgacgtctccatttccaatttcgtcatacatgattcagcgcagaatggcatcgagatcggagggggcgtctataacgtaaacttggaaaacggaattcttcacgtagcaagcggtacggccggcattacatcgccgaatacgcaaacaaatatcttaatggtccgggcgtatggctacgagagtgcggcagtgctcgggggtcagaaacattcggttgtccctaacaacgtgaaaggcggtttccgcgctgcttctacatcaggtcacgttttagacaaaacaagcgcagtcattgcgaccacgggcgggtgtacaacgaaaggacctagaaacgtcgttttaggcgccagcggtggttcatccacaacatcttcgcgtcaagcggttatagcgtcaaacaattcacatacaaaaggcgacgggccatcgagggtcgtactcgctgccaacggggttatcaacgataacggatacagcgtcagagggggctacggaagcggaagcgcctcgaccggaaatacgaaatgggaactcgattcaactggcggtcatattcgcggcacagggcgcgtggagagcgtctcagatttcaaagacttcgctgagtatttcgaatctgctgatggtcagaaaattgattctagctatctcgtcgcgctagaaggcgataggatacgaaaagcaggcgaaggagataagatactcggagttgtttcggaaacggccggtttggtactcggaggcgcggcgttctattggaacgatcagttcgaaagaaacgaattcggcggcttggtttacgaaacggttatcgatggcggcgaagagttaagcgttccaaaattaaaccccgactacgacccctctctcgaatatgtgccgcgtgactctcgtgacgaatggcatgtcatcggcctgatcggccaagtctttgtcaggattgacgaaacagtggccgtaggggatagcgtttcagcaatcgaaggcatcgcaaccaaggcagaaagcgacggctatgggaccgttatgaaaatcaaatctccgtatgacgcggaaaaaggctacggtgtagcgcagatgatcgttacgccacagcactaaggaggttttgtagtgatatacaataacgcatcacttgcgtttgaagtgacgagtcggacaaaaacgaacataaaaaccgcaatacagttcagcacgcaagacatcgatactgcacgtttaatcttctcgttaacaaaggatggcgtcccgttgccgttgtctgctgttaccggaaagctcgtcatgttgatggcggacggcagccggtttataagaagcgtagagatcacagataaagtcgaaggggttgcgcagtacgttctatcagccgaagagatccgacacagcggcgatgtgcaggcggaactttatctgtattacgcgaataaacaggcgctttccatccataagttttcgtttaccatcgacaaggcgctgattgatacggatatcataccgttggcggaatactacgtggatgacttcgaagcgttgcgccaacaaatcaacgacttatacgacgaagtggtcgaaacagtcgaagagctgcgcaagaaattcgaagacctcgaaaatattgaaacgaaagaaggagcgcaagcaaaagcggatgctgcggaaaagaatgcgaaatcgtatacggacactcatacgaaaaggacggacaatccgcatagcgtaacgaaatcgcaaatcggtttgggaaacgttgagaatgtgaagcaggagacgccggacggtgcgcaggcaaaagctgacaaggccttgatggacagcaaagcgtacacggacgaacatacggcccggactgacaacccgcacgtagtgacaaaagatcagatcgggcttagtaatgtagacaacgttaagcaggccgactattatgcgtttcgccaacacgacaacaacggagaacgccacacatcaaaagttgagaaggacaagtggaacggttcgcagttgtttaaattgacgcaggataccggtgcggcacagtacatgacaggcatcgattttaatacggtgacagataccggattctattatatgagcggcgcaacgacggcattgaatgcgccggtaaataacaacggatatcttctcgttcataactacagcacgtacgcgtatcaggaatacacgtcctatagcagtaacgattcgacgtcttcgggccggcggaaatttatgcgtaataaggtcgcgagttcggattcttggacgtcgtggcgcgagtttgaatcggtagaaggagcgcaatcaaaggtagatgcccacgccaacagaacggacattcacgttgtacaggcggataaagataagtggaatagtccgtgggtcgcgacgtggaataacgttactttgattaacggagcgcagcaaaacaccggctatccgttcaagttttcagtagcgaataacgaaattaaactgcgaggcacgttcggctcgctgccggccgccggtacgacggtagcgaaattcacgtataagccgacgcagctcgtagatttcgtcgttcctacgattggctcttacggtacggcccggttcgcatttacgacggacggcgaattgcggttcgatggtctttcagcaaccgactcggcgagcgttacgcgtgtgtcctttaatatcggtattccactatggtaaaggaggaaatcagaatgcacgttttatactacgataaaaatttcgactatgatggcgaagaagatatcgatgtagaagtgctgccgccgaacagtacggatgtcgtgcctgccaaggaaatcatctcgccgcgattcgataagaagaaaaacgtatggttcgatgtagcgacagaggaatacaaagagagcattaagcctgatccgccggctccgaatgaaatcgagaatcttcagaagcagatagcggatttatattatcttatcgcgacaggaggaaactaaatgacttggtatacccgcatcaaaaatctttatgatgccggcctttggacgaaaaagcaagttcacgatactgtcggagccggtcggataacgccggaagaatacgaaaaaatcaccggagatgtttacgatcccaacaaacctcctatcgaagaaccttcggaagaaacagggagacaggaggcgtagttattgaacggcggcgaattagacgtacttaaatattttttaacgcagggaccgttcgcggtcctttttacgtggctgctgatttacgtaatgaaatcgaatagggagcgcgaatcgcggctacaggacttactcgataaatttagcgataagtatgacgtcatcatcgacaagatcgatagactcgaagagaaattccgcggaagagaataactgaataaacgcaacacgcccgtcaggtgagagtcccggcgggcttttttaattcaagaaaaaacgaaaaggggacgatttaatggcgatttcagtacgtaagaatctcgtttcatcaagtaagtattcgattaagtgtccgaattcaatggatgcgcaatacatcacgtttcataatacggccaacgatgcttcagcggatgcagagatccgatatatgatcggaaacaacaacgaagtgtcttaccacttcgcagtggacgataaggaagtcgttcagggtattccgacagatcgtaacgcatggcataccggagatggtagcggcgcaaattccggcaaccgtacgtctatcggagtcgaggtttgttactcgaaatcgggtggcgctaagtacgaagcggccgaaaaactggcgatcaaattcattgcgcagttactgaaggagcgcggctggggaatcgatcgtctgcgcaaacaccaagactggtccggcaaatactgcccgcatcgcgtgttagcggaaggccgttgggaatccgtgaaagcggcaatcgctgcggaactcaaagcgctcggaggcaagtcttccgcaagcaaaccggccaaaacatctggatcgacatacaccgttaagaaaggcgacactttgtccgaaattgcggtgaaaacaggcgtcagtatggcgaagttacaagcatataatggcattaagaatgcgaataagatttcggttggccaagtgctgaagctgacgggatcgtccggctcttctaaaccgtcatccagcggtaagaaatacgtttaccttccggcttcggccgactcatggcgcatctatccgacaaacaaagcgcccgtcaaaggaaacgagataaactatttgcgcccgaaaaaattcggcggccttaaatacgaaattcttgcgaatccccaaacggacgtgtacacgatcaagacggaccaattcggtaaagtaaacatctatgcggcgaagtctacaggcgcaacagtaaaataaacgaaaagggagacgataattatggaagaagtattaatttttgcgactatcctcgcgcctattttaacggcgctcgttcagctcgttaagaaaacggttaagttgccgacgaatatcgtaccggctctcagtttcgtcatcggtatcttattgggcgcgattgcttatccgtttactgacctcgatttggtgctgcgtttgtgggccggcggctttgcgggtctggcagcgacgggcctcttcgagatcggaacaaagcgagagggaactacgaaataaaataacggaactttttgtgggcgcttgcgtatgaatacgtaggtgtccgtttacataacgaacaggtattgcggaaaaagatggtcggatagtatactttaactacgaataggggaggcgtggaatttggagaagattactgttaaggtgcttatgtatttgagcgtcatttgtgtagtagccggaattattgcggggtttgtagtatacgataaggacgtagcagaagatgcaaaaacgagtaaaaaggtaagcgaagaactatacgataattctgtcgctcaagcgcaatataaaacggacaaagcacttgcgaacagtatgcagtcttccgtgttctttagcgtcttggccggcgtagtatccggcgctgttcttttcggactctcgattattattcgaatcttagatgaagcgaatagtagagcgcatgaatcagcgagtgatctacgattaataaaaaacgatattcgcgagcaaactgcgaaataataaaacagccccgtccttaaccggatggggcaatttttacgtttatgatatccgcaaacctcacgaaattagtatcgcctcgtgcgtccttcacacgaaattccttccgtatgtggtccacgtaatggactgcgccgattacttcgcgtatgtatccgtcgtcgtaaagctcgaacgataaatctgagcctacctccatcgattgcgcgaccgtcacttccatatcctcgatctgctgcgcgtccagttgcggcttctctactttaagcttcgcctcagtcaatcgctgaaacccttcgcgtaactccggtaagataaagctcgaagcccacagtttgttatcgctagtcatgccgaacacctccggctttattatatgcgaatatgtgttcggttatcaatcggaaataatttctatgatctcgctgatgtcgtcgatttcaaacgtattcacgattcgatccaagtgttcgattgaaatccggaccacatgattacgtgataattgagagatggctgcggggcgtattccgaccttttccgaaaattcgccttggtttaatccgtgcttctccattaacttatcgatacgtaaaaccactcgtctcatacgtaacctccgtccatttttatattattataatgcgcaaactgcttttcgtaaatacgtaaaaaagaaatttacgcaaaaacgcaatttaatattgacgaccttatacgtatatgcgtaaaatacgtattaacaaatatacgtaaaggcggaaacgttatgcattacttagcggagcatcagacgtttgactcaacggctgctctaaacgcggcagtatacgagcacattaagcgcaatacatacgatctgaacgacaccgaccgccaagcgctgaagaagatcgcccgatatgcggttaagttcagcggggcggcgcacctgaaggcggagacgctggcggaactcatcggaaagtccgtcaagactgcgcgccgggccctgaataaattggcgacgctcggcatcattaagaaaatcgcaacaacgcggaagataaacggagggaagggcgcgaacataatcgtgatcatgcccgctgaagccgccgatgaccagtcgacaatgtccaatcgcggacaagccgaaaagccaacggagacaacggccgaggcaccgaaaacggaaaacgaaccatcggattctattaagcgttctaaaaaccaaaataacgtattagatacggcggtcatcccggctgaagcgttaagaggcgcattgcctgacgaaatatttaacgcgatgtctcgctactttgacgccgacgatatttataaatactacgggattttacttcgcgctaaggcaagcgtagacagaacgatcagactcgaagaacatgcggcgcctttcgtggaagcgtggcacacaacgattatgaaagcgaaatcgcacgaaattagacgtttcgacgattacctatacgcagggtttaggaaggcggcttggaccgttaaggcgcgcttaaatcgtggcggatcgcttatggaccgtttcaggcaggcgtttgaaacagcgtaacccagttcggacttgcggcgtagtgcgtccgcatcgtataattgaataagagacgattgactaaacggtgactaaacgttgatacgcttgactttccgtaatgactaaacggttgacttatcggaaattaattacgtgaagctggcagcgtagaggtcaggggttcgagcccccttggctccatacctttaaacccttattctataaataagggtttttttgttttttcatcctctgcagcagcctctgtgttccgcttcatttctaacaactcaaaataaaggaaagagagaaaatgaaaaagaaaatctatcttatattatctctgtcagctgcactggcacttcttttaacggcgctcccggctctttctcctgtcatcttcacgtctgcttcagaaaaaggagccatcaggcatgacatttataaaaaaggatatccgtatcaaagctactttgcgattcttcaaaaagaagaaggaggcggagaggacgggaacctttattatgtaaattggttcaattggaaagatgaaaccggacagacgccgcacgtatgttattcaaaaaaatcgtccgaaggcgagtacaaagtaagctgcggaaccggatcgtaatgatcaagagcccctctgcaatgaggggctctttctgtcgatgtggatccgcttaataccccctatagaacggctgaacataatgccgatacggatcattcggataatgcgtatttggctgataaggcttattcatatcatgaatacccgtgttttcagactgtccgcagtatttatcgggacctatcacagttgattgccggatcggtgaaacggctttttcccactcgtgctcattcagacagtacgtatgcgccatgatctcaggcggcgtcagacggagaatatccgagccatatatcacttcaggcgaaggggcgtcaaatatggccaaaaggtgggttttgtctgaagtggcgacttcataatgccaccacccctgcggaacattcgccacttgtcctggagagatcggataattccgtattttctgggtgaacggattcagcatcgacaccaccgcggaacccgaaatacagtacaccaattcagcggcgttttgatgggtatgcggttcaatcacatttgttttactcagaaagatatctaataatgaaatattttcaagcgtgtttaactgtttaatccccaatacattgataaagttccgagcatctttcgtaaaaaaacggctctcatttacatcataagtgaactgtgtattcggagacgtgtaatcgatatcggaaaccatgcaatcccccgctttcatctttaaacgtatattcccaaatatatgtgtccctgtttcaccgggtgataaaaaaggaggtaaaatccataaattccaaattcaacacaatattgtgacgacttttttaaagattcattttagatatatcttttattcgaaatatctcttactataaagatatattaaaaatacatctttagaagggttgaggatgaacatgctggatgagagaacagtagacatcatcaaaagcacagtacccgtattaaaaacacatggagaaaacatcaccggacgcttttataacctgatgtttcaagatcatcccgaactgttaaatatgtttaaccaaacgaaccaaaagaaacagactcagcgcgcagcattggcaaatgcagttattgcggctgcggcgaatattgatcaattagaacaaatcattccggcggtcagacagatcggccataaacacacaagtatcggtgtaaaaccggaacattatccgattgtcggaaagtatctgcttctggcgattaaggatgtgctgcaggatgccgcaactcctgaaattatgcaggcatgggaaaaagcttacggtgttattgcggaggcttttatcggcattgaaaaagacatgtacagtgaagccggatggcaggggtataaagaatttacggttatacagaaaacaaaagaaagcaaagatatcacatcattttatatcaaaccgagtgacggctcttcgcttcctggatttgaagcgggacaatatatcagcattaaagtgaggattgcggattctccttatacgcacattcgccagtacagcctgtctgatgcttctcgaaaaggcgcatatcggatatctgtgaaaaaggacggagcggtttcttctcatctccacaatgaagttcaagagggagataaacttgaagtcagtgcacccgccggggatttcaagctgtcttcttccgaaaaaccggttgttcttatcagtgccggttccggaatcacgccgatgatgagcatgctgaaaacagccgccgaaaaacagcccgagcgttccgttacttttattcatgccgcgaaaaacggagagtacgccgcgttccgcaaagaggctgaacaagctgcggagaatcatccgaatattaacgtcatttatgtatacagtgaaccggcagaacaagaccgctcaggagacaagcctttttacagcggccggattgatcaaaccttcttggagcagcttcatctgaatcaagatgctgaatgttacttgtgcggatcagcacagtttatgacgcaaatgaaagatatgattcttgcactcgggtttgactctgattccgttcaatttgaattgttcggccctcagctgagcatggcataacaaaaaaagactcctcattgaggagtcttttttatttgcacgatgtgttctttctccgtctttttccctattttattgaaattttcatcaatgaccagtaaaattataaatctagtgattccggaattaaaggaaggttgatatgaaaaagaaagcaaagaccaaaagggtgcttgggtgcctttttgctgtatctcttatattcggattatttctggtatcaatggtattttcgaaattcatagtgacggaagaaaaaccgcctgaagaggtggacgagcagcaggtctttattgacagcctttccgggcatgctcaaattttatatgagaaatatcatgtccttccgagcatcaccctcgcacaggccattctcgaatcggactgggggaacagtgagcttgcggggaaagcgcgcaacctgttcggtgtaaaaggtgattataaaggaaaacacgtcacgatgaaaacggatgaatttgaaaaaggaaaacgaaaaacgattcgggcaaaattccgtaaatacagcacgttttttgaatcaatggatgaccatgccaaattatttgtcaacggaacgtcttggaataaaaagaagtacaagcccgtcattgaagcggacaattataaaacagcggcggctgcccttcaaaaatccggctacgccacagaccccggctatgctgaaaaaattaaagatgtcatagaaacctataacctgaatgaatatgacaaaatcaatgcctctcttaaagcagttgataagaaaggcgccatcaaagaccacgccattgaagacgtgtggtccaagccgtcgaaagagcggcattctattaaactggcatcggcgcaaaagtttaccggccagcatattaaagtcgtatctgaaaaacaaaacggagaatccgtctggtaccaaattcaagtgaaagataagctggtcggctgggttgaccaaaccgccgtccagttaagtgaagaaacataagcatcaaaaaaagccggcagcttgccggctttttttacattccttcagtttcaaaccttttaatatcacgtttatgccccatcagcacaaggcagtcacattcatgaatgacagtctccggagaaggggacagctgaatgtctccattatgtttcacggcgagaatggtgcagccgaatctggcgcgtgcgccgagatcaagaagggattttaaatgcagctttttagtggctgaaagctccacaatgctgtattcatctgacaaatcgatgtaatttaagacgttttcatctgaaaggctttgcgcaatccgcacgcccatatccttttcaggatggataatacgatcagcaccgatcttttcaagcactttgtgatgataatagttttgcgctttcacccaaatattagggatgttcagctccttcaataacagcgtcgtcagcgtgcttgcctgtatattggctccgattgctacgatgacatattcaaaatttctgatgccgagcgactgaagctcgctttcttccgttgaatttgcccgcacggcatgcgtggcataagaggagtatgcgttgacccgctcttcgctgatatcgatcgcaagcacctcatgccccattttaaaaagctctttacagatgcttccgccgaaacggccgagtccgatgacggcaaattgtttatttttgatttttcccaatcctcataactccttaagaaactgttttcgtcactccaaatacaacaaacaagaatgtactcctgtttcaggggtttgtcaatgcgagggccggaagaaagaaaacagcacaaaaaaagaccggctgacaagcgatgagcttgtgccggtccgtttttcgcaattatttgcagttgcatggctgtgtcggcggtgtgctgcgtttttgaacaacaattgtgtcctcagcatagaatttagagccgatgcttaatgatttattttctgcacggaacttatatgtacctgcagcaggcaatgttttattattaagagaaagcttaaattccgctgcgccgagcaaatcaatgtttaacggaagtctgactgttttgccgttattcagaatctgtctttcgcgcaaagcgtgtccgttgactgtatcttttgttgtagccgcaaatccgctaggaagggtaaattccataacgcctaagctcaggatcgtgttcggacggtacgtcaattcgatatcagaaaatgaccattcctgctggctggcacctgtatattttgcaaataaggtagcagtcgctttcgtggacatttccggctcgtgaacggttgagcctgactcagcggcgaatgacgctgtcggcagagaaagaagcaaaaccaggccgaataaacttgccatgacagttgagaaaaacttgtgtttcatttttataaatccccctaaaaaaaatttgctgattgttcttaaaaaagaacgaccatacctataaaaatttaccatcaattttaatggaagtaaatggggttatgttcctatattttctcaaaaataatcaaatcacgacaaaaaacgcctgaatcaaaatcaggcgtttttttcgtccgtttctatcggaataaatttaaaaatctccccgctctgaaccgagtcggcgagccgcttcagccaatgataataagctttcgagctttcaagctgatcatataactgccgcgcttcttcctgtaattccgcgctgccttcctcggccagcaaaacggactgcaaatccgcctgagcctgtacgatggcggacaaattcacctgaacttcacggtcccatttcggcggaaagaaattcgtgaaaaacgtaaagaaatccttttccgctacaaacgtatgcttccgtgtgccgcggtgaaaggtttttttgaccacatttaaatcctgcagctttttaacgcccgtgctcatactcggtttgctcatctgcagttcctcacgcatttcgtcaagcgtcatttcatccctcatatacattgttccgtataaaatcccgacactccgggtgattccgtaaagatccatcgtctctgcaatggaatcaatgacaagatccctggcttgttctatagctgcgaattctggattctcatccatactgtccctcttttcctcttgaagtttaaatttgttaagtcatttctttatgttcttaatcttaacgaatcatgacaaaatgtcaaaatctaaacggactgaccgggttttgacaggcaaaaaaacatgtgttaaattaacattgttaaaaacattaaatttttatttaacaaacttacttctcggtaaggaggactcttatgagcaaaacgctttatatcggcggcgaatggatcagtgcagaaaaaaaacagacccgccgtatcattaatccatttaatcaagaagaaattgcaacggtatgcgaaggagaccgggatgatgcggtgaaagccatcgccgcagccagaaaagcatttgatgaaggggaatggccggtgctttccgggctcgagcgcggacaatttgttctgaaaattgcggaattaatcagacgcgatctgaacgaattagctgagctggaatcgcttgatacaggaaaaacgattgaagaaagtaaagccgatatggatgatatcgcaaatgtatttcaatattatgccggtttggcggataaagacggaggcgaagtcatttcatctccgattcccgattcagtaagtaaaatcgtcagagagccaattggcgtatgcggacaaattacgccgtggaactatccgctccttcaggcgagctggaaaatcgctcccgctcttgcggctggaaacacgatcgttttaaagccgagcgagattactccgcttacaaccattaaagtctttcaattaatagaagaagccggtattccgaaaggggccgccaatctcgtgctggggccgggcgcctctgtcggcgatgagctggcgagaaacctcgacgtcgatttggtctcttttacgggcggaattgaaacaggcaaaaaaatcatgcaggcggcaagcggcaacgtgaaaaagattgccctggagcttggcggcaaaaatccgaatatcgtatttcaagatgcagatctcgaaacagctgcagatcaagcgctgaacgccgtgtttttccatgccggtcaagtttgttcggccgggtcacgtcttttggtggacgaagccattcatgatgaatttttagccgagctgatcaagcgcacgaaacgcatcaaattaggaaacggttttcatgaagatacggaaagcggtccgctgatttccgccgagcatcgggccaaagtcgaaaaatacgtagaaatcggtatcgaagaaggggcaaaactggaaacaggcggcaaacgtcctgatgatcccgcccttcaaaacggtttcttctatgaacctactattttctcaaactgcaagtctgatatgcgaatagtccaagaggaaatcttcggccccgttttaacagtcgagtcattctcttcagaagaagaagtgatcagacttgccaacgataccatttacgggctggccggagcggtatggtcaaaggatattgaaaaatgcgaacgcgtagccgccaaactgcggatgggaacggtatggatcaatgatttccacccgtatttcgcgcaagcgccatggggcgggtacaaacaatcgggcttcggccgtgaactcggcaaaatcggcctggaagaatacacggaaatcaaacatatttaccgcaatacgaaacctgcggctgtgaactggtttcaagcataattaggaggagatacaatatgacattaaatatgaaagtagaaagcatgcataaattccatacattcgaaatcccgacagtcattaaacacggaatcggcgcgattcagcacgcgggaagtgaagtcagagcgcttggcgtcacaaaagcgctgctcgtaacagacccgggaatttataacgcgggagtggcaaacccggtcattgaatctttgcaggaagcgggcatcgaagtcgtcctgtttaacaaagtggagccgaacccgcctgtacgtcttgtaaacgaaggatcagaactgtataaaaaagaaaactgcaacggtcttgtggctgtcggcggcggaagctccatggatacggcgaaagcgatcggggtagaagcgacacacgaaggaagcgtgcttgattatgaagccgcggaaggcaaaaagccgctggaaaaccgcattcctccgctgacaacgatcccgacgactgcgggaacaggttcagaggtcacacaatgggcggtcattacagatgaggaaagagaatttaaattcaatacgggcggaccgcttatcgctgcgcatttaacggtcattgaccctgagctgcacacgtccatgcctccgcatgtgacggccatgacaggtattgacgcacttgcgcacgccatcgagtgctatacgatgaaattcgcgcagccgatcactgatgccgtcgctttaatggccattgaatatgcggcgcattatattaagcgcgcgtttgcggacggagaggatttggaagcaagatacggcatggcgcaggcggcgatgcttgccggcctttcatacggcagtgaatcagcaggcgcggcgcatgcgatgagccagacgctcggcggcatcatccctgtcgctcacggacaatgcgtcgcagctatgatgggaccggtaatggaatacaactggaaaggctatccggaaaaattcgcccgcatcgccaaagcattcggaatcgatacaagcaacatgacaaccgaagaagcggccaaagcgtccgtcaactggatgtatgatcttgtaaaagatttagaagtgccgagtttagaagaacaaggtgtgtctccggacatgattgaacgtttatcaaaagaagccatgaaagatccgcagactttcggaaatccaagagatttgaatgagaaagcatacaactggatttacaaacgctgctttgacttaacgccgaaaacggtataataaatgaaccccgctcctttacagagcggggttttttaaggataatgtcaagaaaaaggcggtggtggctgatgtggaaacgcataacagcaaagacggaaggcgtatatatagcggataccgaacaatttgttaccaaaaagatggacaagcttcgcgcggaatacggcgggtttcccggtgacctgcatttcggactgacaaaaaaggccggcgcgcgtgagccgatgtatgaaagaggaacagaaatttttaaccggagacaaatttcaatcgtgtccatggaggaatgtgatgacattgcggagaagatggggatttctcatatctttcccgaatggctcggcgctaacatcgcaatcagcggtttttctgcgctgacgccgcttaaagaaggaagcagaatgatttttccaagcggtgcgtctctgttgtgcgagggagaaaatgatccgtgcattcagccgggagaagtcattcaatccttttatccggctcagccaaaactcgccgcggcgtttgtgaggcacgcgatgggcagaagaggaattgtctgtattgttgaacgcccgggtgatatatgcacgggcgatgcggtcaccatccattcctatgaaccgaaacgcgccaagaaaaaaatcgagaaggtctgactcagaccttctcgattttttgtttgatttcttctatttgatcgatgtgacgcttttcatgatggccgataaaatcaatccactgccggatcgtcagttcttgaaaaacgggatgcggaagcacacgttcaaaatcttcctcgtttaatgatgaaataactgcggtcagctgctgtcttgccgtatctaattcttgttttgcttcaatgactgagattcggttttgctcaggttcgaggtgtgacggcgccggccgtttatttgatctgtcctctataaactccatcggtttgtcttcgatttttttaaacggtgcgtcttttgcctgctttgataaaagggtctgcgctgtttcgtcaattttctttaaatggtcaaggacttcccgcacgctccactcatcagccgcgggctttcggttgaattcctcatcagagagccctttcagtacttcccaggtctgctgtctggcttcattaaaaatgctcatcctatctcctcctttagagtaaacatatcatatccggattggataatcatgtaatcagccttccttatcagaaaattgaaaccatttacctttacatccgtatataaagtaacactccgacacctcagccgaaaggaggatagaatgtggacatatttcatctgccgtttgaaacggtctatctttacacattgattatttcgggaagtctcacgcttttgattctgttttttcaagatgtgtttcacggcctctcagaagccattcctgtttcatttttaaaccctgcattgattctgtcttttttaacaatcttttcagcctcaggttatatcggcgaaatcgccgctccgctatcaagtcctgtcattgcgttgctttcatttgttctttcggttcttttggtcagcctgcttcacttcttcgtccttgccccgctttcatcagcggaagaatcgctcgcatatcgggagacagatttaaagggcagggtcggcagggtcattacttccgtcccgaaagacggctatggggaagtgatcatagagggaatagggggcgccatttctaaatcagccgtcagctttgatcaagaacagatcagatacggaacggccgtattagtgattgacgtgaaagacggagtgctttttgtgacgccgcatgaaccaatctgatatctaagggggaactgttatgactatgccgattatcattgttatcggaatcgtattctttttactcatcgcacttattgctgtatttattacgaagtaccggacagcggggccggacgaagcccttatcgtgaccggaagttatttgggaaataagaacgtccacattgatgaaggcggaaatcgtctgaaaatcgtccggggcgggggaacgttcgtgctcccggtattccagcaggcagaacctctcagtttactgtcaagcaaacttgatgtctctacacctgaagtctatacagagcaaggggtgccggtaatggccgacggaaccgccattattaaaatcggaggctccatcggtgaaatcgccacagcagctgaacaatttttggggaaatccaaggacgaccgtgagcaggaggcgcgggaggtgctggaaggccatctgcgctccatcctcggctccatgaccgttgaagagatttataaaaacagggaaaagttttctcaggaagtccagcgggtcgcgtctcaggatcttgctaaaatggggctgatgatcgtttcttttacgattaaagacgtccgggataaaaacggctatcttgaatcattaggcaagccgagaatcgcccaagtcaagcgggatgcggacattgccacggcagaagcggataaagagacgaggattaaacgcgcggccgctgataaagacgcaaaaaaatcagagctggagcgggcgacggaaatagctgaagcggaaaaaatcaatcagctgaaaatggcggaatacagaagagagcaggatacagcaaaagccaatgccgaccaggcatatgatcttgaaaccgcaaaagcgcgccagcaggtgacagagcaggaaatgcaaattaaaattattgagcggcaaaagcagattgaattggaggaaaaagaaattctgcgccgtgagcgccaatatgactctgaagtgaagaaaaaagccgatgctgaccgttactcggtggaacaagcggccgcggccgcaaaagcgaagcagctcgccgaagccgatgccgagcagtacagcatcgaagcgatggccaaggcggaagcggaacgcgtgagaattgacggtcttgctaaagcggaggctgaaaaggcgagaggagaaaccgaagcggaagtcatccgcctgaaaggtctcgcagaagcggaagctaaagaaaaaatcgccgacgcattcgaaaaatacgggcaggctgcaatccttgatatgattgtgaaaatgctgcctgaatacgcaaaacaagtctcagcgcctctttcaaacattgataaaattaccgtcgtggatacgggaggaagcggtgaaaacggcggggccaataaagtcacaggctacgcaaccaatttaatggccggtctccaggaaagcttaaaagcatcttccggaatcaatgtaaaagagctgattgagaatttttcaggcaaaggaaacataaaacaaagcataaatgaacttacaaaagaactgagtgattctaacgaacggcacagcccggaataaaaaaacagcaggcgtaaaccgcctgctgtttcagttcgtccgcttagcttcaagaagccgcggcgcagtcatgaataataagataaggacaatggccgaaaggataaaagaaggaatcatgtaagtcgcgttatagacggatgaataaatccagaccggcgtacccttcggagcatagcttccgaaaaagactgctccggagaccacatgcgccgcataccgcagcacactgccggtgaaaacaccgcctataacatacatcgttaaagcgcctctttttttattcaatgccgatgctcgtacaccggaagcgaacaagccgctgaaaccgagaactgcaaatgccgcgatgtaatcaagaaatagctgcaccgggtgctgcaaaaacaaattgccgatggcgatctggacaatccctgttaaaaagcctgtcgtaagcccggccttcactccccagcggaatgaaatcaaaaaaatcggaatcatcataatagagaccgaaccgccttggggcatccggagaaacatgcctgagacaatgtccagaatgacagccgccccggtcataatcgctatttcaattaagcgcacaagctgtgttgaatgattcatagtgtcccccctggtcagacaaccgtatcaaggataaacaaaaaagcagcgcggggaaggatgggaaaaggtccgcgcgctgcttacataaactgcaaatcatttggctttgccacatccctacgccagcgttaactaacaggttcaaagggtcagaacaaaacgttcactctcagctttaatgctccccttgtggtcatcaagtatttagttcaatcttactatacaagaaaatataccaaaccacaagacagcttatctttctatagaagagaaactgaaataagtatgaaagaaaataattaatgatttttttaaaaaaactattgtcatattttcaaaagggtgttatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactaaggtctgcacgatgcagatcacacagacgttactgcaggatgcagtgaacttagtctgtgatccatttatcggagagtttgatcctggctca

SEQ ID NO: 105 - DNA, 337863 bp, Bacillus velezensis FL50S
ccgtcagctcaggccggttcaaatagccgcgggccacgccggtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaataagcatggtctccggcagaagatcggcaaaccgggcagccgtaagcggggaaagagcttcccctccggcgaacacgcgtgtcagtgttctgccgaggcgtgctcttgtttccgcaggctctgtttccagcgcgtctaaaaagctgttgaccatcgccggaataaaatgcgcggtcgtcaccttttcagaagaaaaagcttcaatcatccgcacaggatctttctcccagccggcaggaagcagatacacggaggcgccggatatcgtccaccaaaacaattgccagatggaggcgtcgaatgaaaaggatgatttcagcacgataacatcctcttccgttaacggaaactgcccttgcatccctgataaaaaggcggcggcctgacggtgttcaacagctactcccttcggtgttcccgtcgaaccggacgtataaatgatataagcgagcgaatcagcatccgcttcgtcagagacagctcctgtctccgtctcatttgtcagagaagaaagagacacttctagcgtttcaccggaaaaaccggaaacggataatcccggctgtgcaagcaggagacaagcgccgctgtcctcaagcatatagcgcagcctgtcctcaggatagtccgggtcaagcggcacgtaggcgccgcccgcttttaacacggcaagcactgaaaccgccatctccggcgagcgttcagcgagtacgccgaccatgctttctttgcggacgcctttttggcagagccgaacggcgagcctgtccgtgtactggtcaagctcggcgtacgtcagcataccgcccggaaaacgaagcgccggacgatgcggcgaaagcgcggcgcggcgggtaaacagcccgtgaagcgtcggggccggcggttcagccgtttctgtacggttaaacgcagttaacacccgtttcttttctttttcatccgccatatcaatatgccgaatcagccggtttggatttctaacggcattttcaacgatcgtcagcaaatgagtttgaattcgtttaatcgatgttttagtaaataaagcggattgataatcaaaattcagctcaatcaatcccgtatctgtccgctccttaattaaaatggacagctcatttgccgtatgcccgctgaaaaacatcgccgtttcataatcgaaaccttctgcctgacgccacgcgagaggctggtattgcatcgaaatcccgatgatattttgcaggtcgtgatgaatctgccttaattcattgacaaaaagattgtaaggatatttctggtgccgcataacagacagctgctgttttcctacactgcggacaaaagacacgaactccgcatccggatctgccgtcattctgatcggcagcgtgctgacgaacatgccgagcatatccttttcgagcttggaaccgcggtttccgtaataagtaccgatggcaatatcctttttagccgtcagacggctgatgcatatgtataacgaagccataaacagagagatgatgctgacattatgatctttgcaaaaacgccggattgattgttctaaggagtgggaaagagtgattgtatctcttgaagctgcagtgctttgtctaagatgagaggttcgttccgccagtgaaaggtgttccggaacggttcggtatgtttcagtccaaaatgaacggtctttttgaaaacgggaagactgtaagtattgctgttctttttccatgtagctgagataggaagggctttggtgttcggccaaatcctcgcttcgcatgattttttggtagatttcaatgagctgattgccaagcagattgagcgagatgccgtccataataatatggtgaaattttgaataaagccaaacttcttcgtctgacatgacaagcagagtaaaatgatacagcggtgaatgaaacagcttgaacggaacacgcgtctgtttgtcaatccatgcatcccgctctgattgatcaatatgagtaaaatcaacggtctctaaagaaatcggccgatgcccggccagatacagctggggttctgagccgtccccttccgtcagttgaaacctgagcgaatcattttgcaagatagagaaatctaaagcacggcgcaatacgtcaaagtcgatattccccctgaatttgacgcacgcagcaagattgcagatacttgtgcccggctcgagcagctctgtaaaccagactcttctttgggcgtgagttaaagaataaacagtgttcttcaatggaatccctccatttcaatttaagaggataagaaagtgaaataattacaattaaatttcgacagcatatgactaaatcatccatataagcattattttaaaacatattttagaaatcacaataaaaaattaaattttttctaacattttttagaatatagtatatattcctcacttcacttcttcatttctataatttttataccatgtaaaacagtatgtatgtacactgcaaactggttctaaaacactataataaggaataaaatgtataattaattgcgcttttaaaaaggttttgtcttctgaaaagaaattttatgataaaaaatgaaaaatcagtgaacaagtaagaaagtatcatgtaaaaaaaaggaagaatgttgccgatattactttttgaaaagattgattcataatcgcaatataatgttttacagacatcaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggtttttgctttaattttgccctctgccggagtattcttcagccggttccgaagagtgcctcccgtcattctgtcgcttgcaccggcgacagggagcgaacgaaggaaagccgggtaccacttctctttctgaaccgcatacaaaagctctccgatttggccggcggatacgccgttaatatgagaaacgccggatccgtctcttgcaatcaattcatccggattgagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattggatctgttctgattttcccttttacagttataccctgtttagtaagcgcttgtttccataaatctaaagcataggacgacggatcccacactgccgcccattctcttgcctttgccgagccggcaggtatggttccctttatcgtaatcacattgccaccgtgctcccgttcaaccgtcaattctttcttttcatcagaagcgacggtttttacttcatttttcacacgaacgatgtccgtatagggagaaattgaaatgcgcggctttttaccgggctgtttcgccgggctgatttccgcaatcaccgttccggtatcataatcctcatttggggaagcggtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccaatagggtcggatcgccttttcccctgagataaaggtttccgcgcagctgttttcctctcacggcgccgtctgcccgtacttctgtcttaaaggtgtaatcttctccgagaacggaaagcgccgaagctgccgtcagcagtttcatcaatgatgcaggcctcagccgcatatcttcccggctgccgaacagcacctcccctgtttttgctgaccggacactgacgcccgctgaagccccctttaaagcgggttcttcatccagaatgtgttccagctctttttgcaaagtatttttttgttcagccgccttagccgcatcatcaatataaggaacttcagcaatgatcaaaagcagaatcaccgcgcacaagcgtttcacatatgttttcaatgttatcccgcctctttcctattcttcgtcatgcaaaatggtgatcctggatgacgcagccgcttcttcgcccggtttcagaatctgaagccctgtcagtgatgcaggctgattcagattaaatgcatctgtaacggaagtataaggctcaagactgacaaacccctgctttccgtcaccgttatataccacccaatgcttgaaagacgtgtctgcctgatacaaaacggataatttctcattcggatgataaataacagcttcgttattgccgccattccgtccggaagaaagaaaaacatcgtcaaactgtttatttttcaaagacatcccatgacggaacgcttctttatcaggaacatccaataaacggcccgtcggtacgaaacgttcatttaattcccacatgcggtcagccgtcaaaaatagacgggatcgctcttcatcgaaaacaaatgtggaatgatagcctagcccccaagggaaagcctccgttcccttattcataatcagcgcccgctgcgtaaacacattgtcttttaatgtatagttcatccggacaatgacatcgtgcggaaattgtttatgaacacggggaatctttgaaagatcaatttctgtttcgactgtcattccatccccctcttctttcgctgctgccgctttccaatgctgattgtgaagaaagccgtgaatatgattatgtttatcctcttcgtttatctcgaattgatacgagcggccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaattgagcgatgtgcggtaaaaccttattgaatcagccgggtaatctgttttttcttccatacaaaccggtaatatccgtattgcagcagcaggctgacgacaaaagccgccggataaccgacccaaatgccaagaatgccgagattcgtataatgagaaagaataaaggccacaggcacttcaattccccaaatcgtaaaaatgctgataatcgtcggccataacaccgtaccgctcgcccgcattgttgctgaaacaatctgagcgtgaccgaaaatcagatagctccaaagggtaatcataatcagattgcgggcaatgcggagtgtatcctgatcggttaaaaacaaagccagtatctgccgggagaaggtgtaaatcagcacaatcaaaaccccgccgatcaaataattcaggccgattccgactttgatgacctgcttcagccggccgaattgattggcgccaatggattgggcggcaaaaattgaaacggcgataccgaggcttaccgccggcatctgcacataactcgccacttggttgacgaccccgtaagcagccgtcgcgtttgatccgtaatgattgacaaatgaaatgaccgcaatttcagaaagtgacacgagaatcatattgatgctcgacggaataccgagacggagtaaaagcgcgagcagctttttgtccattttaagagaacggagcgcagtccggtcaaatgccaagggatgtttccttttccgcaaataaaccatgagtacgataaatgttacgatgtttgaaatcacggttgcatacgccgaaccgtaaatgccgaacttcggaagtccgaaaagcccgagaatcaataagggcaagagcccgatgtttatgactgtactgacgattaacgtataaaacggagtctttgaatctcccgttccgcgtaaaaatgtcgtatacgcaaaatataaaaacatcagcggcattgcgcaaaacaaaatgcgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatctttttctcacgtcttacatggaaataaaccataaaaataaaaagtccggaaaatatttctgaaaaggtattgtaatcttaccgtaattattgtaacatttgtaacataagagaaagagattgattgaaggagagattatatcatgaaaaaatggctattattcctcactactattacattgattctgtcattgggcactgcggcgaccgcaaaaaatgcacctaatgaccttacacaaaaacaagcacttcagctggccctgtcagcgagagaacatttctggaacacgatgagcggcagtgcgcttaaatcaaacacaaattgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccggtcggcgacggagataacctcctgaattggaaaaaagcaaaaatgacccttctttctaaaaaaggaagcgttcaaacataccgcttcactgtaccgactcttgacggttccccgtcagcaaaacgcgatgtaacattcgtaaaagaaaacaacgtttggaaagtcaatcaatttgatgctgtcatataagaaaaagcccgcttgcttacagcgggctttttttacatcatttccaccaggctcttgcgaaatattcaactcaaaaaccccttgtataacaaggggttttctgtcttgccgacattattaatctgcgcctatcttatgcggaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcacgcggcagctgcttcctttaatattctgtatgcctgaatccgggaaatgggcttattcgtccgtttcgatttaaacaaatagtcatcctctttcatgtcttttgtataagcgtatatgtcggcctttaaagactccagtatcagaacttttcttttctttctcgttttgctttcggttgcccacacatgatctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaactccttataattggtaaagtaacatattgagcattatgttactattatagccgaaacctgttgaatgataaaggataaagggccttatgtaacataatatacatagtgttacataagaggaataaggcacacagtttcatcgaagtcttcaaaaacatcatttttgacccgatgacgggattttaaatcaatagagactcacggtattaaaaaagaaaaacaacgcccttaaaacgaaatctgagcattcgtttttttgtgagcaaccgaaaaaaatgaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgtttcacagctttttctgcccggtttcccatttagcctatttgcgactgattatattcacacagaaactccggctttttgcgcaccggactattccgtttgtcacttgtgaaaacagcacattttacttactctataattgtaagcggaaaacaaaggaggcagactatgaaaaagaaaaagtttatgaatctctgttttatcgttctgctcagtactttgctcacggccggaagcatcccttatcacgctcaggctaagaaacacccgttttcctatgacgactacaaacaggtagatgtcgccaaagacggcatggttgccaccgcccatcctctcgcttcacaaatcggtgccgacgtgctgaaaaaaggagggaatgcaattgacgccgcggtcgccattcaattcgcattaaacgtaactgaacctatgatgtcaggaatcggcggcggcggatttatgatggtttatgatgcgaagacgaaagacaccaccattatcgacagccgggaacgcgcaccggcaggcgcagcaccggatatgttccttgacgagaacggcaaagctatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaagacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatatcaaaaacttcaatgtgacgattgacgaaccgatctggggggattaccagggctatcatatcgcaactgctcctcctccaagctcgggcggtgttttcctgttgcaaatgctgaacctcctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgacccacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagttgagtacggcatggatctgaaagcggcggtcgaagagccgagaatttacacaaacagcatgacatcctatcgatatgaaaaaggagtgccggaagaagcccgcacaaaactgaacgaaatggggcataaattcggcagcagcccggttgatatcggtaatgtgcaaagcatcctgatcgaccgtgaaaacggcacctttaccggagttgccgattcaagccgaaacggagccgcaatcggcgtaaacttgaaacaatataaaaaataactagacaaaaagcctcgtttctcaagctgagaaacgaggcttttgtttattctgcactgtattcagatgagggtttttcagatgttaacgaggcaagtgaaagcacgccgcacatcgcgatgacaacacctgctgatccgatccatgtcactgacgcaagagacagatgagtgacaacaatgcccccgatgcccgccccggccgccatagccagctgcatcacagactggttgagaccaagtaatacacccgatgattcaggctccatcgttgccaaatgatactgctgagcaggtcctgatgaccaggcggcgaaggaccaaaaaataagtactgccgccgctccgaaagcagaatgtgtgacaaacggcaataacatgagcatgatagcatgaagcgccattccgccggttaatgtcatacgcgccccccatttgtcagcactgaaaccgcctgctttagaaccggcaagactagcaacaccgaaaataagcagcaatgtactcagtattccgctgccgatatgagtgacgttcagtaaatacggagaaaggtacgtatacgcaaccgaatagcctccgagccaaaaaaacgtaatagcaagcccgacagccacctttcgtttcttcaaaagagaaaattgctgaataagcggcaccggtttatctccttttatctcaggcaacgcaaaacgtataataagcatggcaatgattccgattgccgcaattccggcgaaaaccaccttccagccaaaagcttcagacacggttcttccgatcggaacaccgataatgagcgccgccgtaaaccccataatgacggtcgcgagagaacttgcctgttttcccgggggagcgatttttgctgcgatcgtaagcgcggtgaccaccacagttcctgctccaagcgccatgatcacccgggcttccgcaaataagccgtatccctgtacaagaaatgaaatgatatttccgattacaaacaatccaagagcatagatcatgagcttccttctgtccagttttgctgtaagggccatcatgacaggcgttccgattgcataaacaagtgaaaaaatcgtaatcagctgccctgctgctgccacagtaactcccaaggaacctgcaattttatcaagcatcccggatatcacatattcagacgtccccactaaaaagctgataattgccaaaatgtaaatcttccaggtattttgcacctgacacactccttcattgataatttatataaagatatattgtgatatatcgatataaagaattgaacaaacagaaacaaatcgcaatatgtcgatgtgtagtcgaaaaaagaaactgaatccctcttctaaaggattcagccctacatttcgcgctgaaaataatcggccatcgcctttatcgcatcttcatctcttttataataggtgtatttgccaatccgttttgtttggataaggcctgcgcgctgaagaatggaaagatattgagacgccgttgactgtgtcatctgaagcttatcggtgatctggctgacacatactccgatctcattcatatcaatgccatcatgcggtgcgaagtgacggtccggctctttcagccattgtaaaatctcaagccgtgactcattagacaacgctttaaaaacatcaataggtttcatacgctttattatatcgtgattttacgatatgtcaatgttatttttcttgaatctctattttttgttttgtctctcttatgatccgggaaataaaatcactcacattctcttcaaatgtgttttcccgcccgtattgccttacatgtacagaatggtggcggcactcttgatctcccacaaccgccatatacgatatttttttcatttgtgcttctctgattttatagccgagtttttcatcacgctgatcgagctcagcccggatacccgctttctttttgagaaaaaccggaacgaaaaaaaattggcgtacacagctgtcctgttttctcatcttctgttcgataatgtttttaatccattcagcagttcttcaaacgccgatgttaaaaataaatcactccggtagatgaatgatatattcatattccgaaaatgttcaggaagctcatgaagaaaaagatttttcctgttttgaaaataacggacggctgatgcaggcagaaaggagacccccatccccgcctgcaccgccccaataatggcttccaacgtaccgaattcaatgattttatgtgcgggcactgccacttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgacttgctcaagatcttcatattcgaccggtccgtaaacaaaagcgccgtccagctcatagtgtagaacgcgctgcactaaggtatgtgtatcaccggttgacagagacagctgtactttcgggtagcggctgcaatactccgtgaaaaattgagggagatggacggctgccgccgtttcaagagaaccgattcgaagcggcccgttcggatcgcctgcctctcgcgctgttttttgcgcctcatgcagcaattgaaggattctgtctgcgtcttttaataagttttcacctgttggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatctaagggcaccttcttgctatgatttttattgatagccggctatcaattttcatttatttactgcagctgatacagcctgtaaaatttttctcatcaatcataaaggagagaagaatcatgaatgtccttatcatacacgaaaatggctttaatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggcgcgggaatcgtaaccgaaataggacacggcgtccggtctcatttactgaatgcagaagtcatcatcaacccggtactgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggcgattgacagctacagtgactggaatgaggcgctgaatggcgaaaaagcagatatcatacttgacggtgtaggccccgctttatatcaacactatcttgacattattaaaccgaatggccggatcgtaacattcggcgccagttcaggcgatcagctcggatttcccattcgctcgctgttttttccgcagattcatattctcggtacatcaatgggaagcaatgaggaattcgcggatatgctggaattgataaaccgctgcgagctccgtcccattatcgaccgcatgtaccctctcagtgaagcagctcccgcttttaacagaatgcgggaaggacggcagttcggcaatatcggctttcgtatagatgtctaaaaaaaggaacggacccgtccgttcccttatttgtttttaagcgtttccgcttgaaattcaatatgtttttcttcatcgattaaaatctgcccgcaaatcgactgcagacacacagagcccgtcatgttttttaaggcgtcattttaaacggcagcgatgacttccgccgtcagcagcaccctgatcgattgcgcaaggcttgcaaatcgtatcagtctgcggaaaaaaacaatctctccgctctgtaaaacaaaattccatatttatcctccatttccacattacctttatatgaccaatacaagaagaaggaggttccatttcaatacgaaaaaccggctgatcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgactccgaactgtttcaataatggctgttctgtcccttcaaaaccgatggcgatgaacaccagctgagcaggccagactttttctgtaccgggcagttcatgaaattcatactttccgaattcgtttctgactttttccatttgaatggtgtggatctcttgtaagcggccctgcttatcggccaccatttttgtcgtttgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttgacgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatatcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcgtagaccgttacggaatgaccggcttgattcagctgatcagcgcttgccagacctgccgggcctgaaccgacgacagcgacttttttacctgtgcgtttcgcgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaagcgagtgagagggtcccgctcagccggtttttctcgtttttcttccatgaatccagttggtttccccatgttcctctcccctttcttactgtactaccgcttgtttttgatctttggcaggcgtttgctgaacctttgtattggcttcaaaagcatacataattgcgtcttcttctgataaacccgccgctttttgttcttcgatgctgaggagcatttgtttatagtttttcggaatgactttgataaaggtttctgcggctttttcccaattgtccaggagatttgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgaggacgacaacccggccgcctgtcatgtattcacagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcacaattgaaggcatcaggcgctttcacgatgatttttccgcctgaaagccctttgcctacgtagtcatttgaatccccgttcaaatgaagcgtcatccctttagggacaaatgctccgaaactctgtccggctgatccggtaaaatgaagtctgatcgtatcatccggcaggccttccgctccgtagcgtttagaaatttcacttcccgtcacggttccggctacgcgatttgtattattgatcttgatttcagtttccgcttcctgaccggcttcaattgcagcctgcaccgccggaagaataaccgtcatatcaagcgactcgtcgattttatggttttgcgccgtacggaaagtgcgtatgccttcaggctggtacagcagtgtggataaatcaagctggcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggatcgcccatgaattttttgcggagctccggattttgcgtcgcgacacctacaggacatgtatctaaatggcaggcgcgcatcatgacgcagccgagaacaacaagcggcgctgtagcaaagccgaattcctccgcaccgagcaaggcggccatcacgacatctcggcctgtcatcagcttaccgtccgtttccaataccacgcgatcccgtaaaccgttcagcatcagcgtttggtgagcttctgcaagaccaagctcccacggaagaccggtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcatttttcaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgctccttgcgccattttgatctgcaattcatccgcattgacgagataatggctctttacgccgaaacggccggaggcgatctgtttaatcgcacttcttctgtcgtcgccattttcatccggaacgaaacgtttcgggtcctcgccgccttctccgctgttgctttttccgccaagcctgttcatcgctatcgccaaagcctcatgggcttccttgcttaatgaaccgaatgacatcgctcctgttttaaaacgtttcacgatggacgcagctgattcaacttcctctaattttaaaggcttgcggtcttctttgaaggcgaacagattgcgtaaaaatccgattcgttcttcatccgctgcatgagaatactgcttaaacaggctgtaatcattttttcggcaggcccattgcagtgtatggatggtttgcggattgaaagcgtggtgctctcccccgttccgccattggaattcacttcccggatcaagagtttggctgtaatcatccttgtacgccgcttgatggcgctgtttcgcttcttgtgcaatcgtttcgatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgctggccttgacggatcaaatgctgatgcagcgcactgacggccaaaagcggcggaatcggcgtcaattccctactcattgccctgtcagataaaattaacagagatacgccttccttgatcgctttttccgcttgctgaaacaaatccttcaggcctttttccaggtcatcggaaaacagcgtgcggatgttctggctcttaatatcagggtgcacaagtgttttcagcgcataaaactgttcgtttgataatacaggagtatacaattttatgcggcgtgcatttctttcactcggatgcagcagatcaccttcagccccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatatttctggatatcttcatacgtatagccaaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttctcctgctccacttcaataacgccgacctcagatgagaaaataatatggtcatcttttgtcacatagtaacgtgccggacgcaggccgttacggtcaaggatggcgccgatttgttttccgtccgtaaacgaaatggcggtcggcccgtcccacggctccattaaagagctgtgatattcataaaaagcccgtttcgctttagacatgtgagtgttttccgtccatggttccggaatcagcatcattgccgtatgtgccggtttccgccccgccatcacgaaaaattcaaacgcattatcaagaatggatgagtcactgccctcagcatttaaaatcggcagcactttgtgaagatcgtctccgaagctttctgaaacgaactgctgctccctcgctctcatccaattgatgttgccccggagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaggcttgcgaagtaaaaatcaagctgttcttgaacgccccaattttcagcctgcttccggataacatacaatttgcgttcaaaagcaaggctgtctttcaaatcgtttgcggctccgataaatacttgacgcacatacgggcaagtgctttgtgccactgttccgatttttccgacatttacagggacggttctccagccgagaacgatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaacggcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttccgacggaattccccgacataacaggcaatatcttattcacggaaaagatttacgcgcttgttccgctgcatcatccgcttgccaaacagaaaaatatccatttaattgatctgcgcggcgaccaattcgttttatttcccgaagggtttattctccgaaacatggcgattgacgcttgcagacaggccggctttgcgccgcttgtatcgacggaaggcgaggatttagatgccattaaaggattagtctccgcggggatgggagttactttattgcctgaaagcacctttgcagaaaccacaccccggttcacggtcaaaattccgattgaatttcctcaagtgaagcgcaccgtaggcattattaaaccaaaaggaagagaactggctccgtctgcaaatgatttctatcattttgtcattaaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgaggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagcgccatatttccgttcgcgacatcgcggctgcttttcttttccatcacaatttcgccttcggggccggaattaaatgcaagccattgttctttgtggtttaacggcagggttcctttcgcttcaaaataagttccttcagccgcctcatctaccgcttgaagcagaatgtccggaatgttagcctgcccgagaaagcctttaataccggaggccatcacaattttaaaagcatccagtttcgaacgcattccgccggttcccatttcactcccggcatctcccgcgcttgcttctatttccggagtgatgtcacttacatgtctgattcttttcgctttcgggttgctgcgcggattatcatcatataaaccgtcaatgtctgataaaattacaagcatgtcggcatcaattaaacctgccaccttcgctgcaagtgtatcgttatctccgaatttcagccggttgactgtgaccgtgtcattttcattaataatcggaataatgccccgttccaaaaggacgttcatcgtattgcgcacattatggtagcggtattcatcggaaaaatcgcttcttgtaattaatatttgtgatgcgacataaccgtgcgctaaaaacagctttgaataagcctccattaataatccctgcccgatggaagcagaagcctgtttttcagggaggccttccggtttctgaataaacccgagcttccgataacctgccgccactgcgccggaagatattaaaatcacttcatagccgctgtctttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcgtgtttaatggctttggcaatggcttctccgccgccttctgacctgagcgcatcgaggccggcttccgtcgtgccgtttggagaggtgatgttttcccgaagcacatccggtttttcacccgtttccatcagcatttttgcagcgcccaataacgtttgcgcgccgattttgcgggacagccgtttgtctaagccggcttcttcacctgctttttcaataaactccattaaataataaaagtacgccggtccgctgcctgcgatgccggtgaaaatgtccatctgatcttccttgatcacgtacacttccccgaggcattccaaaagagataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttttgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttggaggttttattgatatgtattgttccgagcctgttattatgtataatgaatcacagaacaaaccttttgagcccgggaggccgggagcgttccggccggatttaaaaattatctgaaatggctttttctatcagctttttgcagcggtcaagctctgtcttcagctgttttttgtaaagctttgcagcttcatagtctttaaattgatagagaacgacttcctggagtttggctccctcttttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgttttactaaaaaaccggttgaacttcttttttcttctttcaatatgtgcccacccttccttctaacaaattattccatgtactaaatattctctttatatcccgttttcccttttattgttcggacagtttggtttatattgatttgttttttggatgcggggaaaaataatcttattgaacatttggtacatagtttatttagtttaattatagctgatatcggtttctttttcactcttttttctgcaaaaacggatctttatgcctatttaatcgggttgcgaaaacaaaaaagacccgtcacaaagacaggtccccttttgattaaggattagttgaccacaaaccggcagttttgatgaaaatgcgcgggtgtaatttcaattgagcaaccatatattctgcaagatcctcaggctgcatgactttttccggattgccgtctgtcagatttaattcaatagacatgtcgcttgcaaccgtgctcggagtcattgcgctgacacggatattgtgttttctgacttcctgcatgagagattcggtcagaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttgaggcgtaagatccaaaaatccgccgaatttgctgattccggcattgttaatcaggatgtcaacctcaccgagttcttctttaatagaagagacggcttgttcaacctctttttggttttttacatcggcagcagcgaatgatgcctttacaccaagggctttcacttcttccgcaaccttttcgacatttgcttctgtacggccgattaaaccgatattgactccttctttggctaaagcgatagcggcggcgcggccgattcctctgcccgcacccgtgataagagccgttttgttttgtaagctttccatgtctttcaccctttctgaatgtccttatgtacgatttcacattataagcagaaaaaaaacaattagcaaataaaatgattcaacacgatccgtaaagggtatcaactgaaaaaaaggagtgaaaagcagatgatcatcattttgtatatcagtgctgccgttgcggctgccgcattaatttatgcagccgtatccgccgtgcattttaaaagaatcacagcgcctgatataaagaagattaacgccgcgacagcgtccatgcagacgtctgttgaagaaatcaaaacagaaacccgtttgttatcacaaaagcagaaagaactgcaggaagactttcttactaaaaaaacagccgtgcaaacgacggcagccgaagttaaaggaacgcctcacgtgctgaaaatgctctggaacgccggtaaaagcggtttatgagcctgcatgtcatccgacgtttttgatgacactaagagaaactggcggattcaaggaggcataacatgatctgcgatcgtgagcggcttgcgcattttttgcagcagcttaaagcattatcatcttcgggaggatttacaaaatcggatttgctgactccggagttccatttagccaaggacggagatctggatatgtattattcgcctcataatgagtatatcaacccacatgctgcggttgtcatctccggaattacacccggtttttttcagatgcagcgggcttacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttttttgattcaaaacgggagctgcttcatacgacatccgttatcaaacaccctgttttttataaacagaaaaactatacgggacaccggccggccatcagcagatcagctcttctcagccgttacgcgctgacatgttttccggatgaaatagaaatgatgaaaaaagacattctgcttatccctctcggaaaagcagcagaatcagcctgccgcacactgaagaaaaacggcagaatgggccatgcggtcattctggaaggcttcccgcatccgtccggagcaaacggacatcgtttcaaacaatttcacgaaaacaaacaatcgttacgtgaacaaattcagcggtttgccgggtttcttcatcagccgtaaaaaaacgccccgaattttcggggcgctgctgttaagaagcgtattcaggcaatgctttattgtgttttgccgttttctcttcaggtattttgatttgatttgtcaagattgcacttacgaaatagagcgctgcgaaaatccatacaacgccttgtgcgccgacaagcccgatgaacgcccaggcaagcgcggggccgacaaatgccgacaggcccgcagccagatttaacacagacatagcagcacctttattgctgccggccgccgtcggcacgatagccccgatcggaacgaacccggcgaggagccctccccatataaaaccgacaatgctgacgaacagcaaattcccatgtgatacaacaggagcataatataataaaagagtaaaaatgccgcagcccactcctccgaaccacatgacagtctttttccagccgaaggcatcgccgactgcgccgaagattaagttaaagacgatatttccgagaaaaatcgttccccaaatttgcagccatacatttgtagaaatgccgtgctgcgccatatgcatcgggaggaataccggaaatccgtatgttccgatgctgttaatgatccgaatgatccccccagagagcacgcgcggattttcagcaaggatggtgattcccttcattaattcctgcgccttttcccgcttatctgcctttttcttttcaaagcggtccctatttaaaatcaaagcaaaaaacgcgccgaggcatacccagaaaattgaactccacatcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaatgaataggcaaacagcgggtaacccagccctttaataaaatacgtgacatacatcaccggtaaattaagattctcaaatccgtatgcgataaacgcggctgttccgatgacgtaaaacaacagccccataaacatcgtccgctttgcgccgaaggcttcgaggcagacccctgaaaaccacgacgccacagcaagagaaataccgtaaaccgtaaacagggatgctgattgctgtaccgtcaagccgttttcaactaaaaacgggctgagccagccttgttcaaggccgtctcccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgggtatgtttccattcttcatataggaagagatccgtctgatccgcttccggctcaattacctttgtgcgggtcgaaagctctgctttcacaccgagagcttcgttgcaaatcatcaccgctcccattgcggatgcctggctgaacccctctctcttatagattatcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcagctttgacaaaatgggctctgcttaagttttgggacagcggagcgtcaaaaataaatccgccttttgccagtgcgtttttctcaggagataaataggagcctaacgcagatatacaggcatgatcatgtttaggcagacttgcgatttcccgttccatgacgctgtaggattcattcggataaaaaatggattttaatttttgataattgagtcctgttacacccggattcgtttcaagaagccattcaccttcttctgtatggcaattcagccatgcattctctaaactttcggttccggtctccgctgttatctttgtaatcggcgtcgtcgtgccggatacgatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatgtcagaaggcacaccgaagatgttgcataatttctctgaccacgcctttttccttacgtcaaacagcagtgtttcagcagcctgtgacggttcatagcttaaaattccgctcagctcaaatgtcacccagtcactgatgcttgtgatgcacttcacttctttccataaagacggctgtctggcttttaatccgacaagtttcatgacggaaaataaagcgctcggaagacatccggtttgctgatgcacttctacttctgcctcaatcccgccttcccattcacgccctctgttatcaatgttgggcagaccgagaaatgcctttttatctttattgatcagaacgattccctgcctctggcttgttgaggtgattccgattaatgtaatatgagggctcttggcaatagcctttcttgccatagcgctgatttgcgtccataacccttccggtgagaaatatcgtccgtccggataaagcggatccgtctcatattcaatgtcttccctttcaagcgcggtcacttcgccgccggcagtcacgaccgcgactcgcgcattcccagtcccgatgtcaaatacaaggtagcctttttgttcagccattacagccgcctccttccgtttcaagttctcttttgttataaagttcacgtattgaacaggtttgatcttgtttccatttgaaaagcgcttcatttaaaatcttcacatgatgatcttccacttcaaatgttgcgcccgctaaatggggagtcgcgaacacattcggcaaagagatcaattcataatcagaagattcaggcggttcgtgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataagtccgatggtttcttctgtgcgcggcaagtgaacggaaacaatatcactttcagaaaatacccgttcaatcgtcgttttttcatactcccggttttcatgacggacaaatggatcatagtaaagcaccttgcagtcaaaagcggccaatagccgggcgattctctgtccgacagctccgaaaccgataaggccgactgttttccccgtcagctcatttcctctgaatttgacgtaagcctgcaaataatcaccattccactttccgtccttcagccactgatgggaagaatacgtatgacgcaaaaatgaaatcacatttccgataaacatttcagcaacggcctgggcattgcgggccggtgtaaagaaaacggggatttttcttttagtcgccgccgcaatatccacattagacggcattcctctgcagacaccgataaaagcggaatccggcaatatgtcaataacacgctgagacacctcatcaagttcggttataagccccgacgcgtttgtctcttgaatcatccggatcaattcatcttcccgataggcccggccgtgcttcttccacggccggtgcacagtccggccgaacagctcagccagctccttcagcccctcgtcgtgatatggcgcggtaattaaaaccgtcatggtgcaaaacatccttttcacataaattttttcataaaaaaatctctttcctcaaagaaggaaagagattcatataccgtctttatacgcttgaagcgcacaaatatgtatagaccattctttcctatctttcaagcatacgcttgctggaattggcacaataaatgttgccgaggattcatagggccagtccctccacctctctggatagaaaataaaatgatgaaattgtcaggctgtttaaaagaataaactcatcatagaaaagtctttccgtaatgtcaacacttttttctgaattgacgttcgattttgaaatgttataatgcttacaatataaacaaagaggagaaatgggctatgaattctgctgcaacacagccgaacggggtctttaagtcggtgtgctcactagactgtcccgatcaatgcggcttgcttgtgacaaaaaaagacggaaaaatcgttaacattcagggagaccccgatcacccggtcacatcagggaatatttgcaacaaagtcagacacatggctgagcgtatttatgatgagaagcgcgtaaccgttccgttaaaaaggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatctgcagcaaagccggttctgaaggctataactatacaatgggagaaggagcgggtactgatccggaggagaccatacatgctaagctctttattttttggggaatcaatgccgtcagcacgaatatgcaccaagtcatgattgctcaaaaagcccggaaaaaaggggctaagattgtcgttattgatgtacataagaaccaaaccggccggcttgctgattggtttattcccattcgtcccggcacagatgccgcactcgccctcggtatcatgcatgtcttattcgctgagaaccttcacgatgaagcatttctcacagaatacaccgaaggcagtgacgaattaaaagcgcatgtcaaacactatgatccggaaacggtttctgctattacaggcgttaaagccgacgatatcagacgccttgcgagaatgtacggggaaacctccccttcccttatcaggatcggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatctgtttttaacggaaaccgccaaatatgcggatatcgtgctccctgcttcatccgcttttgaaaacacggatttttacacgtcttactggcatcattttattcagctgcaaaaaccggtgatcgaaccctacggagacagcaaatcgaatacggaagtgttccgtctgcttgccggagcaatgggatttaccgagcaggagcttcaggattctgatgaagaattaatcagacaggcgctggactttcccgacaatccgtatatcgaggatattgattacgaagcgctctcaagccattccttcatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagatgctgtacaccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatcctccggccggcttcaccgtataaaaaatgataacgtttattggaggtttggatatattaccggcattggaatcgctttagccggatatttcatcggagacggattgaaaactttaactcacctgatcctcatgaatatctgacattccgcatatcacgagaaacggaaagcggtatgtgcagaaaccggcattaagagaatggctgacttccatgctggaaaaagaataacagctgctatgaaaagcgggaagagtttttctcttcccgttcattaagatttgccccactgcctctcttcaaccccaaacatacgacagatatcgttcttacgtaacgaaacatccccttcttttgatttcaaataaaaccctttcttatataaccgtatgacttcctcatatgtaagctcatgacgaaggaacgccattaaacgcccatctttttcatcttgtttattgaaccattcataccgttctgaccagttcactttctgaatgtcaaacaccttcccactttggattaatgcccttttcgcatttattatacttatttccccttttgtaaacactccgactgtctgtggcatttttgaaaacagccgtacccgccctattagtcaccatgttgacttatttcccttcgtgatgtatattgtaattgtcaacatggtgacaatttagatgggagataacttatggatattaaattactaatgaaggaactgcattttatgcaacaaagttacgcatcattattttcggttgtcaataaggtgcagactcggggggacgaatacttagaaatgttgacttcccgacagcacatgactcttattgctattgcccatttaccgacggaagataccacacttatgaatatcgctaaaaagctgggcacaacaaaacaaaccgctaacaaattaatttcaagtctctcgaaaaaaggatatgttcacactgtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggacggttttgaagaaaaagcacatttgaaagttgaagaccaggcacaatccatctcagatgactatgaagaaaaaatcatggctgaattttcaaaacggcgatatgggagtgcaaacgatgaataatatgctttatcgaaaagtaaaagaaactgaggataagatgaaggaaaaatgctatgagctgaaagataaaattgatcaatttatttctcaggctaaatataaacttcattgcaatcgtaaactggaccgagccggcaattatatatcaattgccattggactctttatcctaactgcctcatggctgaccgcaacacaatggctgctttggataggcgcggcgagtattttgagtaatgcctgtttgctcattataaagcctgttaaaaattgaaaatctgaaaaaagctctctaaaagagagctttcttttattaatcgtcttagtcttcatcttcttcccgattttctttcatctcatgaagtctttcataaaagaactttataaaatggaattaagttctttatagccaccgaattcactccaaataacaactggacattctcctttccgttactttaagtcatttattcacaaagtaatcttttttacaggtcatttagtggcagccccaggaaaatgcgaatttacaacgttaatcaaattcaaacataaaaaagtcgaattccctgtcctttaaggaaaacgacttttttatacggcttcttcaagtaaatccccattaaccttttttggggaagatttgtaacctctgcgcagtgaaattatacctgtgctagcccgccatctacgaacaattcaatacccgtcaagtaactgctttcgtctgaagcaaggaaagatacagcgttagctacttcttcaggtgtcccaacttttccagctggaacagtatttctggcattttccatcgctccttcaagtgcatcaccaaaaagctcaccgtatgcaggtgtaagaatcactcctggacttaccacatttacacggatttcagtaccttttaggtcaagaatccagttgcgaaccagtgctcttaatgctgctttagatgctccatatacactaaatgctgggttgccaattgatccagcagtagagcccgttacaataatagaacctactttgtccgggaatagtgatagcgctttttgaacagtaaaaatggttcctttcacgttaatgccgaacgttctatcaacctgctcttcagtaatttcacctaatggaaggaagctgccgatgcctgcattagcaaaaaggatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgcagcaagaccaatcccacttgttccacccgttacaagcgctactttaccttcaaattcacccatacttaacactcctttagaattaatattattttatgtctagtacctttaagtacttgaagaacaacttacaagtaatagtatccttcagtaagcacattatcggaagtacctacttttttgtgatatagtaactaaaaagtaataaatgtggaatggagagctttagacatgaaaaaattcagctgtgggtttgaagtgacaaaggaagtgattggcggaaaatggaaaggccttgtattatactttttaatgaatggaccaaagagaacgagtgaattaaaccgcattatcccaaatattactcagaaaatgctgattcaaacacttagagagcttgaagccagtggacttgtgagcagaaagatgtataaccaagtaccgccgaaggttgaatattcatccactgaacttggagaatctcttaaacctatcttgcaggagctctgtcaatggggaggccattatgcggagcaaaagtatgcagaaggtgaatatgaaattgtacagccagaacaactaagttaggattgatgcagctgctgaagtaaatgctaaacaacttcaataccatcacctgacagataaagaacagccagaaataaatgagatattcaattttgaaagtgaagttataataagaagtgtcatggactatattcaggagaactttgatgaaatcaaaaaagagctgtttcaaatgttaaagagaaggttcagaaacttagcaaaaagataaatgaagacatcagtaataacatttaatgcctatatggtctcttcgcatgcattttttacacaaaaagacccggattttaattccaggtcacacttcgggtcacaacttgctcaaattccctcttgcatttgtcaaactgctttattcaagatcataaaatttcaaacgaaaccttacacgaaggaatcggggatcggcaaaacaaagccagatataacatatattaaaaaatctcttgcatttccacacccgccatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgactgctctggcgtaagcaggacaacatctcctttttccgggatgccgccaagaacgagaacttctgacttaaatccggcgatccgccgcggcggaaagttgacaatagcggtaacctgcctgcccgtcagatcacccggttcgtaccgttttgtaatctgggcgcttgattgtttcatgccgatctcttcgccgaaatctattgtcatcttaatggccggcacctttgcttccgggaatacttccgcttttacgaccgttcctattctgagatcgagcttgataaaatcttcgatgactgccatatcaaaaactccttttttacaatcatgataccaaaaaaagacgcagtttatttaactgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccccgtctgctttttaaaccagtcggaataatacgccggatggtaatgttccattgcggcaagctctttaattgaaaaagtctttgagagatttcggcggatatacgcaattgaatcattcgtacggttttcttgtatcttttcagcaatgaatgagccgactgctgcttagtctcttctgtcagcagaaaccgaatcgatgtccaaaaagaatcaagcttattcagaacgccgggatcaaatgaacctttgaaaaaatatgccggtatgtcgagaacgagacattcgtttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgtgaataggtgcgccgctcacaaatgatatgttgtaatgaatccatttgtccctccttttactgatgcgtttttttatttagtttacataataatattattgtcacctaccctgtaaacctcttaggaaagcaacaactgcaaacttccggctttccttaattgattcggttaattcaaatgcactctgttttctcaacacggcaaagccgtgaagaaggctcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcaaataacatagttaaaccggagacagcgagctctgttttaattccttgaaggccattgacaaaattgtaaagggaaggcggttttacgtttaaggactttgcaacggccgcaagcgtcacttcgttcagccctttttcgtcagcgatgcctgctgcggctctcaatatcatgtcaaggctcaatccgactctcggtgacattatgatcggcctcccggcaggcttcgttccgcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatctgctcgccgcctttcagcaggcgatcaggttcggtctgaacatttttcggcactcccccctttatcggcgtttgtgcttcatgctcaaataatgaagtgtcacctttcagcaagaaagaatcccgctcagaaatacagacggaggcatccggaaattccgcagctaatgagtcaagcgaaccgatgtgatccccgtgcgcgtgggtgagtaatatgtcattcagcggcttcccaagctgccgcaatgcttgtttgattcctttatgactgttaggcagtccggcgtcaatcagggttactcctacttcttcttcgaccaaataacaattcaccgggaaaagcgctggaaaaaaagtcagctgccaaacccttccgtattgtaagattctcatcaacatccccctaaaactaatatcgttagttttattataactaataccgttagtttatcaagagttttctgtttaaatcctgaaaaaggcgcgggcgcttctcttatgcaaaaaaaagaaacgcgcatactgtgataaaagatgctttcagcctgcgaataaatcagactactaaaaccagccggataagcatacactactcaacggagggggagtttcacaccatgcatatcacacttcaaagcatctgccctgtcttaatgattgccttttttctgtataaaaaggtgaaacggtccgtcggctttcagcctttgaaaccccgctggctttatacaagaatgattttgttttcattgctggctgcggctctggcgtttttcagcatcacacacccggctttatacggccatcttatattcggcactttttgcggctggcttctggtcctgtttgccaaacggaatatttcttttgaagaacgccgcggaaaaatgtattttcgcactcatctgtggattgaacttattctattaacgtttttcctatcgagatttgtttatcgcgttattgaaatttaccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggagaataatagatggatgttccttctctgcgtgatttgacgagacgcagatttttaagaaaacgcagctgatgagaaacggtagactgcagcaaattcagcttttctgcgatatcatttaccgcgtgttcaccctgtgacagcaaatggagaattctgattctggtcggatcagacagcgccttaaaagtctgggcaaccaaaaataaagtttcctcatctaaatcgacagcggggtcattcgtgtttccggattcgtgaaattcagtcatatacctcacccttcttttctcaagtagcccaattataccaaatgtcaattgatgcaggtacatcctgcgcctgacaaaagaaccgttattttaaatttatgtttcaaatacgggtttccgcttggtttcgcgcattcatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttccatcaatagaaaaaagccgcgcagagcacggctttttttaataatacggtgagatcattaagtatacaatgacacccgtcagactgacatacagccagagcggcatcgtccatctcgcgatttttttgtggcgctccacctgcatgctgaatcctctgatcagcgtaaacagcgcaagcggcacgataacggcggaaagacagatgtgcgtaatcaaaataaagaaataaatcccccgaatgatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatagcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcactttatgttcgttttcattcaacagattttttggaatgatccgatctatcggtttattcatatgctgatcgagaatatcggctgtttctttgtcccctgcgattacgagacgctcccattggtgtgaagcggccttttgatcaaggtttgaagccaatcgtttatacagcctgttttggttttcttcgacatgggctttggcggcgtcttcgtccattgatgcggagcttccgcttacatcctgcggtttccacgattcattgatgacgtcgtattgataatgctccaccccttcaatttttccgagtacggtttctatgatcttcacttcattctgctgggtgagaataaaagccgtgcttggaaattgttcacggagaagttctaattgatcaaggacagccgtttcttcccaataaaatcgtgtttcgacaggcacctgcaattcaatcgtctcccagacaccgccttcccccgatgcaaaaaatacgaggcttcgcggcatctctttaccaagcccatcgatatattgatagacacgttgcatgatgcggacgagagatttttcttcttccggatcacttacagacagatactcttttaatctccgaaaaccggttttcaaggcgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccccaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgacgattggatcattgtttcctcgattgatgatggccaaacatgtaagattatgctgactgattgtgaatcagcctaccggggaagaggctgtttttcactgatcgcttcttattatgacaatgccattcatatcggggatattaaaggcccgccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaagcatcaatttgatgtctggattgacaatgatacgcaatcaggcggcattaaatgggtcgacctgtaaaaaatgatagataaaccctcgttaatatggtgtaatagattaaaccatttaaggagggttttttttgtatccggaaaaattgaaaaaaggcgacggcatccgtattgtgtctccggccacaagcatgtccgctatgtcagatgaaaatataaatgccgcgaagacaaaattggaggagctgggcttttgtgtctctttttcagagaatgcaaaagaaataaatgaatttcattcatcatcgattgaatcgcgtgtacgggatctgcacgaagctttcgctgatcctgacatcaaagcgattttgacgacactcggcgggttccaatcaaatcagctgctccgctaccttgattatgaaaacatcaagcggcatccgaaaatcctttgcggctattcagatattaccgctctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcagcccggatatgcggaaggaacactgatcggaggaaatctatgcacgctgaatcttctgcagggcaccgaatactttccggagatggaacaagtgattctgtttatagaagatgattatatgtcggacattcatatgtttgaccgggatttgcagtcactcatccatcttcccgctttttcagccgtgaagggaattgtcatcggacgtttccagcatgcttcaaatgtgtctgaggagactcttcgtgccgtcatccgtacaaaagaagaactgtcatccatgcctgttatcgcaaatgctgatttcggccatacctcccctttgatgacattcccgatcggaggagcatgcaggatagaagccggctcagaaggcggacggatatggatcgatcggcattaatacataaagacgggaaaaccgccccgtctttttattttgacgccttatgccgcggcgtgcgaggagcgatcataattcgtccgccagccgctgccctcacccatacggaagctccttcataaaaacggctgatctcttcattatatacggcgtgtgtcagttcacgtttatcatgcgttccgtcttggttttttacgtttaaaataagtacaagctcgtgcctgccattcttcatcacgccagtacgtctcaccttttcaataacggctggccttcctctccctctgtcaagcgcctgaaacagcctgacagcaggcatagacagtccgataacgagcacaatggcgaaagcggtgcatatacctgcttgaaacaccgatgattctgtgaaggcattccataaacatatacattccggctccatcagattcatcccttcaattcttttttcacatccattccttattatattagagaaacactttttctttttccgcatataacgattatatacagtcaaaaaagggaagaaaaaaagaacacaaagcatttcgccttgtgttcttcatctctatatgaaactagtctaatactttaacatttactgttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcagctgctttttaggctcttgttggtttgtatttgattgaacaggctgctgttttgcttcgacagccttcgcttcttgtttaggttgttgttgttcttgaacaggttcttgtttaggctgctcgtttttgacagcttcttgtttcggctgttctgtctcagcagctggtttttgttcagtttgcggctggctggcttcttgagccggctgtgcagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaatgattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaggcttctgatttttccggcgccaatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctgatctgagaacacgacaaatggaggcacaccctgttcagctgcaatctctttgcggagacgccggagaagctcaaataattcatcattttcggtaacggcggcggcctgtaaggcttcttttctcgcgactgcgctttttccaagcagaacgtccctgcctttttgggtgaccataagcgtgggaaatgtgccgtccgccattctgatatattcatctgaaataagaaattcgataaaatcactgatttccgctgcggattgatgcttcataatgccgtaagtggacaggctgctgaagccgttttccagcacttttttattttttgacccgctaagcacctgcgccaccatcgtttttccgaagcgctcattcattctgatgatgcatgacaataccatctgcgcttcttttgtgacgtcatgggcggtccttgtatcagtgcaattgccgcacgcttcgcaagcttccgcctcattctcgccgaaatacttcagaataaaccgctgcaggcaatcttccgtatgacagtaatccaccatctgtctcagttttttgagatcctgcttttgtttttcttctccggcggccgattggtctattaaaaaacgctgcaccataatatcctgcggcgaaaataagagcacacactcgctgttaagaccgtcgcgcccggcccgtccggcttcctggtaatagctctccatatctttcggaatctgcgcgtgtaaaacaaacctgatgttgctcttatcgattcccattccgaaagcggacgtagctaccatcacttgtatctgatcgttaagaaaacgctcctgctggtcttttctgtcatcatccgccaatccgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttgcagatgtcatcatgaacctcaggcgtagccgtcgccgttaaggcgatgatgacgggcggttcttttaattcattaaaaaggatttcgatattccggtaactcggcctgaaatcatgtccccattgcgatatacagtgagcttcgtcaatggcgacaagaggaaccgtaatattctgcaggatgtgaatgaattcagaagaagtcaaacgctccggtgtgatgtaaaagagccggtaagccccttgtttcaaaccggtcaggcgctcatgaatgtcacggcttgtctgggtgctgttaatataagctgccgcgatacccgcttcttcaagcgcgtcgacttgatctttcattaaggaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcatactgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtgaaaaatgctttattctacataaaaattgttttttcgacaaaatatcaatatatcaatataagattgaatcgaaagctgccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccaagaacggttttcatgaagtttaatgacatttcaagagatgccatcggtccttcagaatatacgccgccgcgtgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttgacaaattgatttaagtaaatgtcagcagttgacgcttgttttttctcttcgtctgtcatttcaattccttttgaagctttgaatgttccgttaatcatatctcttccgaggtaaggaaggttttctttatgaagatcaagttcgatcacttcatcattcggattgttttctttataagcagccagaaacgcttcgtataattttacggatacgccttcttcagccgtacggtcgcttgattttacaaataatacttgagacattctaaattcctcccggtaatcttttaatatttacttacaaatagtatgttactttcttttttatataaagtcaatgattttatttcgattctgagattttttatggaataaaaaaacaggtacataggaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggtacggcttcaagtctttcataaggaatttcttttcccgttttctcgcaaatcccgtatgttcctttatccattcgttcaagcgcggcattcacctcatctaaaagattctgatcgacaccgtccagcgtctgattcgtgaccctgtccaaataaatgcttccgtgatcagctaagtgattatctactccgttcgacagttctcctgtgtcttcgctcattgaatgattttctttggattctccctgaagactttcctttaaatcgattaatttatgataaaggctgtcctgctgttcttttgataatgccatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaatcttgtccactttgacgtgctcaatatggacatatgttttttccccttcaaccgtttgcggctcaaaatgacacttatcctgaagctcatcaagctgttgttccactttcttaagccggtctaattcttcttcacacacttttttgaacatctctttcattatttttttcaaagaaaatcacttctttccccgtcactcttggaaagttctatgcgtcccgtattgcgaatatataaacatgatatacaaaaaggaggcgaatcatgatgttttttccatccgttatcaactttgagtatataaaaatgaacggaatcagcggcggagcggcttttaacaccgtctcttccgttatggtgagaaacacagcagccaataaaagaaatgaagggtacggtgaacaaaacggtgattgcaccgttgtcgccatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggaatgcggaagatcgagttttttttcaaaatcgccgtattttccggtcttctgtttaaaatcctgttcattgaaaaaggattttctcgtgccttttacgacaatatattctccgtaggacaacagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacggtcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatatccccatcagttctatcgctgacccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacattcccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgctgttatgaagtaatacggttcagcggaagaaaaggtttcaagaaaacggtatttttttcgaaaagtcagttttttattttcgccataaaaaaccgcggcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaataaattcattcagctttaaacttcttcaaaatacgctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttaccgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagacagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacgattccggtcgccggctcatattttaattacacccgccatgagcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgacaaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgccagacgccaatttgaagaaagccattcccggcgctttaaacggggtcatgtttaatcaggggcaagtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgaacgggcgaaccgctcggaatacggtcttgcagccggactttggactgaaaatgtgaaaaacgctcattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattaaatcaaacaagaaactgctgcctgtcagcagtttctttcttttgtcatgccgccttttacatatgaatatatatgcttctgaaggagttgagcgagtgtgagcacaattcatgaaaacgtcagaagccgccaaaagaaaaccatctccctattaagagaaacgcaaaatgcggacggctcatggtcattttgttttgaaggtccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggctgaacgctttatcatctcaaatggcggcttgcgcaacgtacacttcatgacaaagtggatgcttgcggcaaacggcctttacccatggcccgcgctgcatctgccattatctttcttagtcattcccccatccttcccgctgcatttttaccagttcagtacatacgctcgtattcatttcgtaccgatggccgtgacgcttaacaaaagattttcgctgaaaaatcccaatgttccgtctctcgcgcatttagatcggcatatgactaaaaatccgtttacatggcttcgttccgatcatgatgagaacagagacctctcttctcttttcgcgcactggaagcggcttttgcagattcctgccgcttttcaccagctcggtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcagcgatataccgtacctggaaaattcaacgtcgaccgtttgggatacggcgcttctcagctatgcgcttatgaaaagcggcatctcagataacgatcaaatgataaccggagccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccatcccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttctcctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcttttcttattgaaaaccggcattacgaaggagacgctttcagctatccgaccggaatcggcctgccgaaacagttttacatcaggtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcagcacaaatcgaccggatttttcacacccttcaggatgatggattaacggaggcggaatggtacgaacaggcatcagcactttaccgggacattaccgaaccggaagagccggatgagcgcagagcctatgtgccgatcggcaagcatgtcctccctaaactgccatacagttattccgcactggaaccgtatatttcaagagagattatgaaactccaccatactaaacaccatcagagctatgttgacggtctgaataaagcagaactggagctcaaaaaagcgagacaaacgaaacagtacgacttagtggcgcattgggagcggcaattggcgtttcacggtgccggccattatttgcacagtattttttggttttccatgaatccaaacggaaaaagacggccgacgggtgcgctctttcaaatgattgatgtgtcattcggaagctattccgcttttaaagagcaattttctcaagcagcaaaaaaagtcgaaggagtcggctgggctatccttgtctgggcgccgcgctccgggcggctggagattttggccgctgagaagcatcagctctacagccaatgggacgtcattcctttgcttccgctggatgtatgggaacacgcctattatttacaatataaaaacgaccgcgcggcttacgtggatcaatggtggaatgtcgttgattggcgggaggcggagaaacggttcgagcaagcgcaccgcgtgatgtggccgctttattaaaaaaggcccccgtcttgaacgggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcggaattttcagcggtacgaacacggcaattaaaagcgcgcccaacggcattaagacattgctgaccagaaaatccgcagcgtcaaaaatactgcggtgaaaaatagaaacatcactcaaaatgccgtacgacagcgccgaagggaccccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagacggtcggcagcacgttaaataaaagctgcggaccttgatccggcttgagaccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgacccatcgcatataaaatggtattggcatccatcgcgccaaaatcaggcatgaagaagaattttaatcccttcgctgcatcatgcagcgtaacggagcggatcattaaaagaataaacagaataaacagagccggcatcagcacctggcttaccttttcgatgccgctgctcaccccttttgccacaactaaaatcgtcagcacgataaacagcagctgaccgaaaaccgcagcataagggtttgaaatggtatcgataaataacgtatcaaatcccgaagaaagcgataaaccgcctgtaaagccttttataatgtagattaatatccatccccccactacgctgtagaaggataatagaataaaacacgttatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttctgactgattgattggatgtaaaaggagctgtgtttatggaatggctgaaaaaaataagcgggtttgcgggccaaacctttggcttgtgggttatcgtctttgccggtttgggattcgcctgccctgatttgttttcttggatcagttcttatatgacgattttccttggtattattatgtttgggatggggcttactcttcaagcagacgattttaaagaattaatcagaaagccttggcatgtcgtgatcggagtcgctgcccagtttacgattatgccgcttgcggctttctgtttatcagtcgggctccgcctccccgcagaactcgccgcgggcgtcattctggtcggatgctgtccgggcggtacggcatcaaatgtcatgacgtttttggcgaaaggcaatacggcgctttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttcttcaaaaaacaggtcggacaagccgtgcacgcacttcctctcgtatcggtaatcggcatcgtagcgattgtatcctctgtcgtcagcgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcggaatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgccgccgctcctatccttgattattctgcagatcacgaaacaggcgcaaaagcgctttttttacatccccctgaaataaacctccatgataacaaatcaattggcggatatcgtaatcaagcagccgctgcacagatcggaccgcatcatccatatgtaacgtatagtcaggattagcaagtttcagctttccgtcttcaatgacgaccgcatcacctgtgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcaaatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacgatgtaatgcagcgagtgagccgatatggtctatgtcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgatagaatgcaattcttcattatattcaaattcgatctcaagcggataacagcttttcatataaattctccccttcgctcaataaaaaagtacactgcttgtaagggcagtgtactttttgtctgtttcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccgacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgtacgactggaacgacaagcccttcttcagccgcgacagcgataccgatgtcatagaattttttcacgatcagctcatcgccttgaatttcagcgttaaggagcgggaattttttcaatgcagccacgacggcttttgtaaagaacgacatgaaaccgagttttacatcgttttgctcaaggaattggtctttacggcgttttcttagattcataacggccgtcatgtcaacttcgttaaatgtagtcagcatcgcagaagtctgctgcacttcaaccaatcgtttcgcgatcgtctgtctgcggcgggacattttttgcacttcgacaggtttgtcaaagctttgctgtgttttttgagcctgctgtttcggctgtgccgcaggttttgaagccggtttttcataagcttccacatcttgtttgcgcacgcggccaagcgggtcccccgtcggaatttgtgatagatcaatccctttttcccttgccagcttgcgtgcagccggagacgctaccgttctggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggctcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaggctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgtccttcgtaaccgtgaggcagcagcatgaccagccctgatttttgtccccattttgcccgtcctgcagatatgaattgatcaaaatagacttgagccgcattggcaaagtccccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagcttgccgaacacgttaaaggattccggccagttgataagttcgccgttcagcttgcggagaacatcaaaatcaatggctgtgtcaacgtctggaaaaccgttggacacaggctccggcaattcaatttcccgtacggcgtcttcttttttggcgggcacctttttataggcgtcttcaattctttttgtcactgccgtttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgattaaatcgattaagaaatctttattgaaccgcttccggtattcaaccgcaaatttaacggctgacaggcatgcttccggatcatccgcgttgacgtgaacgatcggaatttcataacccttcgccaaatcactggcatattttgtggatcgtgattcatcgctttcagttgtaaagccgatcatattattggcgatgatatgaatggccccgcccacctgatagcctttcagtgagcttaagttcagcgtctcggcgacaatgccttctcccgggaacgctgcgtcaccgtgaattaaaatggcgagcgattttgtttcgtcttgaaccgggtaccccttttgcgttcttgtttcctgtgccgccctcgtgcttccttccacaatcggattgatgaattccaagtggctcgggttatttgcaagcgtaatccgcgcgcttttggtttcagcatcctgaagctgtctgtctgcaccgaggtggtatttaacatcgcccgtccagccgtagctgatgccggtcgatccttcagacggcacaaggtctttattcggcgcgtgctggaattctgagaaaataatctcatacggtttgccgagcacatgcgcaagcacatttaaacggcctctgtgcgccatcccgatattgacattggttgtgcccgctttcacagactgggcgataatgtcgtcaagaaccggcacaagcgcgtctaatccctcaattgagaaacgcttctgaccgacgaatgtccggtgtaaaaattgttcaaatccttctacttccgtcagtctttctaaaacggctgacagtttttccggtgaatttttccggaacagttctccggactcgaccatttttgtaatccatgcgcgctcttcgaaatcatgcacatggtcaaactcgaaagagatggttcttttataggtattgcgtaaatgctggatggcttctaagccgtttgttatattggcaggtgcgtctttacagatgacagacgctggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgccgagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacgctgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaaaagcctatcctatgcttttatgaagcagttttttcaagagcggatacagcacatcgggcagctgatcgacatccggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcgggcgcaagctgcatgatcagcggacccgccgcctgcagcagggactcttcaaacggaatgacggtattgaagaaattcggctggctcgtttcggtcgcttcgtttgtatcctcccaaaatccgacgatttgatgcggtacggacactgatttcaaggcctcatgaaaaagaacgatccctctttttgtttcatccattttgtcgaacatgctggccgaacagtcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagcgtttttttgtgctcaagtgttttttgtatcatctgcttcaggcgtttttgatatgattctatcgtttttgcctgttctttataagactgctcctcttcaggagacgctttttgaggcgtttgataaaccgggaaggcaaatttgttttcttttccgtcagccagcccggcgccctcatgttcatcctgaatggattcaagcgcttccagtttggagtaatcctctcttttcgtctgacgtgcggaaccttgaacggagccgagcgcctggtcaccgtcatcgccttctctggccgcgtctttcccaagatctgatttcgcgccgtgctcaatatcaaattgaaggaagctttttgacggcgcttcggtttcccggtgccacgtattcattttctcttcaaggatttcttcatctccgtcggaagactcagggagcgtgagatcgtcacttaacgaaggcgctttttttacgctttcgaataaaggctcttcagccgctttttcgtaatcaagttccggcagaaaaaagtatgtgttcagcatatctttctcaagcacttcatcaaggccttccatgaggtcttccgttattgttgcgatttgttccgtagaatccgcctcatacacccggatgagctgacgttcaatatacggtatcatcatatcaatattttcatgcatggaaggaatgccttctagcggagactcagccgtcagcttgacaaacatcgcgcaatacaaagcgtcggtgaaaatgctccgttctaaattcaatgtcagctgcgtcgtgaaatatttcctgtacatctccctccgcttctgaaaaacacgtttcgttcccggccgttcttttttgatctgctcttcaattctgatatcctcaagcagcataaacagctgcttggcaaagctttggcgggtgaagtgccggtgaacgtcatttaaaaaccccgcaaataccagaaatgagctgctgcgtgtcccgacagcgcgcaaatagacatcgcttttcaggccggcttccatatccccggctgatcggtctttccaaaagtggctcatgtaaattttcttttcaaagggattgtagtaagactgcacgccgtattccacttcaacttcactgcttctcgtcagtgttttggccagatcagtcagcatcatgaacaaaaacgaatcaatcgtgctgtcgttaaatttgataaacttcattgtatatccctcattcgaacagcgtttctgcaatatttctgacagcggctttttccctgtcgtcgtcaagtttttccacgatgcctctttcaatcgcccgtttcggcgggatgtacgcagccaagtcgcacgtatctatgagagccctgatggacgccgcttcttctgacacttgtccgttatgcgcttgtgcgattaaatcagaagacagcgtcataaagcgctcaattaatctctcatcttttaagacagactgagaggtcagcacctgtttcagaaggcttcctttaatatacggaacatcaatgatgacaaaacggtttttaagggcttcgttcagcggaacggtgccgacatagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcatcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgtttttcccgaacccgtcggtccttttaataagatattttttcccattgtcaaagcgatgacggcatcgaatacaatcgccttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggccccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatccccggcgtgatgacccataggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgacccttcatcatcagattccctcacttcgatatatccgatcgtttttccgttttgattgatgagtccggcatgctcacggtatgcagatgcttccaatgcgcggctttccccatgttttttgggcggaacaggagcgggtctccccccgcagccgcaaagcgtaattgatgcgagcatgagaaaaagcaagagacgattcatgcttcctcccccttatttttttacccatcagtcttgtcaaaacgtgaaaatggtaaacaaaaaaagccccgaaaggctttttttaaaaataactgcgcgctcctaaataagcttttttccaatatggattgcttaagtttgaaatttcaaccccggaggagcttgcgtgaataaagtctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggcacgccgacatgttttttcgcctcgcctatcattctgtcaatctttgaccctgtcaccggaggttcgggagtatttggcttggttggctttgccggtttgttttccggctgccgcgcaggctcttctgtttttcccgttccgttaatcaacagaacctgtccgatttgaagcacatcagttgtcagtttatttttttctctgatgagctgagcggtgatgccgaaccgattagcaattttccacagggaatcgcctgcttttactttgtaagtggatggcttctcagaagggtttgaatgagatggcggttttgtgccgctgtttccgttatgtgaagaacctttgatctttaatacttgattcggatacagcatgtctgatgttaattgattcagcattttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgacatctgaactcaaacggttcaggcttctcagttcagaaacgctcattcggtattttttagcgatcacccataatgagtctccgtatgtaactgtgtaggcaccagtgtttcgttttcctttttgccctgttttatgtgtgccgctgccgtcgggaatgtgcagccgctgtcctgggtggagtatcgttgatttcagtttattttccgcctgcagggctgaaatacttgtatgatattgccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgttccttttctttggacgccgcctgttatgcaggattcattcagaagtcgacattaattccgattcatttggtcttagatcatcaccaatgccacacattttacataaattgagaacatttcacaaaagactttggaatcattttcataacatggcttttttccgcgacattccacctttcttgtctgtttttcatacaattctcttcacggcgtgaaaatcctcccgaaaaacaaacaaaaaaaagcccgcttcctataaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagttccgctgttacatcttcttttttaaacatcttgcccgcgcccgtgttttccacttggcttccgacggcgaactgatctgctcccatcggaatgacgatcatcggggttttgtagtaaagcccttcgctcgtactgttcattccgccgtgagtgataaataagtccgctctcttcaggatctcaagctgcggaacataaggctttacaataacattctcaggaatttcatcaagctccgccggatcaagatgtttgccgattgacatgacggcttttccgttaaagttcctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattaagccggctgaccgcttcggtataagccggataatgagatgattcctctgatataaggtttgtatttgaaaacacttctttaataaatgcttcattcattgcaaatgttgtgcaaagtgaatatgccggcagtttcagcttatttctcacaagccttcctgccagaaaatgatgatcataaaggatgtagtcgtatgattcatcttttacttcctcaagaatacggagtgcggctttttcggaagtctcaatcattaacagtaaaaactcggtagcatcccgctgttcatcacccgttgcgttttttccgaattcatcttttcggaaatcttcacattcacggaattccgctccgcttgacgcgattttgtgctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacaccaatacagaaaaaggtaaagatgttcaccttattaatattaaatggttacaatattcccattttcttattatttcgcatgaagcgcccgcggtgaaacaagcggatacagtccgccgtctttagcaaaagacatttttcccgtttcttctgaaacaacgagcacgagtgcatcagtcacggccgaaagtcccatcgcggccctgtggcgcgtcccgtatttgagatcgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcattccggcatcctcggtaatttgtttcaagtacgtttgaacggcagcggtaaacgcgctttccgtcatttgagtgtggcgcatgtcacatcatctcctttcccttattttctgcatcgcgcgcatggatatgcgccgctgtgtacaccataatcatgaaaggaggcgcacatcatatggaattcgcacggctgatgcaatatatctgcacctttttaggggtcatttcactttcattcatttatgccaagatgtttaaaaagccgaaaccggataaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacacaggcgggccttgccctgatcacctttttggacacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacaaaaggaagtgccgttttccgtcatccaggccgtttatgtagcggccattctcagtgcggcggttatcctggtcggctttttcaccgttgatatgatcttgggacatttgggcctggaacctcgtgtccggacgatcgccaaacactttttaggctttttatccctcggtatttttcctttgtttgtgtacgccgttttgcgctcgttcattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccgtcagcttttttatcgtcttcagatttgagccgtttgccgggtactctgtatttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacgattgcatcccaccaggcggcaatgaattttgcttccctcttgtatatgctgccgctcagcgtatccatggccatgacgattttagtcggctttgaagcaggcgcaaagcgttacagggatgcccggtcatacagctatatcggcattgtgatggccctttgtttttctttatgcacggcggctttcattttactgttcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagcaatgccaaaacataaactgctgtacgattatttaaccgaacgggcggaggacatcagtcagacatggtttgatacccttcatgatacggatcctgattctgtttatgcttctactgacccggctgttctcacaaatctgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattacagagctgagctcgccggtaattgtgctttttgacaatgtcggactgctgccgctgatcggggatattgacacggcaagagccaaaatgattttggagaatacgctgcaccagtgttcagagaagcgcatcacgcagctgtacattgatttatcaggcgtagccatgattgatacgatggttgctcaacagcttttcacattaattgaatcactcggaatgctcggcgtgaaagcgacgttatccggaatccgtcctgaaatcgcccaaaccgcggtgcagctcggactgagtttttcaaatttatcaatacggtcttcgcttgcggaagcgatcgcttccgacctgacacaaaaaaagggataaggcatttcagccttatccctttttttatcagtctttccacggatatgtccaatacacttcttcttcaaaccatgtctgaagaaccggctcgttattttttaatttttcttccagctctctcagcatgccttccgtttgggtgcggtgcgcttttaaagcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttgcatgcgtcaatcagctcttgctttcttaacagcggcagtgtttcacggttcgcgaaaaagggatctcccatgttccggcccatttcgccaagcgttgcgcatgcatacgtaacgggaatatctttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatatttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcaattcaagatcaatcgccttctccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgctttttgcccggaaaacggttcatgatacacaaatacgccaagcataagggtgatggtcggcgctatatattgcaaaatgccgacttgatacagcggcaaacgctttgccccctctgcaaacaataacagcggcagggccgtaaatacgcctgcgaaaaataggagcgcccatgttcctgcccccaaggacccaaaagtgctcccgtcagctgcatatcctaaataaataagtgcagccggggtaatcaaaagcgtctccagcgtcagcccgatcgtgctggacatgcgggttctttttttacataagccgtacagaccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatgacgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaagaccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcgtacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttctttaataaaatggcggataaccgccggctcccggcccgaaaccgccgtatgggacgcctccgtatccgtaaccggcaaacccgtacggatagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcggttgtaacaacttgtgcctctctctgatattgcattaagatataaacattttggttataatttgattatattttgattaactgttatactttttttacaagttgcgacattataaaaccatcagggggaataaaatatgccattacttcgttttgacgttattgaaggccgggatgacgcagcattaaaaaaattactggataccgcccattacgccatggttaaagcttttgacgtcccagtaacggaccgttatcagatcgttcaccagcatcggcctcatgagcttatcattgaagataccgggctcggtttcaaaagaagcaaagatcttgtcatcatcagcattgtcagcaaagcgcgcaccgaacatcagaaagaaacgttatatcaactgatggctgatcagcttaaaacagaatgcggcatatcacccgaggacgtcatgatttccattacagcaaacgggaacgccgattggagcttcgggctcggtgaggctcagtttttaaccgggaaactgtaaaaggcctccctgcttgttttttggatgatttcaaactgaataaaagagggatgtatgttggttagtgagttgtatccttgtttgatatgcggatttaaaggattagagacaagtcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccagatgatgttccggcggaatgtaaaaatgatcatttccttacattcgatgctttattaaagcaattaaaaggcttgaacctcaatctgaacaattttgatattaatggtttttatgacgattaaacattatcattaagaaaaggctgccttgggcagcctttattattcatcacatgtgtcgttggcagatcccccgggctcgcaaaaactgtctgcccatttttgcatttcctgaaaaacggcttgcagagccatgcctttatcagtcagtttataaatgactttgacaggtgtttcaggcagcacctgacgctcgacgatttcattttgttccagctctttgagccgctccgcgagcattttttgactgattgtcggtatcgtttcggtcatatctttaaatcgtttcggcccgtccatcagtacatggataatgaggccgttccagcgttttcccaaaagagaaaaagcggattccattttaggacacattgtatatcccacgtgaattcatcccttcatctatgaattgacaagttttttgtgatccattaaaattagttttcaagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcaccttccgcctggaaccttcagcattggcattttcaagtttttcacagtgatgaagcaaaagctgccctgcttccggttgcttttaatcaaaaacagattattgattcatcagcagttattgccgtattaggcgacttaaaagcaaatgaaaatggtgaagacgtttatgctgaactggctgagcaaggcaatatcacagaagagattaaacaaacgcttttaggccagattaacggtgcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaagaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcagactaagggttttttataggaatcgctcattgtaccaggcccgtgcctgctcggcttcctgctgtgtgagctgatgaccgccctcctgccattcaagagcaacggatgcatgagcatctgtcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgctgcaatattggcgccgtttgaatagccggcagcaatcacgttttctctgctgaacccgtacatttgcgccgcttcatcaataaaattctttaattcttccgtccgttcaattaaatctttctcgtcaaataccccttctttcagccgcttaaaaaaacggggcatgccgttttccgacactgatcctctgacccccagcagacttgcgttcggatcgataaaacgtccgagcgacagaagatcatgttcatttcctcccgttccgtgcaaaagcagcagaacattttctgacgttccctgttcaaacatatgtttcatcatcattctcctttctccattttgggcagaacagctgtaatctgactgcgatgctcttccagccattccggaagcttcagctctgttccgagattttcaaaggattcatccgtcataaagcccggttcgtcggttgccatttcaaataaaatgccgccgctttctctgaaatagattgaagtaaagtatgacctgtcaagaatgtcagatgaagcaagatgagaatcagcaagaatatccttccactccgcctgctctttttcgctcgtgcggaaagcgacatgatgaactgtcccgtaaccgccggcacccgcttctttcggagcaaggtcaacatctataatatgtccgatccgtgcctccgattgcagcctgacaatttgattttcttctcctgtctttgaataaccgaagcgttctatgagaaattgaatggttgcttcaggacggtatgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagacagcatgatctgttcttttacagacaagccgttttcttcaagccggcgcttccaaaacgcgagtgctcctttcggcacggagaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacgagccgcaaacccagcacttcagtataaaaccgaagattttcagcaggatcttttgcaaatgcggtaacatggtgcaatccttgtgtattcaatgtattcactcctaaatatcttgatttcgagatattaactattctaatttaatatgaatgaagatgcaactaaagtgtttcagttaaaaaagtaatagaattcttttttttctgaaaaatatgttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcctttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggggggctcctcgtctggtttttagtcggcgcggatctctatacggcttatacgtttttaggcttaacaagcacagcctacacagggggaagcgttgctttttttgcaatcccgtattctgttttggcgtattttatcgcttatttctttctgccgaagttgtggaaagtggcaaaaattcacaaattaacgacgcttgccgattatgcccgtgagcgttttgacagtaaacttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcggaattaaagggccgacgtttacggcgattattaaagacattatggtgtgggtgattatgctgtttatggtcgtctcactcccgctgatccattttcacggctggacgccgatgattcacactttggctgaaaaagcgccgcatatgctgacgataccggactcggggccgaaaggaattccttggtttatcacagcttccatcgtatctgcgctggcgctctttatgtgggcgcatgcggcaaccggcgtatttacggcaaaaagcgcagatgccgtccgcaaaaacagcatgtttctgccgctatataatattgttttgattcttgttatttttctcggctttatcgcgtttcttgtcctgccggaagataccaatccgcggctcgctttattgaagctgattcaaacgtcttacggcggagtcgcacagggatttgcttactccacgatcgcccttgcgtcattgattccctgctccatcatggccatcggagcatcaaacttatttgcgaataacttatatcgggatttgattcacccgaatgtgtcaccaagcaagctgacgatgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattaccggtcttctcgtcggtcttatcgtgacattcacggtaaatatcacccaatccgcccacggtatatatgaagggttttggggtttgaccgctaacatggcagccgttattatccttaacccgttttttgtaaaaaaagcgtcttcaaacgccgtcaaagacggtttattcaataaagcgccctctgataaactgaaccaaaaaggcgcttaacagaaaaaagccggcacatcgatgtgccggttttttactttttgtgctgccatttgtaggtggcgacggttttagccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgtttggctccgcgctcgataaattttgaaaagttgcctgtcatatgaaagatcgggatattccaatagcggtcagggtttttagcatcctgaataaacagcgtcgggtccggggtgcctatccaatgatgcgtcttgatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacggaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctgctgagacggcggcatgtacatgctcggatagtcgatttccagcaaaggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcaatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccagttttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagccgcatacacttcggcttccgtgctgcttgatatgaaaaagaaaaacataagaaaaaccaaggtcatgtgcagactttttttaaaaaacataaaccaccatccctttccttatttttataagcgattctaaatgaaaagccggacagtcacctccttcccgttttaatgaatgcgctttcataattactgataaaaagccggcttcacacaacggtgaagccttccctttttacacctttaggatacatatgcgccgtttgtttcaatcacttttttataccattcaaatgagtctttcttaagccgcttcattgaaccgttgccttcattatcccgatcaacataaatcatgccgtagcgttttttcatttctccggttgtaaatgacacgatatcaataattccccatggtgtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttacgacatccccggtattatcgtttatcacgtcactttttacggtagtggacatgtaatagctgaatccgaggtagtccactcggccgtttttcaaaatctcttcatcaccgtcttcaaagtgtatctgatagccttctctttcaaattcttttaacgcatagcttggataatatccgcgaacctggacgtccgggaagaaaaagcgctgtctcatcgtttcttcagccagcatcacatcatcggggtgagatgagtacgggtaaatcgggacatgtgataccatcgcgccgatcctgaactcaggattgatttctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattattgatttcgttaaacgtcatccaatacttcaccttatgtttatagcgttcaaaacacacttcagcgaatttcacaaaaaatccgactgtttttctgtttctgaaaccgccgtattccctcgccaaatgcagcggcatctcaaaatgtgacaaggtaattaccggttcaatcccatgtttcagcaattcatcaaacacccggtcgtaaaaagccaacccttcctcattgggctccgcttcatcacctttaggaaaaattctgctccagccgatggacgttcttaaacatttcaggcccagctcgctgaataatgcgatgtcctctttatagcgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtttatatcctcctttatttgactgccgcttgcataccgaataaatgcactgcagcagcttcaagcaccgcttcgcaggtgtagaagaattcctgccttcattttcatattatacgtttacattataattgtaccggtataatttatcaatacataaacaattatagttaatttacgaaatggcttttaaaaacgattatgctataattctgaaagaagcgggacaaaaaatgaatgaggaatggatatgttaaaataccagcaaatcgcgatagatattgaaaaatacatagaagaacatcagctgcagcaaggggataaactgcctgtgctgcaaaccttaatgacccggtttaacgtgagcaaaagcacgattaccaagtccttagatttattagaaaaaaaggggattgtgtttcaagtgaggggaagcggcatttttgtcagacggaataaaagaaaagggtatatcagtctgctttctaatcagggatttaaagaatcacttgaagattttaatgtcacttccaaattattagcgctggaagtgagaaaacccacgcctgaggctgcccaaaatctgaatatgccgcctgacggcgacgtgtattatgtcaagcgaatccgatatattgacgggctgacattgtgtatcgaagagtcattttacaacaaatccattattacgtatttgaataaagagatcgtggcagaatcaatatttgattatattagagacggtctcgggttaaagcgcggtttttcagatttatatctgtacgcggggatgttaaatgaggaagaagcggagtacttaggtctgtttacaggagcgcctaagctttgcgttgaaacgatttttcatttaaccaacggccagccgtttgatttctcaaaagtcacctatcactatgagcaatcacagtttttcattcaggcgaacagccacctttttgaacaggaaacgacataagacgggcttttcgcaaacaaaaaacaccccatgcgcgagcgacgcatcgggtgttttttactatttcatattcttatttaatgtttcaacggcttttttcatttgtgtatcgttgtccgcaagctgtttttgcagatccgtcatcagttttgccgttgtgtctcccgttaaaatacctgtttgtttcagcttctcttttgcttggaattgtttgactgcttgttcaaatgctttatcatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgatgccttttttatgaatccactctccgtccgctgtcagccattttgcgattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacttctttcgtgccgtctttgtattcgacctgcatgatatttttccctttatcgataaacatgttgctcattttgatggcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaatacggatcatccagggaactgatcatgccttttatcgctccgtctactaatttgctgtcatctgttttttgatagtaatcacttttaatctgctcataggctttattgaatttctcaaatttgctgttcgtcaaagcagccgagccttgtccgaaaatggtcgtattgcccgtgataaacagcgtaagcgccgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcaccccggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatcctcttatgcttgaaaaagcagcaaaacgatttgccgctgaaggcttaaccattccgggctatttagcggagcttgagcggctgccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacgcagataaaagacttctacggttttaccgtattgcaggatgaaaccgcatggaaacagagattgcttcagcaaggctttcagaaagcggatttcattcccgctgtctatgaaaacaatgcgcaggagccgactacagaaatggatttatcgcccgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcgcccctgtcggcggccgtcacagagggtacggattcggttattggggaggaggctggggaggctggggagcagcctacggtatcggccttggtttcattaccggatttgcgcttggaggtctgctcttctggtaataaagaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcctcattcagctcatatccgttgcttttgctggaaatgtccatggcaagccccgtctggtgttcgctttgccccggatatgcgacggcttctttcgcctttttttcacctttcagactgacttcattatcgaaaataactttctgtctgtcataagaacggtatcctgaaacggcaaccaggtcataaccttcttttttcccggcgctgaatagttccgccaaagcatcggcggccggtttgcggatatatcgtttctcgattttctcagtaaaagaaaattcgactttcgggattacgagatcattcggtttataatctcccggcagcgtatatgtcttatttacgagcgcaagtgtatttgtcgggttttgaatggtctcaagcccgttcacttctttaatatcattaaaatatttgctctccaatacaaaatcactgttttctgtcttcgttgtttttttgcttgatgtgtcatctgattgttttgtttcagctgctgtttttgtgtccttatggctgtcgccgcctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatctgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatagccaaaatcacgtcacgcaccttcacgtcattacggatggctccgcatgagccgactctgattaagttttgaacatcatagctttgaatcagttcattcacataaatagagatagacggaacacccatgccggtgccttggactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcattgatcagggcaatcttgggcagaatatgcgggatgacaagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaatcttcagccggctccgtcttacctcggctggacgagcagccggttaattttactccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccctcttatttcttaatagtattagcgttttttctcatttttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgagggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaagagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggacggcttctatccggatcgctgctgcgagcagaataaacaatgcgaaaagacttgctggcttgtacaacgttttccccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaaacaagccccggagggagaaaagataatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccatatttcagttctgtgaccgataactcggaataattcctttccgtagtcctttacatatacgacgtcgccgatcagaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccataatttcgcatgggcatgaaaaccacaggaaatatctatttctgcacctgttcaaaatggcaaaaaccccaacatgcttgtgcgttttttcacttaccgtaacagaagcgtctgatggcattgcgctctcgatcgaatgagcagtaacaatgacgagacaaaaagcgcctgtttttgaatgagtttttgtttatttctccatgacacaaagataaatacccggcccgaaggcatgttgacaatatcaccgccgtgatgttcaaaatttgccgtgaaacacatcatcgaagatgtatggagatccaattccggctgcatatctgcaatggcttgtttatcatgaagaaccaaactcgtttcggctttcaatgaagccacaacttcaatccgcttcaaccttgtcacataaaattcccttttccgtccaaacgtcagtgcctcaccatagatcatttgattcctctcacttcatttaaatgtttgattatttctccgtgaaaagaggctccttacacgggaccccgccggcagcaggtctgatccggtgaactctgcagctatacattctgctgccttatgatccgtgccatcaggaagacttgtttacgcgctgatcaaaacgaaaggcattgcgggatttgatcatacggcacctcataagcgattgatttcaacagaaaaaaaccgcacaatgtgcggtttttcgtcaggcgtgatgcacctcggtctcatatttttcccaagcttcatcaaatgtcgccatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtccccatcagctcttgatatgtgagtgtttccggtaatttttttgcattgactaaaaaaagctgattttcgatttccgctatgaccgcttcctcctgatacgtcatgccgcaggaggaacaggcgaatgcgggtgtttctgtaatttctatggctctcgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttcctcctgtcgatcctcgatacattttccggtgtgaacgaaacctctttgtccgcgaaaatggcgctcagtccgacaggctcgcgtttggccattgttcccggaaaaacagattcaaaatagtcgtcagcttgattcgggatatagttttccggctcgggataagatgtaatcaccccttcgaagtttctgatcacaactttctccggactttgggagagcaagtagttcggctgcagggcgattttaccgcctccgcccggggcgtcgacgacaaaggtcggcacggcaaagcctgttgtgtggcctctcagtccttcaatgatttccaatccttttgacacaggcgctctgaaatggccgattccctctgacaaatcacattgataaatatagtacggacgcacgcggattttcactaaatcatgcatgagttttttcataatcggcaccgaatcgttaatgcctgctaaaataacagcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcaggtttttcaaaatatattccagaatctgatcgttaattaaaagcccgtctccgccggaaatcaggcagtcacggatttccggcgtttcccggatgtaagcgattgccgcatcgagctgttttttcggcacccccattccgatctgtccggaaaaacgccttctggtgcagtatcggcaatacatcgagcattgatttgtcaccagaaaaagaacgcggtcaggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttttcttccggcacatctttccacaattcaatctccttccagtgacgcttcggctgaaaccatttgtttgtcaaacgaattcctccttatgaatggccaaacgtaaagttttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagatgaatgattccccggccagcgagttcctgctccaacgctttaaacaagtgtgccgttacggagttccccctgtaatctgacagaaccgcgcaatcggtcatttctgcgtgccccaaaaccggattgatatctgcgcttgccgccccaatgagacgatcctgatcgaatgcggcataatagatggtgttttctttcattgtttttttaatataaaggggattaaaaacaggagtcggataggtaagaaaaacatgtttatataagtgcgttaaacggtccgcatcatcttcgtccgcttttctgaacatcagcgtgctttctgtctgagtcattccccgccgcggtgtctcatataaacggtcaacagccgaatcttctgatacatatgaatctgaccgtctccgttcctctgataaatagcgcaccatcacaacagccttatgcccgttgtaatacccgtctatggcaccctcaataataaaaagatgcttgacaaattccggctcatcgccgcgcttggcaaagaaaatcaccttttgggctccctcttcctttgcttctgccaaaacggccggtataagcgcctcgggctgtccgtcataacgaatgaccctgatccgctcgttgaaacggtctgcatcaatctcggccgctccgctttcagccctcagttcctttatcagcgctgtcacccccatctgccaccccgcaccattccatgataaaaagagaaatgattttgacggcatcgattaacgcccggacttcaatgtattcattcgcctgatgcgccgccttgacttctcccggaccgaagacgatgaccggcgtctgtcccgcgtgctgcaaaagccctccgtccgttccccacggggacgcttcacgaaccggttttgcccctttcattttctcaaaagaagattccagagcggaaatcagcggatgctcatccgggagatcattcggaagccactgagccccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttcccccttggacggtgccgatattaatgggaaccggaatcggaacgtcccgataaagcgggtctttgatacgggcgttacggacgtgttcaagctctttaagggctgtgatgacatgcaggcttttttcaatggcgctcaccccttcatagcgggtgccgccgtgtgcggacaatcctcttaccgtaatgcggaaccacatggacccttgctgcttaacaaacagctttaaattagtcggttcgggaataagcgccccgtcagccttgtagcccttcataacagccgccagtgttcccgcgccgccgcactcttcatctacgacactttgaaacagaacatctccttttaacgtaatcccgcaggcttcaagcgcttctaacgcaaacaagagggctgtattgccgcctttcatatccgttgaaccgcgtccgtaaactttgccgtccttttcaacagctgtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaattgtttgacactcggctcccagacatcaatatccatgtcaaactgtctcagtttttctaaaacgactgcctgtgcgttaaattcatggccgaacgtgcttttttccccgatcagccgtttcagcaggcttaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagccccatcatctatgctgatgacggctttctctgtaatgatgagatctgcacagcctgctgctgtaagcggcaatgaacagctttcgaccagcttcggccggcctttctgatcggtgtggctcatgacgacaaccacttttttcgcgccttgggcaagctccatcgccccgcccattccgggcacctttttccccggcacgagccaattggcgagatcacctgtcctgctgacttggagcgcgcctaaaatggtaatatctatcagaccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagttcggcactaaagaaggaatgccgatccccaggttgacaatcatacctgaggtaatttcactggcggcccgcctcgcgatactctctctttccgctattcccaagcccatctccacttcactccttcactttgcacgacaccctccacgaaaacgcccggcgttacaatatgctcgctgtcaagttcgccggcaggcacaatctctgccgcctcagcaaatgttctttcggccgcagcagccatcagagggttcatgttgcgcgccgttttgtcaaacgtcagatttccgaattcatcagcaatatgtgcagacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcctgcgacaggatttgagccgatatgggaagcgatcagcctttttacccgcttatgaacgataagcgggccgataccgatttccggaaatccggcatcattgcagatgacggtcaattctttaacgccgctttccaaaatcgcttcgattaatgacggaggtgaacccactcccccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaacggcggggcgatgatgacggcgtctccttctccgctgtcaataccgggctttgctgggtaaataagcaggccccgtttttttgccgctttaatgattttttcggtgaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgcccttgcacagtatgggttggcactgtacgtatgtccgctcataatgaccccggagccccgcttgatcgtttcaatgatgtcatcagacgcaacagctgccgcaatcggagcgtaaccggcgcccaatccttttccgagcaccgcgatatcaggggcgatcccccaatgctcagaagcaagcatccgtcctgttctcccgagccccgtcatgacttcatccgcaataaacaaaataccgtgcctgcggcagacaacctcaagcgcttcataataacctgtcggcggagtgatggccgccccggctgctccgacaatcggctctgcgacaaatcccgcgataaatgaggaaccgatccgctgaacagccgtttccagttcagccgccgcagctttcacaaattcctctccctgcaactctgaacgatacatattaggcgctgaaacggccggaaaccgttcaagcagctgggtgaagcggtatctccgttcatagaaccctgataatgaaagcgcccccaaagtaatcccgtggtaacttccccatcttgatagaaagacggatttttggtattgccctttttcctgccaatattgaacggccattttcatcgctgtttcgactgcctctgagccgctgtttacaaaaaatgaccaattcagtccgcccggcagatgatcggccagaaataaagccagttcttctgccggagtactggtgaattgcgagcgatacacaaacgaaacggagtcaagctgctcttttaaagcttgtataatctcctccgtgccgtggccgatattgcaagtgaccgcccccgatgctccgtccagatacttgttcccctcctgatcatacacatatgatcccttaccatgactgactgacggataatttgcgtcaagctccggtttgattaaatagctccccatatctttccacctcgaaaacccatttgcttcattgtatgaacagatgaataaccgcattcttatccttcagaaagttttttgaagaaaatacctttctgtaaaacaggctgccggagatgtcccgacagcctgaagagcgttctggaaattctattcctattgttgattttttctttcttcggttctgctatttatctgctcatcacatcatttttgatctgaatctgtataagcagcaggcggaaaattcccgtcttctttactgtatgggaatcaatatttcacacaaatgatgattcaccttttgtaaagtatacctttcgataataggctgttctctgattgataaattattttttccgatctcagaaaaaacagtgttccaaaatccgctgactgcctcttttgtatgatcaagcaagaaaacagcgtacttccctccggaaaatgtaccgatccgggctggttcaggcacatggtcttgattgataacaagacaaacatcatagcggcatttctctttaggagtacgattcggatgatcttgcggaattcctaaaatgacagaatgatcaagcaggccattcaattgcgcccagtttttaaatgactccatcagttctttgttttgctttccgccatactcaccgacgtttcggaaataagcaattctggattcgggtaattcttcaatcgttatgttcacattttctcccccttctccagaaaggtaatatgtattaaaatgtttttcaagctgatttttcagcatggaaataacaaaaagcctgcagaaaatgatgttctctgcaggctgattttcattataggattttttcagtctaacaaataaaagccgcaccgacgatgattaataaaataaacaataccacgatcagcacaaaagtgctggttccgcctccgcagccgccgtgcccgtaaccatagccaaaactgccgcaaccgtagccatatccgtatccgtacatacgcaaatcatcctttcttcttacgatatacggtattgtatgcgggccaactcccaattggtttatgcgaatgcccaactatgtaagaaaataatgaaaaattgtatgcacgcgccgaaatcttttgaagccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccctccttatacaaaggatatttccgctcaagcttttgttcggccgccgcctcgccaatgtaaagggcatcatagatgttcataatagacgacccatcggcgaggctcttttccgtcccccaagcagtgagcgggtgtccggcctgcaggtccccattttccagtttccttgcaaaaaacagctcatcttccactacgcagccctgctttaccagagtttgtttcagaagaagcggaaatgcgtgctccggagacgctttcacatgaatataattggcttgaagcatgcccggaacggacgaaagaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttgcacatccgactgcatctctcaaccttttgttatattgagatttcttataatttcatcgtacaccggatagaacggcattccaattggtaattgtttaatttgctgaaaggaaatgggtatcgccttctgattcgcaaaaaagcgtttcgctacgtcatgactgatcggatggagaacccctctcaaataaacataaaatttccgttcaatgcgaaacagcatcctcccgggcaaatgttgaacacagtccgatgtccaccggctgatcggcggaccgtccggaagcgattgtatttcggcccgttctaaagccgggatgccatgccgtttaaatcggtaaaagcgaaatgcgctatgatcaaccagccttttctccccgtcttctataaaataaacatgaaactgatccctgacgagctgaaaattcggaatacttgcggagtcctcttcctcatattgaaataaaaacggatccggaatgacgacggtccggccttcgtataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatgcataacatcttcgtcccaaaagctgccgaacttctctttcacacgctcaagcaatgatctccggtgcatcactgaacagtgatcaacgagaaaagcggcctgatcaagcacctcttcagcaaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcggccgaggtttcttcatttgaatgatcatccatcacaaacagctcccaattgctgtaggtctgatgcaaaacactttcaatcgcctgttttacaagatccggtttgttgtaactcgttaagataattgagaccttcttttccatcccatcaccccttctgtaaaacgtaaaaaacggctccgaaaaagacagagcctgatatcgttattaaaaagccccccagctgacgatgcttgaaatcgcgacgtttgatctcgtattattgagcggattttgaaaaacggccaaatctgacagcacttctttgacaattacgttctgcagtgtgctgccgttaatcagattgacgcgcgatacaggaaccccaagctcttttgccattacaagctgacgccgcaaatctgaatgatctccggacggctgatgagataacaaaagaagaagaagcagtacgagctgaaattcctcctcaaaacccccgtgttttacagtttctcctgaatccaaaatattcctctccttcattttttaatctatacaacgtatgtcatactcttacaatccgcataggcaaacaaagcctgattcgaaaattcagctgtttgattaattattgaaaaaaatgcaagcaaaacggcattcgacttataccaatcttttcaatcaggaatatgaataaacgtgaggttgaaattgtaaaggaggtgtatgtccgcatgagcgaggatcgtttggagcttaaaaagaagttattaaaaactcttttagcccctgtatttgacaacagcgctttatctggcggcacagatggaggagataatgtggaaaacaaagtaaaagatttattggaatcggcaattgatgcaaaagtggatgaagcagcggcgaaagacagtctcagcgcacaatctgtattgggaagcggtatttcattagcggcgagatggatttttgcaagaattcagcccggcactgtcatcagcattgtgatggattcaggagacatgatcggcccggttcaatttgttgcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtatatctatggatgacggaggatcctttttatttcgatgtgagtatgacaatcgcgccgcttgcggatgccgttttaacgatagaacaaaacgcgcttgatgcttaccggcaaatgggcttacagcacgtatattatgtcccgatccccgttaatcagcggctttttaaaaaacaacctgctgaagcctctcttcacacaaatctgcttctgatcggatacccgtatccgaaccgcgttgaactggtgaaagcagcggcgaagcttccgtatacgcttcgtattatcgggaagggatggcgcagacatctgcctaaaaaaatcgccagacagcaaaatgtgctcgtaatggatgaatggattgaacccgaacttgccgcattatattacaacagcgcagaggtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcaacatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccatcggcacgatcgataaccgttccgttactgccgccgtccggctcagcgctgaacttccagatggcctcatcttcttctgcgatataaagactgccgtattcatcgtctgctgccatcccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtttggatccgtaatgctttgtaatgtgccgtttttcccgtcaatggcgtaaatctcaatggtattctttccttcagaccgattggatgccgccgcaatatcgactttttttccgttcaacggaaaatcataacggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaaccggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcactttaattgtaaaatacatacaggaagttcagtgttaagtttttgtgaagattgtccgaatgtgaggatttatgaagagaaaaaattgacgtgagcaaatatttaaaatgaatatttagtacaatgttttatttgtaatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagtaaacaatatgtgatgaagcaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagcggctttgctgcaagaagtgacgcatgtgattaatatcagtaccgataaagccgtttattaagatactcaccacaagcaaatcaaaaaaagaagcttactctgcactcctttccaaagcagcctccaataaatgctgagcaaattgtttataaaattcatctaagtcattactcgcttcatcctgatctatatagcggatactgtaattatctttatggacaacctttattgttttcttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgggaatgctggctttattcaaggtgcccagtaattcaaaatgtgttcttgacatatgccttctctgcacctgagtcaacaattgtcaaataaatcccggggcaggaataagccaccgcgaatgaagaatgacgtgaggtttgaagacattatttcggttcaatatgccgtttcagttttgcagcggtatttctgagaattaaagaataggtactaaatcctttcaaactttgagatatttgtttttggcggtgaagattcatttaattttttataccaaatacgaattttttgtcctttgctcaagtcatctttattgttaagttgactaagtcccagtaaaactatatccgatctatactttttaataatctctttttcactaagattttcatagtctttaacatcagctttttcattatgtatgaaaattgcttgattctctccttttaaaatgacatagccgaccatggtttgctcagcctccataaaatgtttgctttgggttttgacaccctaatgttatacttaacaaaattaacagcattgtacataatctatacaagttcaaaccgcccttcttgcatatttgtaacaagagtaaaacactgttttaggaaatgacagactaaaacgactcatttttaaggattttaacaacttccccgtagtcttatggaacacggcgaggtctttaccatcatagaaccgcacaattgcatcatgaaatatttaattggctgatcaaccacaacaccttctttaagcgatctaatgtggaatatgtgtaaggaggcggtttatttgaaaaacgatcagaaaataacacttgactcttcttttgcgttatccactcttattgtcttacttattgcattgtacccgtcctattcttcttggtttgtcacaatattctttttaggatttgcactaatatacacatttgaaaaaaagagcaaatcttcaaaactaattgctattatctcttatccattatttattgttgcgtttgtttacagcataataaacagcatgtaataatcccccgcctaagacagggttattttttatcacattgcagcaacttttgggccgcctttgtctgtgatgataaagctgtcactcccgattttttcttttgatccttatcttcataaatcgttacaaggtgttttgtcataagagccgtccctgccatcttacattcctgcttatcctaaaagtaaacaattttatattcacctagaatgatcattattagctaatccagctaaatcagatgaccagccccctgtaggcaaattaaaagcaaatcctaatgtttgaacgacagcagcagttgagtatttgtcaaagttgatcgtagacgttgctttcagtatcattccaagtctgagttatctcttttcgccttaactcctgccccaaaatcataaagcaaaccactccagtaaaattccaacaatttcaatcttgccaatggtgtttcttaaacctaattccccctctgagtgttttatgatattacactcctgaaaatatttgtttttgttaaacctacagttttattgaatcttctccacggcataaaatgggcatccccaatgagactttcggttcttttttaagaaaattgtgtctcgtataataacaaaagtatgtttttaaaattcttgttccttcttttataactaaaattttttaggtaatatattgatttcattacaaatatccattatatttgtaaatatattaaactaatggttatttaaggatggtgaagaaatgaagaaaaaacttatttcatttatcatggtgttcacgttggctgtgctggctatatcagttgtttctcctggctatgcaagtgcagcagaaagtaaaaaagcacctgtagttcaaaatagcgtacaggctcctttagcttcaaatcctgaagtacatacacagggcattcctttcgctaaacaaatattagtaaaagcacttagggttggtggccccgctttaggaaaccttattaaaaagatcccatataaatgggcacaaaaagctggtgatgcttgttctaagtggggacacaaagcggcggacgttatagatgaacttacaaatttcggagaaacagctgttactgtggccttagtgaaagccggaattccattagctgatgcacagttaattgcgaaggttgttgtgttctttttggtataactatacattaaaaacaagagagtgaggcttacaaccttcactcttttgttttaattaggtaaggagagattaccatgaatctgcttgttatgacgttatcaatttatcttttatctctcatcgtcttttttatttttatgtacagaggagaaaagaaagaagctgcagaaaaaaacacaaatgaaaaatttttattatctacagtaataggagctttggttttatcactcattcctactgcaatcataatggtgataatcttatttgcaacaggatcagcaaatgtgcttgtaaaattctttgaattagaaatagaatttaaacagattgttataacaagtgtgtgtatggttgtttattcttttacttttgataatatttttgtggctgttggaaggcatctcattggggataacttcttcaagtttatatttgcctcgttgtttaggtttttatttatttatatagtgggtatcttatgttccattgggaacagcgacaattttaaattatcattaggattaactttattttttcttttgttagaatgtattttccctaaaaagtctgaccgtgcccagaatttaaaatcttaaggacgggcatttggtgagaacattaattcatataaaaaaggaataatgttcaaaaagataaagcaggcttaatgtctgctttatttaattaaaatccctcttcatacagtgctttctctaagcaattcggctcctaaagctacactgaaccttccagctttatactcgtttacaacaataaagtaacaagcaagttgagaaatctcgaatcttgatatgctcaatggtactgttgtttttgcttcctgactttgagactgtaatgggacgctttatgtctaaaaaatctgcctataatatcgtttactgtgtagtcgatataatttatattaattggcattcaattgctaataacccgctcactgaacggaaaagcatgcttttagacattaaccttgaccataacaatgtatttgttattgaaggtctgcagggaaacggattagcttactttaatctgccaatgaaaagcatcttgaaggaatcgtcgtattaataaagctaactctccatatgggattaataaacattcttatagctggctgaaagtgattatagatttaagactacatggtaaactccgcataccttcctttgaatcttggagagtataatctctctattacataactccttaatgcttagcaaaacggactgaaaattcagtacataatacaataagttatccaaatcgtttagctgtaattcaccaaaatgctcttcatattttgtgacagattcattccagtttgaataaacccattgacctcctgaaattaaatgttattatttactttaacttacaaataaaggagtgtttaatttgaaaaagttgtttagttttattgtttgcaccatggtggccattctttctctgagcattgccactgccgcatctgctgagaccgacaattctaggttttcaactaagcttactaactctgtcgaaagtgaatttaaagcttttggtcttaaccctcctaattcaaatagcgttgtaaatcttacgaaaaacaaattgacattcgctggacaagcaactggcaatacgttatattcaaacagttattttcaaggcaaatcttcgataagctattcaattacaaataatattggaactaaactaactgtgaaagtttggaatgattccgactggatttttgctactgaaacactaactgtaaatgctaacggtacagctacaggaacaataaaaaatctagatgccaatgcgctttactatctatctttctctgctccgagcgacttttctggctatgttcaataatacgtatatagcagctccattcgtggggcttttttgtattcgttaaaaactatcgtacagacagaattggattaattgtaagaattttgatatattagtaatacaatcgaatatccaaggctgctcctacacaaaaaacaagccagtgataaaatccttcttcttattattttttatcttagtgttaaattttttcacaggggctgattttatgtttctaataaacaattcttttgactttatgagcaacgtaacaacactagttgattttgttggcattgtaggtgcggtaggctctgccttgagtatttgaataaaaactatcttttatctagacttgtccagctctctccaacatttcaaagagattgtgcctgcctcaattagtttggcattgtagtcttcaacctctttctttgtgctggccaatttatcaaaagctactcgccaacaccattatgaaatttgataaaagatttaatcctcaagccatcaaaacaaacatctaaaattagtctattgcctgaagtgccatcaattttgctaaacgcagcttctttattgtaccagcataaagcacctcttcaatggattcattggtaaagtactcagtttccttggttgctacataggttttcatttcttcctcttactacgtttaaaatcacgatttcatcttcggtcctagtgatcttaagtcctttctctatatatacgcagagtgtatttgagttcgcacagtatttagtgaattgtatttgatatcaataacttcaatattaattgactctgttcttataaatatatttaatagcctatcaatttcaacccattcaccattgcaatatttatcttggaatagcgttattttaatcattgtctaacccttcctttaatgaactgctttcgtctaactttcggaaaacatattaatctgctaacaaatagctcatcgactttatcattgtattcaccatattcaccagagtcccattcaacacctacagaacctcgatttgtcgtccacaatataattcccatttctccattctcaaagaccttacttgctcccttttttgataatcgagtatatttcaacctctttcttaaaataatcacattttaagttaactttaaacggcattatgttgagaatttcacctttaattggtaagctgacaccagatcatacttatccaatgaaggtgaaatcatgaataaaataatcggaatgaccggattaattatctccttacttgtgcaagggttttcagcaagtgattcattgactcataagatcgccatggcttgtctatttttgttcttattggtttataattttaaccatactaaggagttctctaaaaagtctctggcgattataggcgcttcctttattgtgctgatgcttgggatttatcaattgctctcttttactggtgattactttgaaagtcgcggtttaaattttggaattatcctcttacttgaaattgttttagttattgcattagtgactgctgcgctgagtttaattaagcatattgcagaccgcttaaggaaaacacctgatggtaaagagcgttgactctttgcctttttttagctaaccatttctttttatgccgtctttcttgtacaaaatcaaacgcaatatcgacttttgccggctctgttctgtcaatgatgaattgatttcagaatgattcttaattcctcatcattcattggactccgccttaatggactctttttcatttttcaccagaatttcttgatcaattacctttttgacactttacaaaaaatccagtcgcatttctctctttgataagagctctacatttctaatagcaagattgaatattgtttgttaatacactcggccccaacttttgcgtcttagaatttgaaaggcgtacttgcactttaacatttgtcatttcagccgatatgaaatcaatccttccagcccaattagggctctctttctcgggagtcggatatagtttaaaacgccaactgatctcccctgttttggaggcaaatccttcataaccgtcgtagcttccataagaagatggctgaggaaggtggacagcaagaatactcatattcgttctcgcagcacttggcgggtataactgcactttatagattagtgccgcacccttcgcatttttcaatttttgattcaccggttcgagtactgcactacaaggcattggacttgctttcatttgagttggagagacaataacagcagccaataaaggtataaccaaaataaatcgtttcatctaaattccctcacatttttttgttaatttcccttactcccgccttgaatattcattacttttgaatggttagcttcattaaaaaaaaggtgaaaaaggcagtactgaagcaactagcgctgccggtaaagatggaaaatcagcatatgaattagccgttcaacaaggcttctccggaacattagatgagtggcttgcctcactgaaagcaacaggaaattgatcatatccccttctcgaacgagggggcttctatcgcattccacaccaaattgagaaattaagaaaaaacactcttcctaatatattacattatgataaaatattacataatcagtcgaaatactaggagggtgatttttttggagcaattgatctcttcttcaaaggttggcttaaaaatcaatgaatggtacaaatacataagattattcagtgttgcagatgcagaaattctaaagggtgaagttgaacaagaaatagagcatatggaagaagatcaagatttattgttgtactattcgctcatgtgttttcgacatcaattaatgcttgattatcttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacaatacgaatatcttaaagcaataagtttttacaaccgagctgaaaagaagatatctattgtccccgatgaaatagagcgagctgaatttcactacaaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccgcggttaataggttcttctttgtacaatctcggtttatgctcatttacaacaggacatatggagaaggcattggagtattttaaagaaggcgtctcaatttatcaaagtaattctcttcacaattctagccgactgcttgacatacttctaatgttggcaaaaacgcactttaaattattcaacacggttgatggaaaacaggtttgtgaacaaggtcttatgctttcaaaggagttgaacgatgacgtattaggaaaaatgtttgattttcttatgggtttattcgttgagaatgacaaagaacgactttttaaaatcttagattacttagaatcaaaagctatgctttcagatgtggaagacctagcgactgatgcagcaatgtattataatgtaaatgaagaccataaagtagctacagccttttatgagaaagtgctttatgcccgaaaacaaattcagagaggggattgtctttatgaaatttaaatttgcatcggcttttatctttttagttattttacttgggcttgttggacattatcttcttgacggccacaaagtttttaaagaagcccgaagaggccacacagccagtatccatatcgcgcttgatcaccataatgacttctcagcggaacgccgagggcaaaccgcataaatgttttggcactcccgcatagggggtgtttttttatgatctgtgttcacctgtaaagctctatgcaatgctgtccttcatagtaaaacaggtaagccttattcatagctgcaaccaaaaaaagcacaaataaatagtattgctcctctaaacttgtgtggcaatcatacaaaaacacaaaaggaacagacctaaacagtaatggagaagcacttgtcacatctggatattgaccgctcatcaaaaactgtctgctcctaatcatttactttgcagatttattctgcaagtgtgttttttttatataaaagataaggagcgttatatgaaaaagtcttatgttttatatgggatttcaggagttctaattggtgcaatagttatattgttgatcaatgcattctttataaataaaggtgaacactctgtaagtacttctaaaataaatccaaccgaggataaaatcttttttatctattcaaatccactcatcaagaaaagcgtactcatatccacatcacaaggagaaaaattcaataaacgatactttaaggtaccggatataccatatatccagaaaaaaaccccctcttcagacgatatcgtcttgttagctgaacatgaaccatattattacacattaaaaaacaacactattaaagaacataaattatccaatccatttgctttttggtatcaaggagaagatatttctgtaaaagcctataatgtcgataccaatggaaatgaactgaaagtaaatgataaaaagttcaataaaaaatatagcctgactttgcctaccctcgtaaccatgggaggaagcgataataggtatatttacgtcattcaaggaatgtctatgtacgtcattgatagaaacacagaagggattattaaaacgattggattagcttcctatggagatgtatttgatcactctgaaaaatatgttgtagctagctcagaacatgaactaactgtaatcgaaaaaggatcatggaaatcaaaattcataaaatatcctgatgatctcgaacaagcggacgctgtgtattacgacaaaaaaagcggtaaattttacgttacataaattaataaatccgtatacgcctgcttacttgagtacgataaagatttttcttttgaaaaattcgatttaaaatttccgtatatgaatgcaaagtttaaagatcaaaaactttatgtaatttcacaagaggaaaacaaaaaagggattggtggctatatggggatttttgatatccgtactaaaaagaaacttaatgaatttgatttgcctgaagaagaaacaaaagtgcaggactttatggttttagattaaacataaagaataagttgcaaagcaaaagccccttcctgaataaggggctttaattttaaattaaatagatgttttatacgcgttaatggcttgatttctcaaaagcatattatctttcgtaaccattccaagattgtatgcttgtttgatgatatctaacacttgattatcagtttcagttacagctcgtcccccagttattctggacttccagtaatcaaactggtgatttaactctgaactgcttttaaggtttttattatcaactactttgccattctccagcgcttctttgaattcattaaaaccaattgaacattgcgtattcgaactaattcctgcaccttctgtcgctaaactgcaaaacgctaaaaatttcggatctttcgtgatattgtaagagttatttagaccttccataacattcatcctctctcgaattttacaacgttgctataaatgattttcatgtttttcccaagaccttcaacttgaatctcatttgaaggaagttcgttcattggaatttcaatgtatttgtcccatcctatcacaactttgttttgtccaagtatagggtcatatttgtatatgttcgcttcacctttgtataacaaatttctcccatcctttgctttaatgacggtcgaatttgtatagcccataaagcgaactttaatatgcagcttgtcacctttcaaaacatttgttgcatttggcttgctgcttgtaacaggctcccatacaaagtcgtttccatccgatgtgacggaaagaatctgaagactgtaaagcggtgttgcttcaattgcttttgctttcgatgtgctaatggaaaacatcgttgtaacagcaagaagtgtaattgttactaaactaagtacttttttcaatcccttaacctccttggtattatttcacatgttatttatcggtaattccagccgattatttaactcaaattcaaaaaagaacctgattctaacatggttcttttcgcataggtaactgaatgggtttttaacgacatataaatgattcctgtacattaagtatgctcacttaagggaatcttggagtcttggagtcttgctcaccccctatagaaagggggtgatgcttatgtcaacatttcaggcattaatgtgaatgcttgcatttgggtcgtttataatcgccctgttgacgtatataaataaaaaatagacctcccttgagcctgataacctgaagggttaggtctatcatgaataacataacatctgagcaagccctttgatgggttgcgaccaacaccatgctctttttattttatgcatttcttgttaaagaaatacactataaccagtctgtattttacagattgattataacagattaaatgaaaccattggaatggtttgcaaaacttttgtttattggataaaatcattattgtatttggagccgataagcatctttaatgtatcaatgcgctttattactttccaaatacttctcatgttgtctttctaaaaccttaatatcctttttaatgatctcaactttatattcttctttaacttccttagataagttatcgtttagatagcgtcgtaattcttcttcattttttgttttatccataccaattgatatgactgggtctgtttctccaattccaaggctaaataagccaaattcatcccatgcactttctaatacttcctcagtggatttttgatttttaaaagaatgtgtaactgcgccatacatgaacacagaaaaacaaacaatgatcaagaccccaattaatttctttttcattgtctcctcctttcatttcaagaataccataaaatacaatacatggaaaaataattcctcagccaacagtatcctagttcattacgggttggttttgagaggataaatgctaatccgtatcttaataacgatctaattagattagcttaagttaccgtctatcatcgtttgtgaaagtaacctcccacacattcaccataattctcgggaattttattttaatactttaaggagttttacatattcatcttcacaccaagaaataatacggttgtaaagcccttcttttcatatagatgtcttgcgtttaagttatctgtatctacaccgaatgttatttcctcaaatccaagttgtttagcataatcaatcaaataatcaacaataataccgcctatcccgcaatttcaatatccttctttaacaatcatacgagacagataaatgcgtttatccggaatggtataatctgggtcattgttttgaaaaactaacgatccttctcctataaactcgtcattcactgagtaaataaaagtaattctgtttccgcttactaattcgtcataaaacaccttagccattttctttttcttttccatgtcccaaatattattacacttatggtattcttcgggttttaatttctttacttggtacgaatccataacctctctccctttttataattagtttctatcgaaaataaaaaagctctctttctgagagcttaactttgcaatacttttcctaacaataaaagctaattgtccttaccaaagagcaattttgcaaagtcattgtctaaaacctcaatttccacatcactgtcattattatcagtttcaattggttcatctactaaacttagaataaactcttcaaaagagttggcaataaggaaaaagtctttatcggggtgacttaattcatgatcccaaaacaatatcttttcattatcgatatccatgcatatttcattcccacctgccgagcttgctataggaataatgttcctgggaaagcgatcagaataagtattgattgcttcttggagactgttatgatcgttagctaaaccatagaagctctctattaattgtgtatcatcttcctgacccatccaaggatctttctctataggtttgtagcaaacgtcatactcaacctcatctgttgtttttttactttctaaataacagcctccatatcccttcaaaaaatccttatagtcggaaggcaattgattacctatatttctttcaatttctttgagctgctcgtttgtattaatgctaggatctgtgccagcattaatcgtaaactctttcaacttttgtttgatcttagtgaagctcattttaatactccttcatatgctatggaaaaacagatatagaccttctttttagttttaatcgtcccagtcctcatcatcgatccagtcgtctttcgattcttcaagctcttctattaaaaactcttggaatgtcctagcaacttgtttaccatatccctcttggttatcccaaagaatgactgggcattctccatctatcatcttgttagtgtcaagacaataagaaaattcatctacatattcgatcactacaagaccatcggaaaggttataatattttttatattcattggtctgctcgacaacttcagcgccgtgagagtcatatccgagaatcattgttccgtatgctccccctgaaccatactcagttaaaaaccatttatagctgtctggaagagttacattgagctcctcttctatttctctaatctgatcttcagtgactccccccgtgagaattgaattttctttattttcatcaaagaaagtttttattttcgaataatccattaaactttcacctcttattcttgattctcaaattgctgagctctccatctccaataccttcttctgaaacttttatattgtttatcaagcacaggatcatttctaaaactctgtccattcccttttaatccatgcaaaacatcactgtacttattatgccagctttcaggtatctccagcatagtaccaggctcttcttgaattaagtgatgtaaatttatttgcgtgccatctttagcaaacggagcattaccatttttcatcagttgaagattcgtaaagcctttacgatttttttgattaaggtcaatatctttcattgtgtatactctacggcttacatctctaggctctcctttaacttttaccttgccgtctatttcataggcctcatacttctctttatttaaccaagggacatttactttctgaccagtaaatggctttctgctttcatccaatttctttgcactggacaaaagtccatttttaaggttttggctgttaaccacattgtatggtacgttatcagccagagcaagatcatacttagtgttataaggaagcaaatctgaaatcttaatgtccttaattttctgacctgcctgtcctgccttgtttatgaccttccccgccgcatcagctttgttaacggctcctgcgccttttgttccgacgacagccacagccactgaaccgaccgcatatgtcacccatcttgatctggagtaagcattcccgttcaccatatctttttgatacgattcctcaatagctgttgaaatggcattatacgtgttaattggatgggcaactgcccctatgataccttcaacaacttcatcaggcttactgatcagctgccataaaccggttaccgtgtctttcccgacaccataaagaccgacgccggctccttttaaaatatcccaagtcacttctccggcttcttccatctgttttgcttgttcaagctgcattacatattccacctgagcgggttcaaggttttcatagccgatcttctttgcgatttccaaatactcatccggatcggtgacaccatcagccagctttttcttcagatccttgatttctcgctctttcgcttcttccttcttaaacgttaaatatgtgtctgagtgtcttgcaatctcgccttttttcttatgtatgtcactttctctgtacgccttggcgttatagtgaagtggtgttgcatttttccctttacctgtagcattttggagctgctgaaagtcagcctgaatgaaatgttcatttgcctcggtttctgcgtattctttcgttagatcgtgatcaagcttgccgagcttatgtacagtatcgtcccgttttttgtctgctgattccagcttttgatcgacatcttctgtagagaaaacatcaagatgaatgatatcgctgatttcatcaaggatacctttcatttcattctgctgctcctgcatgatggcttgtgatttattcttcgcatgaatcagctcatgttctaaaaacgattcttccacaaacgaatcggctagtcccgcatcagttacttttcctgagatactgttaagaaaagcaatcttcatatcgatcagatcaagccagctgtctgtaacaccagcgtgatcttggaagaatgctttgatgttatcagcacctttacctgaaaactcgctgtcatctaaatcagccattccctgaaaagctttcctgagattgataaattgttctctaacctgatcatattcttttgcccgcttttccgctgctgaaatgaacgaggatgcttcaaatactttcatttacgtctcctttctgcttctttctgtctaaattttaccatagctttattatttgattaacagaaaaagacagtccgttccgactgtcatacacagttttatctcgtcctgtaataattttcagctgtatagtatttccagtcccaaaagcatccccgttcgacataatatatcggtctaaaaatatttcaaagtttaaatttaatggattatattctgaaccactttcaaatataaatagataattaggatcaccttgattcactctatccttgtcgatcattaaatgacattcttccaacaggtagccaacaggtattccattgataccttcaaacaaaagttcgtattttagttcttcttctatttcttcaaggctaaatagatgaagtcctcctccaatattctcaccctctgaaagaatttcgaaaattttcgcaccattatgctgagaaataaacttcaggtaatcatcaggaagagtgaatttatgattcgactgaaagttttggatttcactaagagacgctttgtttggagaaaaattcacaaggctctctacaatatatccctcagaacaaaacaatttaatagcccctttttcatctaaaagacttttcaaaccattgatagtcttatggacaaagttagtcaataaaaacacccccatactcctcagaataattactgaggatacgaatttgttaatcagtaacaattttattcataattgaagcagcacttgtggtgaacaaaatgtaagtgttatttgctgttttaattactatcctatccgtagagccagtttgaagtcctctgaggcttcttttttatttggtacattcaatctaaacaaaaaaccacagagcgtgtgagggactctgtggcctatagtggctgattaaacccctatgatacatcaattaggattttatcaaaacttttcttttaaagataacatcatctctgtctcaaataatgcctgcagcagctcatctatattaatttctttctgcttgtaattattcttttcataagtacgaataatttcttcatattctgatcgattatctcctttaatggagctaattccaagctcttcaccgtatcggttaatgaatagttgtttattcatttctttcgctttatcattttcataattacaaaatgcacctgacaactggacgagaaaagtttcatcttcagaatttaggttattctcgtattcaatgtcagacagaatattgtacgaatacttctgtttttacagtaaatacaataaagaggaggtgctgtttttttggagttaaaaaacatcgttcattcttacaacattacaaatattttgggttatctcagacgctctcgtcaggatatggagcgggaaaaaagaacaggcgaagatacgctaacagaacaaaatgaactcatgaataaaatactgaagtcgattgaaatcccctatgaattaaaaatggaaatcggatctggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagtaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttcaggactagcgccttatggataccggttaaacaaaaaaacatccaaactagtcccagtcgaagaaaaagcaaaagtcgttcaattcatctttaacatctttttaaatgggttgaatggaaaagaagttagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaagaacaaaagacggcaaacgaacaattagacctgaaaaggaacaaattgtagtatcggatgcacatgcccctataatagatcaagaacaatttcaacaatcacaagagaaaattgcaaacaaaatccccctgctgcctaataaaaacgcattggaattaagtgaattggcaggcgtatgcacttgttctaagtgcggtgaaccattatctaaatacgaaactagacgaacgcgagaaaacaaaaacggcacggaaagtgtgtatcacgttaaatcacttacttgcaaaaagaataaatgcacttatgtgagatataacgatgttgaaaatgccattctggattacctctcttctttaagcaacttagataataagactttaacaaaacatatcatttcaatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagagctccagattgccaagcatgaactcaatggaactcaagaagcgcaatcagaaatagacagtaatacagtcagaaacaacataaataagataattgatcaatatcacattgaaacaagcacagaaaaaaagaactcgctattaagaatggtcttcaaagaagttatcgttacgatgacacaaaaaagaaaagggccaattccggctcagtttgaaatcacccctatcctgaggtttaatttttcgctttcgatctcaccgccactgatagttcctcaaaatgcagtaaatgtcttaaaaaaccgataaagccgtttccccggtaaacacaatgggagctacgaagctgttgtccgagaagctgtttcatcaggcgaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgatcgatgacgccgcaacgctcaccctgcaatctgcggcgattacaaagggcggagaaacgtttatttttaaaatggagtccctgaggcttgaagaactgcttcacgggtttgaagaatatgcgttccggcacggactgccgcggccagccgctgttgaagtgggaaaacgccccggtgagaagcttcatgaagaactgacctctcctcatgaaacggaatctttatatgaatggggcaatctttacgcgatattgccggatcccgccaaacatccggaatttcggaaggtcaatctccccagatatcaatccgatcaggcgccgctcatcacaaaagacacaatcgtaaagattattgaacgattacatgaagaaaaaaaaacatagaaaaaaggcctgtctgataggcaggcctcattgctgagctctatttttcaaataaatgcaggcaggcttcatagccctcttccttcagcttgtctttcggaataaaccggagtgccgcagagttaatgcaataacggagaccgcttggccccgggccgtcattaaatacgtggcctaagtgggagtccgctgttttgcttctcacttccgtccggatcatcccgtggcttgtgtccagtttttcgtcaacctcttcttcctcaatcggttttgtaaaactgggccagccgcaatgagaatcgaatttatccagagatgtaaacaagggctttcctgatacgatatcaacatacagcccctcttctttgtgatcccagaattcattttgaaacggcggctccgttccgttattttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttcttcaagctgtttttttgaggcttcagcgatttgtttttgttcatcattatggtaatatatcgccgcccgatatgaacttccgcggtctgcaaactggccgcctgcatcagtcgggtcgatctgctgccaaaacagctcgacaagcttatcatacggataaatgtcaggttgaaatgtgatttgaacggcttctctgtgtccggtcgtttcactgcacacttcttcgtaagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctttcaggggaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaatttgcccccattcttgaggtctccgcaagccacattaccgcagtgaccgatgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcaacgttaatcaaactgttcagcaagctagacaaaaaacgctgacacgaaaaaacacaaatccctgaaaggatctgtgttttttttatgaaaacttattgtttcggatgataataggaaaattcaatttcatccgtgtcgagattgattttatccgcttttacatacatgccgttgtctaaaggcatttctgacagacggatctcgatgcttttatccccggaatgaacgtgcacaaatgacgggagttcataaaagctgtccatataattcagcacaaagctgatcggcaggcttaattcgcctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgttctcccggcataaccaataatgtcacaattaccgcggcggcaatcacattgagtgcgagaagaacaaaaaacagcgatttccattttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtgaggatctttttccagctcttttgcggcgatcttgttccaatccgtcacaaccccattaatttcttttaattcaggcagcgtaaacgtgaatggattatacatgctgacatacaccagctctgcgttttcattatatttgcggatttttgaaatgatcgtcttgaaccgtttttcaaaaggtttctcttccttttggaacggctgaaccgtcagctgcatcatattctggcggagcaccttcattaagtcattgccgccgatggtaaaaaagatatagtcggcgctccttaatgatttctgcacttttttattatcaagctttttcagcaggtctgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgacaggatatcatcatacggaaccttctgcacgccgtcataatctttaagcaccttgccgtcaggtccgactaaataaaaagaagtttgatgtatgacctggtcctctccctccggctttttgacgattgctttaaagctgttcatcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgtcttggttctgatatgaaaacggctcaatctgatagttcagcgggtcttttatcgttttccccccgcaggcgcacaagagcagcaaacaaaagacggcagcgaagcttttcatttttttcatttccattccccccatagataaaacgcttacagcattcgtcataaaaaaattcccgcaccctcccttatcaaaaggaaggcgctaaggaatgtgcaccgttatgcgttatgttttaaaatctcttggctgaaaacggcctcataatctttccacttcatacggcgcttgacatattgtcggaatgaatacactgttcccacactttgtgaagcaaaaacttctttcaaataaagctcaaggtgctgatgaatttgaaaagtatattgttcaccttccgtgacaaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatggcgcattgattatataattcaagaatcgtgctgcacacttttccttccgggacaagcaaaacgtcatcgacgacggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgatcccggacaggagtcctcccccccctacgcttgcaaaaagaaaatgcggttcgacgtcaatgtcatttaaaatttcgatggcagccgttccctgtccggccatgacatcgggatcgtcaaacggatgaataaacgtgcggttttctttttcacagcattccgcagaactcttatacgcatcatcgaaagtgtcacccgtcaatatgatttcaacaaattcttttccgaacagttccacttgggatactttttgtctcggtgtggttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgactacctgcaggtcttctcttttcaaatagatattgcagccatacctctcagaaagtctgtcattcctctgcaaaggcgtatgtatcacaacgtcctttacgttttggtgcgcttttaaaatgtcttttacctggatgagagagtcttctttaagcaacggtttcatttacagagtcctttcttatttaaatccctatttaatatgccattataacatgaatattcaaacaataagataattattttaattttgtaaataaaaataaatgaaccgatacaagagaaaaagatattttcgatcgcataaacgtgttatacttaaaccaattagaaccaaaaggagccaatttatgagtgtaattgaacaaactgatcctttttatcagctagccggcgaacatcacaccttttcagaagcgaaacgattggcctcgcaatttgccttatctgatttgccggtcttcataacgggtgaagtcggaaccggaaaaaaacaaatggccagagcgatccatcataaatcccgcagaaacagcgaactatttattaccgttcactgcagtcaaagcgaagagcggctcgaatatgaactgttcggcgctgaaggcgcattaaacagggcccgccgcggaacattattcttatatgaaatcggagacatgccgctctcggtacaggcccgccttctttccgagctggacgccgggctttccgcccgcatcattgcaagcagcacggcgaatcttggcgataccggcgcggaaaacacgttcagcatagatttattttacaggcttcacgtgttatgccttccgctccctgctttatctgaacgaaaaagcgatataccgcttcttctgcagcatatgctgacagcctcggggcagcatgttcatatcgatccgtccgtttatccgctgtttgagcggcacacctttaacggcaacatcagagaacttgaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaaaggcgaacccgccagcagacggagcatatccgaattaagcgaaaacagcacaatgacattaacgccccagcaagtcagaaacaggcttgattacttagaaaagatgaactatgtgacaaaaggccggggacgcgcaggaacaaaaatcacattagaagggttgacctttttgcagtcactgcaaaaacaaatcctttaaaaaggaggacatttgattgtttacaataaaagaagaaatcgcaaatgccgtcacacacggaatcggtgtattgctgtcgattccggcgcttatttttctcattatctttgcggtgaaatacggctcgccgacagacatcgtcagcttttccatattcggcgcttcaatgctcctgctgtatctcagctcgactcttttgcacagcatccagcataaaaaaacgaaagacattcttgaaattgtggatcattccgcgatatacgtattaatagccggaacatatacgccatttttattaggaccccttaaaggggcgctcggtctgacccttttaattattgtttggtcgcttgccatcggaggcatcgtgtttaaaatcttttttgtgaagcggtttatcattttttcaacgcttgtctatttaatgatgggctggctgatcatcatcgccattaaaccgctgtacgcttcgctgtcaggtcccggtttcggccttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatgtcagccggtttcagccgtttcaataacctgccccgcagcagccggtctgttcccgaagtgctgacgggcacaatcgggagatcgaaacgaagggccagttcctccggattgattttgccgtcttcggacagaatcagactttgccctttttgcagccggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcaagcagcagaagatcagccgggcgcaatctgggatgcacatacaatacggggccgtccggtatcggctgatcatgatgaatgccgattgccgatcccgacacgtcaatgcagcctctcataaaggctttcggccgctcatacaccagcctcatctgtttttgaaaagagagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaagggtttttttcatcttttactccctgtttgcgggaggtcaattcccattcagcttcattaaattccggaaaaaaacggtctccttcaaagacatggtgaatttttgtcatgtaaagtctgtccgcatagggaaagagcgcactgtacagctgggcgccgccgattacaaagcattcttcatccgccgggatcaacttgagcacttcctcagccgagtcggcggtaatacagcccgggaatgaagattcgtcccgcgaggttacaacgatgttccgccggttcggaagcgggcgtccgattgattcaaacgttttgcgccccattacaatggtgtgacccgtcgtcacttttttgaaatatgcgagatcatcgggaaggtgccaaggcagatcgttatcttttccgatcagccggttttcatccatcgcaaaaataaacgaaatcatacgctgacagctccttttatgtgcggatgcgggtcataatcctcaatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagtcccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcagggcggaagcgccatatgatcaatttcgccgacattccaggcgctgacgattaaacgtctggaattcgggtttgtcttgatgtcatgaatcagccgggagatttgatcaatggtctcgccgtccgctccgcgccatgaacgccattgagagccgtaaaccggtccgagttctccgttttcatccgcccattcgttccagatgcggactccgttttcctgaaggtagcggacattcgtatctccttttaagaaccaaagcagctcatgcgcgatggatttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcagtttttccggccgacggtttactggaaataaccacatcctgatacgcttcatcatcttgaaacttggctaaatgtcctgtgatgacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccgtcagggcatgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcgcggcgtcatgtccggcaccgtattatcatgcaatatgggaaattggtaactgtgaccgagtggataaaccgcttacaataagaaggagaaaaaggaggggatgagatgattaacgctttatttgcgactgtatcacttctcacgctgctttattttgtcgttatggaaatcactgattaacgaaaaagaagcccatgatatcatgagcttacatggatgacaccgaagtggaaaagcgccgtctttcttttcagcaccttgaagccgtatcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatctaccgatgaatcaggaagctcccgcaaataatcggcgcagtcggcatgtttaacctgaatgcgtttcatggcggtttggagctgctccattccggtttcccacgtttgaagtcctgtttctacaagcaatgagacaagctcgtttttctccaggcccatgacttgtccgctttttccgactgccaggcttgccaaaatcgcatcggatgccaggccgagcgtacaatctaaaaaggaatccccctctcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgatgactaaaagatcgctagcggctcgttccagcattttttcaatgggctgtttattgcggctgcagtaagtgtcacccagcctgacactgagtgactgcgctgtgtgtatcgtgtattcgcttggtctgtaactcgttgtgatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagcgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcgagaccggctgcacagccgcacacggagttgacaacgaccaatgtcgtgccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaatccttatatgaagtcaaggatactatagagggggccggaattcaattgttcaggcctctgttttatattttcatgattccgcctgtattggcgcttgttacgagtttggaataccgggccagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccatcccgacaatctgagacgtcggagcaagcatctccggcatgcccggtccgccctttggcccttcataacggataatgacaacatctccttcttttactttgcggtttataatgccttcaagcgcggcatcctgggaatcaaagacgacagcggggccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctccgagtgtgcggcctgttacagtcagcgcgtcaagatgaagcgccccttcttttttcgccaattcattaagggccgccgagactcctcccgcttcgtgcagatcttcaatgaagacgtccgaggccggcgccaatttcgataagtgaggcacccgttcagccacttcgttaatgcgttctaaagagtactcaaccccagcttcattggcaagcgcaagcgtatgtagcactgtgttggttgaaccgccgagagccatgtctaacgcaaaggcgttgtcaatcgctttttcggtgacaatatcgcgcggcttaatgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcgggcagccgaactgttccagctcctgcaggtcgctttcaccgattttcccggcttgatatgcgccgacgccttcaaatactgaagaaagcgaaattttgcggccgtcgcttgtgcggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagtgaatatctcatgccgatatgccccatcgcgattccgtcatctactccgatcgtgttaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatccccctactgtttttagactgtgcaatatttttaaaattttcagtttattctagggcgcgttctgcaaattacctgtttaacagcgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttatcactgttctttttttctgctttcagtcatctgtttccagactgaacctttcgcctcttctccgtgctcaatccgttcaatcgccattttgacttgcaggctgacttcgaattccggatcgtcttccgccgcttttaatgcttccagcgcgctttcatcgccgacttcatataaaaacatggccgcgcgccagcgcacgagcttgcttgagtcactgagcgatttcatcatagccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttccaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacaccctttactccttcaatgtttaaaatatcacgtacgacggccggagcatcatctgcctgatcaggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaaccggctcccgcttttgtattcattaagcctttaagcttgattaatttatcctctatatgggccagcacacttgtttgagttccgtacatcgggtgacccttcgccccggcaaacataaaagccctgccgatgcccgctgcgccgatcgcatcaagcatgtctgcatcctgaacaactttcccctccaatgaaagcggccgctttatcaggagttccctgtgtctgaatgacattctcgtgatgatatccgcgatctcctcaatggagccagccgcaatgttgaaagcagccagccgttctgtcacttcgcctgccgtcagcctttcgcttttttcgagcttggcgtcaatcagatcatgaaccagcgcggccgtctcagtgataaataagtcggcgccttcttcttttgccatataaacagaaagtgttgcgacccgggaaatatgaagccagtcatggcccgtacgttcattgataagcttttctctgacccaattcctgacgctttccagctgctctttttcgttcaccgtatcaccttttatcgggccaaaagcctctgcaccgtatcttcaagctcttttgggttgacgttcggtgaaaaacgcccgttgacttcaccgtttcggtccacgataaacttagtgaaattccatttgaccgcttttgtgccgagcatccccttcgcctgtcccgtcagatatttgaagagaggatgagcgtctgccccattgacatcaactttcgcaaacatcgggaatgtgactccgtagtttttcacacagaactcttgaatttccgcttcgtttccaggttcttggttcatgaattggttgcatggaaatcccaatatttcaagaccttcctcccgatatgtatcatagagctcctgaagctgcttgagctgggatgtgaacccgcatttgcttgctgtattcacaatgatgatcaccttgcctctgtaagccgatagcgtcaagtcttcgcctgttatggtccgtacgtttatatcgtaaattgtcatctgcggccctcctttttacattcttcatttattttacctgttttacactgcaaaacaaacggtaaccgctttttccttccacttaacggaaaacgtttttttcgaggaaccaaacggctctttacccgtcataataaaagagccgctccgaatttatacccatttgccgcttttatccctgtcattatgcgttaaatgcggtttattacgccgggatggattgaaaaatagcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgtttttaattccgagcacacatactccaaaaaatacggcaaggcagcatctggatgaattttatacggatttttccagcatccgccacaaacggtttgacggaatgattattaccggggctccgattgagcacctgccgtttgaagatgtttcttactgggaagaattgaaggaaatcatggaatggagcaaaacgaacgtcacttcaacactccatatctgctggggcgctcaagccggtttatactatcattacggcattgagaaagtggagctgccgaaaaaaatcttcggtgtgtttgagcataccgttcttaaaaaacatgagagattggtaagaggatttgacgagctatactatgtgccacactcacggcatacagatattaatacggagcagctgcaatcggcttcggatctggatgtgctcagcgtttcagaggaagcgggggtctgtttaatcgtttcaaaagacgaaaaacagattttcttaacgggtcatccggaatatgataccgatacgctgcttcaggagtataagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaactccgtatgaatgggattaatttttgttttaagtgatacggtgacaaaaatatgataaaatactcttgattcagtatgcgtataacaaaactttaaaataatggaacatatcaattaaatttagtttaaatatgttggcgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatcccgacgttcaacgttatgaccgatttctgccttcacaaaatctgggttcatgaaaatgttgataaatattatgtcgccacagattacgtaaaggaaaaactgattgaaatcggcactcacccgaacaacgtaaagatcacaggcattcccatcaggcctcaattcgaggaatcgatgccgaaagagccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggttatgtagaaagaattgacgagctgttccgtattacggactgcatgatcacaaaaccaggcggcatcacactgacggaagcgacagcgatcggcgtacccgttattttgtacaaaccggttcccggacaggaaaaggaaaacgccattttctttgaagatcgcggtgcggctgtcgtggtcaaccgccacgaagaaattttagagtctgtcacctcccttcttgcggatgaggagaagctgaaccggatgaagagcaatattaaaagccttcacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttacagcgctgctcgatttcttcaatttgtttctccattgacggcattccttttttcgccatttccgctaaacttcccaaatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaatctccaaactatttgcggaggtgttttttaatggactctgaattttttccaaacggactgacggataaacgccagcttgaattagcggtggaaacggcccagaaaacaacgggagcggctacccggggccaaagttcaactttggtggagtctgcttaccaggcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatgcagaaagaatgagcgtgcgtttttccaaactctttgcggaaatgcttttttacgaaacagcctttgcaatattcatcctgaagctctgtcaattctttataaatgctttttttatccaatatcagtcatctccgttaccttctaatgttatgcggctttcaatctgccggtccgagagaatttttctggcaaggtcatccgcttcttgattttcctttcggtttacggcttcatatgtcggtgtcagctttaaggattcgagcagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtccggcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgtcttttatataaggaaagcggctgacttctcttgcaagcatgcgcgctttcggaacggtcagccaatcttcggaaaaaaacgcgacagggcctgttccttttgcttctatttcgatatacggcttaagattcattgaaatcaccttaccattcattagttgacgggcgtgtgctataatcaaaccattctcaaattgaaaggaagtcagcaggttttgtttaacgatgtgttatggatcttatttgcggtcattcattttatcattgttcttctgttttataaaggatttggcaaaacgggcctattcgtatggatcggtttcgccacggtgtgcgccaacttgcaggttgtcaaaacagttgagctgttcgggcttacggcgacactgggaaatatcatgtacggcaccgttttcttcgcaacggatgtgctgaacgaaaaatacggtccccgggaagcgcgcaaagccgtctggctcggcttttccactttgctcgctttgacatgcgccatgcagggggctcttttatataaaccggctgcgtcagatatcgcgcagcctgcccttgagacgattttcggttttctgccgcgtgttgcactcggaagcctcttggcttttattttcagccaaacgatagatgtttatgtatattcagccattcggagaatctttccttcagacaggcttctctggctcagaaacagcggaagcacggcgctcagccagctgctggatacatttatcttcactgccgtggcctttatcggcgtttattccgcgggcgtatggttcagcatctttatttcgacttacctgattaaatttgcggtatcactcatttctgtcccttatgcgtatgcggcaaaacgaatgacaccgaagggagagtgacggatgatgcctgctgaaatttacgtggacggtgcaagcgccggaaacccgggcccctccggtatcggtatttttattaaacatgacgggaaaacagaatctttctcaattccgatcggcgaccattcaaatcaggaagctgagtttctcgctttaattgaaggaatgaagctgtgtgccgcccgcggatttgagtccgtgtcattccggacggattcagatatcgtggagcgggccgcggaacttgaagcggttaaaaacaaggctttccagccgtttgtggatgaaatcatccgcttaaaggccggatttccattgtttttcattaagtggattcccggcagacaaaaccaaacagccgatcagctcgcaaaaaaagcggtccggctgaataaataaccggaatgaaattgcgtttcactgttcatcctacaaatgaggtgaacagctatgagaaaagaaaataaaggccggctgaccgggggcgtgaatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaatcgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaacccccgtttcttctctgaatatctcatctgtatataccttataattgccgatacccttttgcagcagcgctacctgaacttgatgattcagcaattgaagcagatctttatcacccgttacaatcgtaatttccgcttctccggaaaatagggcagaaagcgtaccgatacagtcatccgcctcatagccttttatgccgatgtttaaaaaaccgagctctcgcgctgcttctttcgctaaatcaaattgcggaatcagctcaagcggcggttcgcttctgttggccttataatcttgaaacaaatcattgcggtacgttttgcttcccatatcccagcagcagacgacatgtgtgggctgaaacgtatcaaccgccgtaatgagatgctttaaaaaaccgttgacgccgtttgtcgggattccgttttcatttatcataaaattgcgatgaacggccgtcgcgaaaaacgagcggaacaaaagcgccatgccgtccacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataagaatcaaatttctgtccgaaaccgtttttctttttggcattgttattctgctgagcatttctgtttcccagttttgttctgcccattgtcatatccccccttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtaatgccattgatggcatctgtcgtgaacggttcattctgtctgcattttacaatggcttcttcaatggcctgttcacgctggtagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcttcgtaaaggtgttcaatttcccttgcacttgtattttccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttccgtcactttttgcaggctgagcctgagcccttctacaaacgctgcttttccgttctgttcaaaaaactgcttcggcgatttaacttcttttatgtgatgtgtgaatgccgagacgtcaatgaccggagcgacctctttcagctgaacggcaaattcgttttcggcgctcacataaatggagaaatctccatcttccataagtttcttctgacagttttccatccattcctcagtcatatggcgctcaataaaaccggtcatccggatatcgagcgttttcagctcttgaatatattcaaaacggaattctttgagcgcttcattcagcgccgctgctatattttgtttccaatcgccgttttgaaggcccggatggaaggcggttttcagcatatcattcgcataaaacgtcaggcgatgtttaatgtgatagagctgttcttccgtatctttcatcacttttcgaatgatgacctcagacgtacggcgctttgaaatgtcagcgagagctttttcataggaagactccagacgctgtttctttttctctttttcttctgccgactggtgaagagattcgtgaagctgttccaccatatcgcacaatttgtccgcctctgttttcagctgggcgcagctggccctcattacatcttcctcaataaagtgctcaagtccggttcttacatcagagaacctgttataaaaagctgcttttttacccgcaagctcttctttacttgagacatgatataatttcggccggttaattccctcttttgagagttctgagcggacatagtctttgacggtttccagctcgctttcggttttggccagatcggcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaattgtgatgcctttttgcgtgagaggcgaatcataatacacggtaacttcttttacgcagcaggccgttttttcttcggcagcatacggttttaaatcttccaccggcaccgtcagtgtctgcctttgacggatctgttcttcatacgtatcaaacgcctgcagcatcgtctgaatcaccgggataagttcatccggaactttcccctttttaatggcataattccatctctctttcagtgaacgcccctttacatcagcgtctttcagctcagtcagctgaagcatttcagcgtccagatcctcctccgtcttaaaaacgatctccgcagttttatgcggtttgccggcttgcggtttcgttattttgttaatcgtagccgttgtgggcgtcggtgatgacggaagcacgtattcaccgacaagcgcatttgcaaatgatgatttaccggaactgaatccgccgaataacgccaaggtaaactggcggttttcaagccgctcaatcctgcttcgaaaggcttctgcctgttttcctaatatgctcgaggattcaagaatcccggcaagctcatagaaccgatcagtctgctcttttataggaagttccttcatcgcatttttttcgggtttgtttacttcatactgtacagtctcttttggtttctctttttgaacgggcgcttttgcaaggcgtttttttcgcgtataccattcgccgcttcccgtatcacaggtcaattcttcttcccacaaagcgcggacccgggctgctttttccaaggcattgcgttcttcttttgccgattgcgcgagctcatcccttatcttcttttctttttcgagccggtttttcaagttctcaatgagcggtccgttttttgcctgaacataagcggtcagctcctcaatgagttccgctgtctgtcttttggcttcccttctgatcatctcagcgaggtctttcgtataagttaatacgtattcagatgaaaaggccgctccctgcttaagggcctgagcggtgatatcatcagaaagcggtgtgcggtacgcctggattttcttgatcagttcgtccgaatccgcttcataccgcttggccgctttcgtaaatgtgtcgataatgtgccaatccgcttccccttccgttctttttttaatatcggcaaaaaactcagcatgccttctttctttttccgatgctgttttcgcttttgaaaagaataatccggttttaaatgagggctgctgtgattcaatataagcagatgcaagctccctcatctcaaagggtgtcaaattagcgttttgcaatatgttctgcacgtcttttctgatgtctttctctgctgtttcagcctgttgaacggctttattaagttcatcttcaacagaacggacaagtgcttcttgtttgtcaaactgctctccgcttccgtttttatcatcttttacgagcatctctgtatgctctttgactaagtgtgcgacttttctctccgttaaggaccataaatttgtttttgcctgctgtttcagcttctgcagatgttttttcagctgttccatgccgtttaaaggatggtcaggctcagtgacagacgtaaagaaaagcgattctttcggtattcccgcgccttcaagcatatcttccacctgcctgcggtactcttcaaacttcgtttcagtttcatcatgcctgtcaatttggttgacgatcagaaacaaattcggaatacggtctttgatggagctgagaaacagcatattttcttctgaatgaacgtgattataatgaacgacgtaaaataaagcgtcagcctgatggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttctgcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggccgcgagctgatcggcccgtttttcatcctggtgatccaaaaattgtacgtataaggcacccgttctgctgaaaatctccctgttatggcgttcttcttctgtcatgtgtctttacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatcctcacagtgagcatgcaggcattgagaatcgaaaagagaaacagtgtccaatacgctccgtataacagcggcagaaaaataaattctaagatgacgaccgcgtagttcgggtgcttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagggataatgtccttctccgtattcgactgcgccttgctttttcaccttctgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacatgaaaaatagttgcggaagacatgttcccatgtttttgcagcaccttccgagatgcctcaagctgaccgatgtccattgaaagactcgttaaataggcgtcaatgacctttttcccgcctggatgggcaagaaaggttttaatgtcgtgaggaccgacaccatattctattaaaaattcatcaacattgtccttcagccactgtgaaaccagggtgggaatatctcttgaaaaaatgacttgaaaaccgctgtcggtgaattcccagcccatcacatcttccgcatccggcatcatcaccgattgagtggcgaatatccgcggaagaagcggctgtttgacgccgtttcggttcgccttttctcctccgactagtactgcggcaattccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccaaatcggtatccgttttgttttcgcagaaaacggcagctgattcatcactttcgcttcaatgctgggtgtcgaaagcccggtgctggaaataaaaaagatcgcatccactttttcataaggaaagggatttgttaaacaatccgggtttgttaaacaatcaagtgccgcatccgcactgtgcttaacggtttcttccgtatacagccggttcttttctgaaaaaccccgcgccgttttataccattcaatcggccggacaaactgccttgattcaatttcgccgttttgaaaggcttttaacagccggtcaatatccttaaatgaatcggcaaacatccctctcgcaaaatccgccgccgtttcttgcgagacatgatattccggaatgctggttccgaccgataacacatatgccatgcccatcacctcttcacataaaggtttccgcttttttcctgaatgtatgcataagtttgaatcgaggatttcactgacatgcccttttaatttaaaattggcccttttgaatgataagccgctcgactatacttgatccattcataaaaaaaggttgtgataagaatgctgaagcccgtcattcttaaagggtcactcgttcagttagagccgatgacgattgatcacactcaggcactttgtgaagctgcttcagaaaataggaggacttacgcttacacccatgttcctgacggaatcgaagaaacaaagcgttatattgaacgtgcgctttccgattatgaaaaaggacttgcattgccatttgcagtacggagtcttgaaacagagcgaatcatcggaagcacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgctgaaaaccgatgttcgcaaccagcgctcacgaactgcgattttgcggatcggtgcccaatttgaagggatccgccgcgcgcatattccggctgtcgacggcggcctcagagataccgcctactactccattcttcgggaggaatggccttatatccggcaaaacctttctggccggctcgcagcatataactgaaaaacctgccgatatatacggcaggttttttacatattcggatcatggacgtataaattgagatcgatccgtccgtctgacgtgaccgctacgccctcagcttcaagagacagcttctgtacagaaaacatctcttcatctcttaatccgatttcaccctttgcattgatgaccctgtgccaaggaagacgatgctttttactcatggagtgaagaatcctcacaacctgcctcgctccccgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcatctgcttcctgatcttatttttatagatgataattgcttcatcatcatacttattacatctctgcgtttaaatagattatctgtttgttcacaaaaaattaacaaagataggcatgtacatgtttaacataatatgtaataatacaattgtattaaaaagaaaaggagtgtttgcaatgaaaatgaaaaaagctttagccggctcagccctatctctcgctttactctgttctgccgcccctgcttttgccgcaggtcctgctgatacaccttctgcagaaagcaaaacgaaggaagtatctgttttggcgacgttcatacttaatggttctggccctgattatcctacttcaatttaccggaatggaatcacctattatttagacaacatcaccttccatggtgctgatggcacttggacagccgtctacaaaagctgatttttcatgacggcggaatgattgtcttaagtaacaactaaaaagctgctaatataagggggctttgcccctttttttagtttcactgccttttataattgatccagcatatagcacctaggtgcgtaatttcatttcacccgatgatcattatcagtcgtactgttttctgcttttagacgcaaaaacacataatctaaaattctctcccgcgtgtctatccaaaagccgagtctcaactctatcaatccggaacattttatcgacgcctgagttccccagctaacgttaagaaacctcttacttgctcttttatttttgataaaacaccatccagggtgataacatgagatttgcttgggaagaattaattataattgcattcggaatgattttactgagaatttcagggagaaaatccattgcacaaatgaccatcgcacagacaatggtgatgatttcaatcggtacgattatcgttcacctcattttagaaactagtttattgaaaacattaatcactgcgtctatccttttagtgctttaattttgatggaatggtttcaagtaaaagtaaactggattgaattttttttaacccgaaaatctaaattcgatatagaagacggccaactcaatatagaaaacttaaagaagctgagactgacagcagatcaactcgaaatgcgtctaaggcttcttggcatttcaaaaataaacacaattaaatatgtcactttagaagctaatggacaattagcctacgaattaaaagatgactgtaagcctttaaccatcaaagatcttaaaaatgtgaccgacccaaaaagtcttaacaaagagcctcagccacaaaaagatgatcaagccaatctattcgaggaaatcaaaagacaccagactcagcacaagccaaaaaatcttgaataattcgctgattagtaaaatcttttgttattcaaaaccgaagccgaatcagaccgttaaccgcgccgatcattttttaccagcccgtttttcaagaaacaaaaaaacatctgaagcagatgccttttttcagacgagatccttgtatgcgcctgaatatgcttttcagccgctatacccaccgccggccttagctataatgttaatcagtttgtttttataaaatcattgattaattgatcagtcgttaatattgtggcaaattcgtcatgcaatgtagccagagatatattgtgaatagtctcggcatcataatatgtatcattttggtctttcattccgaaggctgctgtcgcatctgaaatgaggtaggtatcaaaccctaaattaccgctcattcttgtagttgttgaaacacaatggggcgtagtcaaaccagttattacgacagttgttatatcatttgaatttaaaatctcttctagattagtcccgataaagctgctgtttactttcttggttataatgacctctttatccataggtttaacgatttcctttatagcaaccccctcattttttggataaaataaagaaccaggtttatcagaaatatgttgtatgtatatgactgtccatcctttttctctccataatttcagtattttactaatgttttcttccgcttttacgttatttcgttctccccattttttatcatcgaaagctttttgtacatccacaatgattaaagcttttttcttttctgccaccagataacctcctatattgaaaattagtatttataacattttaaataaagtttttacttttgtacaattgtttcagttttaaatttcatatcacacctttcccgttggaaaagcgctggaatagctaaatcaaacactcactcaaaggctgcagctcaccagaggccagcaataatcaactctttttctctatatacatatcagtatcctgaaataagctgcaacagcggatgaaaggattgccccttttgccatccactcccctaaaaaaattcacgctgcgcccacaaaatattaacaaaaaacctcttggttattattgtattttgtgtaataatacaattgtattaaaaaacaaaggagtgtttaaaatgaaattgaaaaaagttttaactggttctgccttgtctctcgctttactcgtttccgcttcccctgcttttgcatccagccctcgcaatacaaatagcgactcaactgaaacaaaaatttcgacacaagcgatcaaagattcttttacaatggattaccttcatagatgggatatcccaaatacaactgttaaaaatggtgttacttattaccttaagaaagtagagataatcgaagggttctatcgcgcaacttttgaaggatggattaattaaaagaaggggcttccccttcttttcactctcttttgtaaggatccgtgcacaagacactccccctcagcgcccattctgcagttgcacttcggcatcaggcatttcattacatgtctaaaccaagtttcgtgtcatcaccgtccgaacaatgatattcgtttatgatatgatcccccattctcctttttttcttacattcagtcatatgttcacgtacatatagttcgggacggtttttcggcgaaataaggcggatgccgcatcactcaatttatttcttttcaaacaatgaaactaataaaaaaagaagatgcctcgcaaaaagttcagcaaactttcggaagcatcctcgatctcgggatttcataaagaaatgttattaaaatgttatttttttaagaaaaacgggtgactaaccctcttgaacccttgtcacatcaagggtttttttcgttttaggaatcatattataaacaatattcaaaagcacggctgtaaagcttccggcgacgattccgtttgtggtcagcaaatttaagtaagacggcaggtgcttaaacatatcgggaacgacggttacaccgagtcccaatccgaccgaacacgcgacgatcagaagattttcctgctttttaaagtcaatttgactgagcattttaatgccgtaggaaatgaccatgccgaacatggccaccatcgcgcctcccagtactgaagacgggatgatggtcgtgaaggctgcgattttcggaaaaaggccgaatagcattaaaagtgcgcccgtgacaccgatgaccgcgtttttcttaatccccgtcagctgcacgagaccgacgttttgggaataggccgtatacggaaaagcattgaaaatgccgctgatgaacaccgccagaccttccgcgcggtagccttttgctaaatcacgttcagacaggcgccggtttgtcaggtcaccgagagcgaaatagacgccggttgattcaacaaggctgacaatggcaacgatggacatcgtaataatcggtgccgcatgaaatgtcggcgtcccgaaataaaacggtttaatcatttgaatggcgtcagcattcgccacattgtcaaattgcacttttcccataaaatatgcgatggccgtcccgatgacaatgccgattaaaattgaaatggatttcaaaaatccttttgtaaaccgataaagcagcacgatgatgacaagcaccgtaaatccgagggcaaggttagccggatcaccgaaatccttgctgccttccccgccggcaatatgattcatcgcgaccggcattaaggtcatcccgataatcgtcacgacagatccggttacgacaggcgggaaaaaggatacgagcttgccgaagaaaaacgacagcagaatgacaagcagacccgatgccaaaatgcttccgtaaatggctgaaatcccgtactccttaccgatggaaataatcggcgctaccgcggtgaacgtacagccgagcacaacaggcaagccgatgccgaaacatttattcctccatacttgaagcagcgtagccgccccgcacataaaaatgtcaattgatacgagatatgtcagctgttctgcgttcagtcccagtgccgctcctacaattaaaggaacgacgacggcgcctgcatacatggcaagcacatgctggataccgagggaaagtgttttggcatagccgtttttcatgaacggacctcctgtacaaatgtcacttttccgtcttcaagcgattgaattctcgctagtgattcgacccggaatcctttttttaccagatcgtctcttcccggctgaaatgacttttcaatgacgattccgatcccgcaaaccgctgcgcctgcttgttttacgatggacaaaagcccctctgccgcctgtccgttcgctaaaaagtcgtcaatgattaacacgcggtcttctttcgagagatgatttccggagattgcaatctgactttctgtttttttcgtgaaagaatagacggacgccgtcagcagatcatccgttaacgtgagagacttcctttttctcgcaaagatgacgggaacgccgagttcaaggccggccattaccgcaggggcaatgcccgaagattcaattgtgacgattttggttatctcgtctttttcaaaacgccgcgcaaattcccggccgatctgctgcatgagaaccggatcaatttgatggtttaaaaaagaatccactttcagcacttgatcagaaagaacgattccgtcttctgctatttttcgttttaatgcttccacaatgattacccccgcttataaaaaataaaaaaagcattgcccgctctccaaaaaaagagcaagcaatgccgaatgatctacacgtaacggccgaataaagccgttccattgctcactcatagtcggacatttacggtgaccggtagaaacttgcgtgccatatccacgcgattatatgagtgttcgtatgatattaatcaaattataacaagatacacttcttttgcatagtgaaatttgaatatttccgaacttttacaaagaattagttttcaattattcgtctttttagaatttttagaaaaacacccggtgtataccgggcgtatcgtttataaatataaatttgaatatttgccgacgagatactcaatgagatattgaacgttcagctcttctcccgttgcatcttttatgatgtcaagcggcattttgcgtcttccgtgctgatgaaccttttctgtcagccattgtttgatcggctcaaagtcgccccgttctattaattgatcaaattcaggcagatcctcaagcatggtatgcttcagctgtgccgcatacatatatccgagcgcataggaagggaaatagccgaaatcgccgcccgcccaatgtacgtcctgcaaaatgccttttgcgtcagatggcggcgtaatgcctaaataatcatgatatttttgattccacaatgcaggcagttcttccactgtcacttcattgctgaaaatcgctttttcaatttcataacggataataatatgaagcggatatgtcagctcatcggcttcaattcggataaaggtcggtttcgcctcatttacggcgcgtacaaagtcctctcttttcacatcttgaaattgatcaggcgaagcctcaaccattttttcataataggcggtccagaaatgttgatttctggcgataaagttttcataaaataacgattgggattcatgaattcccatggatgcaccgtcagataagttcgttccgctcagcgcttcgtcaatattctgctcgtagatcgcatgcccgcattcatgaatcgttccgaaaatcgccgtgcggaaatcgttttcgtcatatctggtcgtcacccgcacatcgccgcggttgattgtcgtcgcaaacggatggaccgtctcgtccaggcggcctccgtcaaaatcatacccgaactcttttaagaaatacaaggagaggtctctttgttgttctttcggaaacgttttcgttataaaggaagtgtccggtttattgccggattccgtcacttttttgataagcggaatgatcgcttccttcaattcagaaaacagctgatccagcacctttaccgtaacacccggttcgaaaatatcgagcaatgcgttgtatggatgatcttcatagccccagtaagaaataaaccgcttattaaaatcaatcagcttctctaggtacggagcaaacatagagaaatcagaggccgcctttgcatcctcccaagccgtttcagctttcgatgttaaaatgacatattctttatactcatcttcaggaatttttttattatgatcataatcttttttcgcaagttccgccgctttcactgtatcttcagagagctcttctgcatgcgcgagaaggatgtcgatcagctctttcatccggtcggatgtctggatttgaaaaacgtcagccgacagctgtccgatgctttccgcccggtcatcagagccttttttcggggctcccgttcttaagtcccaatgcatgagcgcaatagcttcttcatagtgggatactctttttaacagatcaaaaaactctttttcatatgtatgtacatccatatccgttcccctcccttttcactatcaattacaggctaatggaacgccgtcataaagtcaacttcccggattaaaaaaagccgcaggataagattcctgcagctcttgtttttatacgattttcggtgtaacaggcaagacctttttgacttcggccaggacccgttcactttctccgcccgcataaatggatatggttccgctgtcctgattagaacggatgaggcggccgattccctgccggactctcaaaagcatgtacggcagatcaacttcctcaaacggatcttttttcgctccgttccgctttgcggtaaacacaggatcatgaggcggatacggcaatgcccaaatggtcacattccggagcgagtcaccgggaatgtcaagaccttcccataagtggacggaacaaagcacggattcttcatcccgctggaatttttcgaccagactgctgatctcttcgtcaccttcgtagtaaatcggatacggcagctcccacgcggcagcctgttctttaaattccttcatgtcttcaaaggaagggaaaagaacgagggtgcgtccttcattctccttaatggtttcaatcgtttcggctgttttctgctcagacgtcatgtcaccgtgaagcgcaacagacatttgctcctcgtaatcgtacggagattcaacggtaaatgataaaggatcacggattccgagactgtcagcgatataatcaaatgaaccgccctcagaaagagtggccgatgagaagatataaggtatctttttagaaaagaccttttctcccaaaacttcggctacagttctcggcataacgacaaacgttgagtctgtatcccgcgtttcaagccagctgatggcatccttttgatacagcgacagcgaatatgccatttgttcgacgtattcttctacgactgacagctcgtacttatcaatcgtatacatttccgattcaaatacgagcgcctcgccgattttatcgagcagacggcacagttcgtcagccgcacgcttaacacgctggtcgttttggatgtccaatcggtgagagccggcgatttccttcgattcctctgacagcacatagaaaaactcatcgtttgcggcaagggcatcttcaatcagttcggcgaattcctctctgatgtcattttgaagcagacgctctaaaaacagctcaagcgtcgactgcttcacacgatacgttaacgctttttgcgcggcgaattccagcagatgtccttcatcaaacacgacggcgctgtgatccggcaaaagcggcagctgcccttcccttttgcgtgattcttccgtccatacatgctccatgtagaaatcatgggagcaaacaatcagatccgttgattttctgtaatgatctcttgaaagtgttaaaccgcatctatgtctcatatcacatgttaaacaatcttggaaggaatcatagctgacgccttcccactcttcatttgtcaaatcagcgtactgtttgcggtcgccgtacggataaaagcgctgcatcgcttgtgattcgtgtacgaatgaaggcagcgactcataaagatccagccacttttcatcatcagaacgctgcatcgttttctccagctttttcagacagagatactgctcatgggatttggacagccgtgtatcaatctgcagatccaaatgttctgtcagcttggaaatgtcgccttcttttttgacaagctgttctattaacgtttcatcggcgcatgcgataatggccggtttacccgtatatcttgcatagctgatggcaaacagcagatacaccagcgttttccccgtaccgactcctgcctcagcgaacatgacctttttctctttaaaagcccgttcaagctgaaacgccataaatacctgctcatcccgaaggtcaaagcctttctcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggcctcgccaagtttttgtcattatcatttccggttaatgatatgtgtacataggaacggatggtctgttgaatgtgtatgttttaccgcattttcaagttcttcctgtgcgtgtgtcatgacggaaggaccgaacttagctccggcttcctccagccggaaagcagttgcgtctaacgccttttgtattttactgaagtgctcgctgttcagcataaaataagatcacctctcaaatagaaataatcatcattctatgccgatgcttcactttctatacatgccatcctgaatgatccgcacctgacctgcacaaactacaacagatattcgatcgaatatccatcttcacaaaattattctatccgggagtgatggttacatgagttataaagatcgattagatcagcattctgaattgtttcatcacaattggacgcggccgaaacgctctaaatcgcaggtgaacggccacaccgaaatgtcccagaccaacattattttacggagcaacgcaaaagcgcaccgctggtaatggcagaataaaacgtaaagatgccggagaagacgctgtatcaggcgtcttctctttgttgcggctttttccgctgcggccgcactttagcccagtactgataataatccgttttgataaaaccgttaaagagcttccgtttttttgttgcttttcttccgtagacctcttcaaattgttcatttgacgttaacatgtagacagaccatgtatcaagagattcaaatgcccggcccatttctttatacatctgctctacttcccttttttcgccgagccgttcgccgtacggagggtttccgacgataacgccgaattcgagtttcgtcgtaaaatcctgcactcgcatctgcttgcattcgatcaggtccccaagtcccgcttcttctgcgttttctttggcgatgtttaccatccggtgatccacgtcactggcaaagatctgcagcggctgatcatagttcgccttttcttccacttcaaggcgtgccttgtcccacagttcttttccgatccattcccagtcttctgaagcaaaatcacggttaaaacccggagcaatgttttgcccgattaaagcggcttcgatggcgatcgtgccggaaccgcagaacggatcgacgaacggacggtcaggcgtccagttggttaacagaattaacgcggcagcgagcgtctctttaatcggagctccgccctgatcaaccctgtatccccgtttgtgaaggcctgttcctgatgaatccagtgtaagtacggctttatcttttaaaagggaaatctccaccttatactcgggtcccgtttcttcaatccattcattttgttttcctgattgaagtttcagcttttccgctatcgcctttttgacgatccgctggcagtcaggcacactggcaagcactgatttcacggactttccgataacggggaactttgcgttttccggaatgtacgcgcgccagtcaatcgcttttgttttttcaaacagctcatcaaacgtttttgcctgaaactcggcgacctgtactttgatgcggtcagccgtccgcagccataagttagcgcggcagatcgcaagcgcatctccttcaaaaatgacttttccgttgtctactttgcattcataacctaaatcacgcacttctttggcgacgatcgcttcaattcccatcggcgccgtcgctattagtgtgtacttcttcatcgtatcaccctgtctcttttaagctttcgattcattcaagataaaagctcccctttaaaggagagctctaatttgtcatatcaataatgtttaacgttctgtaagccatgttttgttccgtcgtactgcaatcggctcatcacctcgtactcaggcggcaatcatctatctacagaaagtattctgtccttctatctgttcagttccttcaagaaggttcccctaccaaaatttgggtttctcgctcgaggggtttaccgcgttccactctcaacatttctgatgagacttcgtcactgtggcactttcaaggatactcagccatatccggagacgtaggcttttttcctgccgtcagcctatcaaggctgccctagcttatttcttcgctaggcacgaacactacgggcatctcagcaccgtgcgagcatggactttcctctacagattcaaagacctgcagcgattacccgaacgttaagaacacttgttcattataaagcaacttgtctcatttgacaagtgcatctgccttattcgtcataaagtttgctgccgaatacatgtttctcaaggttggacagccttttcagaatatcaaagttggtcgtattggactgcaccggctgttttttgcttgcttcttcaagctgttttttcagctgcagattttcctgctgcagttcttcaatttcttgatgaaaggtttcataatccttaataatcatatctaaaaatttgtcaacgtcttcttgtctgtaacctctaacgcctgttttaaattctttttccaaaatgtctttcgcagaaagctttactttatcagcaagcatctttttcacctcatatcgtgaatcatcatgttatattttattcagaaacacgtcccgttgtcaaatattctctgacgtgttatgtaaagaaatcttcttcctcaacggcggcacggagatcatccatcgtaatcgaataaatcggatatccgtctttttcacggcgtttttctgcctgctgcagcatatatttcggcgatccttccacctccggatcatataaaagcaaaagcgcatctgacttttcaataaagaacgcgtttttctgccggaattggagcggactttcgtacggccgatgcgtcaggctctcctcataatctgcctgagcaagcaccgcttcatacatttctttattcggctccttccacttttcctcctggccgtagaaaggcgtgataacggcaacctttaattccggatactcttctctgagatcgtacgccgtttctgccgcccaaagctcagtccccagctgtccggatatgagaatccattccaagccttcgtcaataaagcttctgagtctggtttctatcgccttttttatataaacaagcgcccggtcatcctgtttaaagataccgagctcaaacggcttgtaccccgttacggctaatactttcaattgatcacctgcttaaaaaatggggctccccatcgggccccattttgatttgctgatatcctaaccgatcttgcttaagcgttcaatactaatgatcgcagcaagggcttccgcactgaaaatgctggtgagttgtcgggtcaacatttgaaaaagtgtgcggatagtaatgaacgtgctcaaagttgtggtgatttacgttagttgtatgttgcggatgaatatgcggcacaaccgtgttagaaaagcaatggtgttcacagcaatgagtcggatggacaatcggcggcatcacgtttggtctgcaacaatgatgatgaaacatgctaaatcccctctccattaacttttattacactgttaggttatgaagaaaagagggtgcatgttctaattcaatcacccaatttaaaagtgtgtcagcaaactgtctttaaaattcgaaaatacaaacgcaatcaaaaaaaccacgacaaagaacaagtaaaaaacacctttatacataccaactctcccctataaataactaacgctattttacaagatgcggcaccattctacaacaaaatcgatgcggattcagaaaaaaatatttttggcgaaacagctcggcttttgcgctttcccgggcaatatttcaagaggaatatttcctcttgagccgggcaattctcacatggagcttctcggcttctttttccgatatttccccgtcttctgccgcctgctgcgcggcctgcagagcttttttgtaatcttttgcatggtgctcaaaatagatcgccagctcaaccgctgaatggtgtccgcatgtgtgaagatcagagtccgtcagtttctcccaaaggggcacggcgtcttgcctgcggttttgttttttataaagcatcgctaagtcaaaaagggcccgatccgaatcttcaaagtctttgccttgcagcgcttccagctgcaaaacggcgcgatcggtttctttatgagcgataaaccatttcgccatggcgtatgcttcctgacgttctgacgtctgatcagaagatgcaaaaatcttttttgacatatggatgtaaagagcgatgagggaaagcacatcttgttcattatgcgagagcactccctttaaaagagccgggtcctccgcctttaaaaattgaaaatacagcatcggcgccaaataaccaggggtgtcttcgtcccttttaaaagcaagctcttcattttcaaccgccgaaagcgatacacgctctaatttatgtttccaaagccgtctcgccccgtgcagaagatcaaagtgcccgaagtcaggaagtttcggaagcctgtcccgcagcaatgtatgcctggtttttacctgcggccagtcaaaggcttttccgttatacgtaacaagggacgtaatgtcaacctcacttaaaaagcttttgtaaagagccgtctcgtttcccggtttagggagcagatgctgtttaaccgctacacggtcttcatacactcttgcatggccgagcaaaaagatcatattgccggccccgccgccgaggccggtcgtttcagtatcaaagaagaacagctggcttttttcgtatccttctgctgataaagtatgtgtcaaaccgcctttattccataatgccatgacgtcatcaagttcactgaagctgtaccgtccgtggcggtgcgaaagcggatagacggtttcgcggataagacagtattcatcctcaaaaaagaaaggcttcactccgaatgcctcccattcttctctaaacgggacttgaatatccgggaccgaaagttgtgaagctgccggctttttttcagcttccggcacattcaggtggtttttcatccgctttaatttatttttcaaggacatctttcgtccccccttttcttttacacgtaattcaagagccggagtatcgctttctttgcatctattccttctatttcggagccgatgcaggaaggacacccgtcttgacatggacattgtcggatcaggcgctcagccccttcattgatttcatcaaatcgtttatatacttcatcggcaagtccgattccgcccggataatgatcatacagaaagattgtcggaagtcccgtatgtgcggctttgatttgcggcacgacatgcacgtcatttcgatcgcacatgacgtatacaggcacgatatgctgcaggacgtgggcaatgcctaaaagcagctgttcaagcgttttttcgccgatttccgaatccgtttcttttaattcaagccagactgcactggtatgcagttcttcttcaggaagatgaatcggtcctgatcctatattttcaaatgtcgtcattttaatttttttaaatattgtcggaagtgcgttcacggtgacgtcgccgaaatgtaaggccgttttctttctgctgtccgttctgtcaatgtccagcactttcagctgcaccgctaaattggcatctgtataatattcgacatcgacctttcgcacgtacgcttttttatgttcccaatcaagcttttcaacctgatactgcaccccttcatgaagataaatcgcttcatcatgaagaagcgtcatcgcgctgaagcggtccatttctccgatgatttttacatcagccgtctctgaccggtcaacgatgaccacgttttcctgtgacgccgaacggagactgatattggaggcgggaaaagattcgctcgcccagtgatagcgttcgcggttttcgtgaagcaccccttcttcctctaaatactcgagaatgtccctcgcatcattttctccgaatgtttcatcggctctgaaaggcagctcatatgcggcgcatttcaggtggtcgaccaatataatgagattatcgggattaatccttgcagattcaggcgagcgtttaaagaaataatcaggatggcggacaatatattggtcaatcggatcagagttcgccaccatcacgataagcgcctcaccctgccggcgcccggcccggcccgcctgctgccatgcgctcgcgacactgcccgggtaccccgtcatcacgcagacctgaagctggccgatatcaacgccgagctccagcgcgtttgtgctgacaacgccgagaatgctgccgtctcttaacccccgctctatttctcttctttctttcggaagataaccgccgcgatagcctctgacagacttcgagccgatttctttttttacgatctcctgaatgtggcttaaaataatttcgacccggacacggcttctggcaaaaacaatcgtctggatcttattttttaaaaaagttttggcaagttcgttcacttccacggtggcgctttttcgaatatgcagcggtttatttacaatcggaggattgtaaaaagcaaagtgctttcttcctgccggggcaccgttgtcgtcaatcaggcgcacggattttcccgtcagctgctccgccaactccctcggattggcgattgtggcggatgtacagataaatgacggcttgcttccgtaaaaagcgcagattctcattaaacggcggatgacgttcgccacatggctgccgaatacgccgcggtacgtatgtaattcatcaatgacgatatatttcaggttttcaaacagactcacccattttgtatgatggggaagaatggctgaatgaagcatatcgggatttgtgatcacaatatgcccggcctttctgactttctgcctgatagccggagacgtatctccgtcataggtgaagcttttaatatccatgcccgtctcgtctatgatttcattcagctcgcttttttgatcctgcgcgagcgcctttgtcggaaataaataaagtgcgcggcttgaggcatcttccgcgatagactgaagaaccggaagattatagcacagtgtttttccggaggccgtcggtgtgacggccacaatgctttctccgttttgaaccgtctgaaaagcggagtattgatgtgtaaaaagccgctcgatccccctcttttcgagagccgcccgaatgttcggatctacttgctccggcatcggcatggttttcgcctcccgcggttcctcttcatgccaatgcacaatattttcatgattttttaattcctgaatcagttcgctcagtgattttttcttcatcgttcacacctctttatgaggtacagtttaccgaatatttgtttgcctggctagatgaaaatcctgcacaagaaaaaaagcagggaatcagcccctgcctacttcatttttatcgtaaaaagctctgtttgtccttttttcgcttcatttgcgcctgcaaattgcaaaggttctgcggcatcgccattcataatcaccatagggatgacggtgctgcttgctttttcttttattaaatccagccggcacgttaaaagcagatcgcctgttttcactttgtctccttcttttacatgcgcttcaaagccttcgccgttcatattgacggtatccaaaccgacatgtatcaaaagttccgctccggaaagggtgcggatgccgacagcgtgttttgtatggaacagctgaatcacttctccctcaaccggtgaaacaatttctccgtttgcaggctcgacggcgatcccgtcccccatcattttttgtgaaaatacaggatccggcactgaagccaaatccatcaccgctccgtcagccggagaaaaaatcacttcctcggccggctttttccggctgtctcccaatccgaataattttttcagcaatgtgttgtgctccccttcctaaatgtgaatccgttaccagtttattctccactatttaaccatactttcttttttccttcaattcttaaccatacggcatagcatcgcatagtctgtttgtaaaaaggcggtggtcatatggatcaatcccaaaacgataaacttgatccgcaaagtaatgaggacatcatcagccatgcgatggaccaattttttcactcaggtcccttcgcagaattgatgcagggttttcagcaccttgtcaattcggcttttactgaagcgcaagtgacgattgacgtcagagaagagccgacggggctcgcggttgatatcggcgttcccgagacgttccgtgacggggatatgctggtggaaacgaaagggtgctaccttcacgttacaatccgctacgatcataaacaggctcaatcatcccatgtgtcttcaagcatgacaagaaccgttgtcctcccgtataaggtaagtgaagaagatatggaaacatcctggaatgaacagacgcttaccctctttttccctaaaaaataagcatgaatgatggatatcattcatgctttttatttgaagatactggtgaagcctttcaccagcgatccgacctgatttacggcgcttaccatctgccccgttgtatccatcattttattgaagtcaaactgtccattcgtttttttaaactgggagagtatgcctgagaattgggaagactgctgctgattcggtctgggaacggggtaaggattcacaaaccccggctggcccccgggcatgcctgcctgaggaggagcaggagcaaacggctgctgtatatgaccgtattcctgattcggataaaattgctgcgggtactgcccttgctgatgatatggcggctgctgcaatggctgtatctgctgcggatacggcggctgtaatggctgtatctgctgcgggtagaaatatcccgccggctgctggtacatattttgatatggctgcgctctccattgcatatgacattcccccttgtctctcactaagtttctgctatatatgtatgaattccgccttggttatgtgctttcggtgattctgatctttgtcaaatgctgtcgaaagtcttaattttttaaaaacagaaaaaagtcgaatcgttatgttaacataatctcaacatacatgagaggggatgcaccattatgaacgtatcatacttaagaaagcgttttgctgaagtgaaaaaatatgaaacagattgtgcagataaactgatggactttgcaaaattcctctatattcaaggccatctcaccgcaaccgaatttcgaaacagtatgaaggttctcgaagcaagtggagcagaaaacccggcgtatgaataacatacccgacccctttatataaaagaaggcagccgttttcagctgccttctttttcaatttcatcccttaatatacgaagcgtatataaaacagattcagttaaatccctgtatctttttttatgaatatgatgaacatatgattggagcatcagctccccgaaattttctgtaacggcctgaatttgtgcatgatgaacgtatttcggacggttttcctgaataaacgcaagcgctgcttctgtccaaagcgcgcaaagccggtctcttttttcaacatcgggtttaatcgtctcaaaaaaatcatatgaacggcctgactcttttccatcctgataccttttttcggcttccagaaccgcctctatcatttgttctgtcagctccaataacgactgtgtctgcaaacggactcacctcagtacatatggtaccaaagtttttgcacaaaatcagcttatccggcagactcgcggcaaatcctttttacgccggtcagtcaaaaacaggtcatcaatacaaacatgaagctcccgcgcctcttcctcaagacgggaaagtttctcctgtctgatttcttcagcttccgcctgacagcatctgactgcttgggtaagcgttttttcagcagcagaaatccggatttcgatatcagaaagcagacggagaatatcagccttgctcgtgtaaacagacattcatgttcctcccttttatcacttgcatctctttcaaatataattctcgttttcataccgctctcctctgcacatgacaaaactagaagcagttcggcaaacaaacagagattatcctaaaaggcgtgcctttcgacaaaaaagtgccgcaaactttgtatgaaccggcacgttaatgcaaacgatacagttgaggaggtgccgtatgaaaacgagaccgaaaaatgcaggtaaacagcaaaaaaccgaagcaaaaacgactgatacgcttgataaaaaattaggcggcccaaaccgcccttccacgtaacacatcagcagcccgaaaccccagcgaacggtttcgggctttttcatttcttcagccactctttaaccgcgaagagcgcatggagctcccgtcttttctggaagtaccagtccgtcagttcaagctgtttcggcattttctcctgtaagaaagccccttttcttaaccttttttgaaaccaatccgccctttcgccgtctaatgggtgggcaacaatgggataggttgtcctaagcatcggtgatgttctttttttgatgccgatcattttctccatatcaaagcgtgaaccggtatgaggaacggtatcaagaaaacggtaaaaagaagcgtgaagatcagggctgaacagaaggcgggccagctgttttccgagcgtaattctctcttcggtttttgaaaaccgtttgacggaaattccgtataaatgtccgtcaaatgaagggaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaagcggaaccattcttcctgcataaaagccgagacgcggaaataaggaagatgacggaaaagaggttcgccgatttgttttgaccactggtagaccagaagctgaggataggcatcagaaaaaatcagccaattcgccctttcatacgaaaggaaaaaccagtttttctgactgctgtcaaggccctcctgataaaggacgcctcttaaatcagtcatcgaccagcccgcattgcgggacacaaaggatgccaaaagcggccacttgatctcaggatggcggtcataatatgctttataggcattcgtccgggaaatattatcggcattttttattttcgtctctttttcgatcaggcgaagaatggcggttacggtctgtcgtttatgcacgttcattcacttccgtcactattagtttgataaggaggatggaaaaagtgattcggtacccgaatggaaaaacttttcagccgaacaaaacggtttcatcccaaaacagccagaaacggtctcattcatacagtaatcgcggcatgaccctcgaagacgacctgaatgaaacgaataagtattatctggctaaccaaattgctgtcattcacaaaaagccgacacccgtccagattgtaaacgtccactatccgaaaagaagcgccgcagtcattaaggaagcttattttaaacagtcttcaacaactgactacaacggcatttataaaggacgctacatcgatttcgaggcaaaagaaacaaaaaacaaaactgcatttcccctgcagaattttcatgatcatcagattgagcatatgaagcaggtggtcaggcaagacggcatttgttttgttattatatccgctttcggaaaggtttatttcctcgaagccgacaagctgtttgtcttttgggagagaaaggagaagaacggcagaaaatcaattcgcaaagacgaattagaagatgcttcctttccgatttcccttggatactcaccgagaattgattatattagtattattgaacagctttatttttcgcaggaacagtagactgagcgaaaggttgataaacgaaaggttgagatgttatgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagcggcggcatttgccgttttggtttccggcgcgccgtctttggacgaagccaagctgaaaacgccttactcttcaacgatttacgataaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcgtatcggaggcgctttggtcgccaactttacggatgggttcggttcagagggaggaagcacaatcacccagcaggttgtgaaaaactcgcttttgacccatcagaaaacgattaaacggaaagcacaggaagtgtggctttccctgcagctggagcgccattattctaaagatgaaatcttagaaatgtatttaaacagaatttatttctcaccgcgcgcctacggcgtcggaaaagcggctgaagaattcttcggcgtaaaagacttgagcaagcttacggttgaacaggcggcgacgcttgccggaatgccgcaaagcccgaccggatataacccggttaaaaacccgaaggcttccgaaaaacgacgaaacatcgttctcagcttaatggaaaaacaaggattcatttcaaactctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttatacgactcttgatacgaaagcacaagattatcttgatcaattgatgaacggcgatacagccggatttaccgaaggcatgcagggcggcgtcacgctccttgatacgacaaacggagaaatccgcgccatcggagcaggacggaacagaactgcaggcggattcaattatgcaacacaaggtaaaacccagcccggttcaaccataaaaccgattcttgattacggcccggtcattgaaaataaaaaatggtcgacgtatgagcagattgacgattctgcatatacgtactctaacggcacaccgatccatgattatgacaatagatacagaggccagatatcaatgcgagaggccctcgcagactcacgtaatatccctgctttaaaagcattccaagcagttggaaaggataatgccgtggactttgcaaacgacctgggattaggtttaaacaaagatcaagtatatgagccctattctatcggcggttttggggatgaaaatcgcggtgtatctactatgaccatggcaggcgcctacagcgctttcggaaataacggaacgtacaatgaaccgcatgcggtcacatcaattgaatttaatgacggcactaagcttgatttaacaccgaaaccgaaaagtgctatgagcgattacacggcattcatgattaccgatatgctcaaaacagtcgtgcagtcaggaacaggcagactggctcaagtaccgaacgtggaagtcgccggtaaaacgggtacgacaaactttactaaaggtgatattcaaaaatataacattgctccaggcggagttccggattcctggtttgtcggatacacccctcaatatactgcggcggtttggaccggagttgagtctggcaacaaagcaggcaagaaatcactgtcttctgcagaccagcaagtcgcaaaacggattttccaaaagctgatctcatacgttgatgacggtaaaggaagcttcaagcagcctgacagcgtcgtaaaagaaacagttgagaaaggctcgaatcctgccgctttagccggaccgaacacgccggatgataaaaaagtgacggagtacttcgtgaaagggacgcagccaactgccgtttctaaaacgtatacgaaagaaaaagccgataaaccgacaggattgcaagtgaaatacgacaaagataaaaaatcattaaccttaagctggaattatgacggtgatgcaacattcaatgtcaaacaatccgttgacggcggaagctacagtgacattcaaaacagttcggcaaaagaagccgtcgtctcagatgtcacgccaggctccacatacagcttccaggtgacagcggaaaacgatgacggaaaaagcgatacggcatcagcatctttcaaagtcccgaaagatgaagaagacgatgctgataaagataaagcgactgacgatgaacagaagactgatgaagataaagataaggacaagacgcaaaccgatgattcaaacaaagatgacgatcagacagatacgtctgacggatcggatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaactatcaacgggcagtccaattcgtcaaccatccagtcaaatcccgctcattagcggacgaaatccttcaccccaaacaggtgaaggattttttcgtacaaaaaaacctccttatgggaaaaggaggtttttaacatttgttcatggcttcatatttatgatattgtttcttcatctccgtcatcaattcatccagctgaataaacgagtgaaattgagtcggttttgttaaaataaacgccattcgctccgcccaattgatcggttccgcgggaaaatgctttgtttcaagcacagtccagtcgagtgatgtgacccgctcccctgccgtccaatgaaaagcggcaatcagacaggctattcccttcagcatgtcattttgatcacatctcgattttcttgtttgaaaaacgggaagcagcgtttctttcgtttcattccaaatctgaaaaagaaacgggacatattcgcccctttccctccatggctgcactgttggctgaccgctgaaatccatatacagcggatggcggcgcagcgccgctttgatctcgaggctttccaagtccgtaaggctgcgcaggtatgtttcatagcctgccagaatgtcaatcgccgtcaccgtttcaccagcccttttttgtcacgcttctgcccttctctgcatagcggaagcaaaggacattccgcacagcggggagattgcgctttacagtgataccggccgaaaaatattaatctgtgatgcgtaacagaccaatcctctttcggcacttttttcattaatgttttctctacttccaaaacagagtccttccagcggcagatgccgagccgtttagagacccgctccacatgagtgtctactgcgatcgcaggtacgccgaaagcaacagacacgaccacatttgccgttttccgtccgacacccggcagcttcacaagctcatcccggtctttcggcacttctccgccgtactcttcaatgatcattttgctcagcttttgaatatttttggctttattacggtacagaccgattgatttaatatcctgctggagttcttccagcgatacggcaagataatcttcaggccgtttatatttttgaaatagcgtttttgtcactctgttgacgagagcgtccgtacattgcgcggataatgcgactgccacaaccaattcgaaaggatttgaatggacaagttcacattctgcgtgcggaaacatatcgcggattttttcaagacaatattcaatctgctttaaatttaacacgtttctccccttctcatgttattgttccagccaattgtaaaaaggcacctgcctcgtatactctttttgcggatcattctgtttcgtttgaacacgccggaatttttggctgtgcgccttcgcctgctcaaccgttttgaagccgttctttttccattcaaataaaatccggtcaatatagcgaaaactgagtttccccgataaaacggcttcttttaaggcgtgtttaatcagaatcgcatcatgctgatcctgatcctgccatatggccagcgtctcgcattcaagcggcgacagcggtcttccgaactcttcttcaaagatggtatacaggcttttttgttctctttctgacgttctttcctgcgtttcattttgagaatgctgcatgtaatcatacagcttcgcccataacggctgcagagaatatttttcaaactttatgccgttatggtcttcacattcttcaataaacagaaaacctttttgaataaacattctcaggcagcttgtacattcttcagcagagatggacatgcctgattgaagttcaaacggcgtcggaaaataagagcccttttccaaatgcattttaatcttcaaaagcaggatcaattcggtttcattcagcccgagctgccggtaatgtgtcagcagcaggttgggaatgcttgaaatgccgagttcctgcatatctataaattgctgttttttcatccttacacctcttactgtaaaaggttatctccgggagctttcccctttacttagaaaaagtctcccttgcaggagacttcgtttttcataactattacggatacagacggttcagaagtctcgggaacggaatcgtttcacgcacgtgaggcgctccgctgatccaagccactgtccgctcaagtccgaggccgaagccggagtgcggaactgaaccgtattgtctgagttcagcataccatttgtaagcatctgaatccagaccgtgttcttttaatctttcttccaataaatccatatcatgaacgcgttctgaaccgccgatgatttccccgtagccttccggagcgattaagtcggcacataacacgacatcgtcacgatctttggcaggctgcatataaaacggttttaatgacgtcgggtaatgagtgataaacaccggtttgtcatagctttctgcaatcgctgtttcatgcggcgcaccgaagtcatctccccactcaatatcgtcaaagcctttttctttcaggaattcaatcgctttatcgtacgtaatgcgcgggaatggcgctttgatttgttcaagcttcgatgtgtctcttcctaatgtgttcagctcgatcttacaatgttccagcacactttgtacgatgtatgcaacataattctcctgaacttcaaggttttcttcaaattcaagaaatgccatttcaggctcaatcatccagaattcgatgagatggcgtttcgttttcgatttttccgctctgaacgtcggtccgaaagagaatacttttccgagcgccattgcagctgcttccatatacagctggccgctttgagacaagaaggcgtcttcatcaaaatatttcgtcgcgaacagctcagtcgtgccttcgggagcgcttcccgtcaaaatcggcggatcaactttcacgaagccttctttgttgaaaaattcataagtcgcacggatgatttcgttacggattttcataatcgcgtgctggcgtttcgaacggagccataaatgtctgtgatccattaagaattccgtaccgtgctctttaggcgtaatcggataatcagtcgcttcgtgaatgacttcaatggatgtaacagcaagctcatagccaagcggtgaacgctcgtcctctttcacaattccttttacataaagtgacgtttcctgcgtcactgatttcgcaatttggaagatgtcttcttctacttcagctttgacgacaactccctgaatgaagccggtaccgtctctcagctgtaaaaatgcgattttaccgcttgagcgtttattagcgacccaagctccaatcgttacttcctcgcctgtgtgtttatacacttggttgattgttgttttcaaactctttccctccagaacaagaaagacattcaggaatctgcctgaatctcttttttcatcactttattatacccgttctactctaacggggtcaatgcaagtgaaaagcggctttaaaagccgcttttccagaatcagctgtgtttttccgtaaagcggcggattctcttgaccgcttcttctaaaaggtcgagtgacgttgcgtaagataagcggacgttgtccggtgaaccgaaacccgagcccggcacgatggcgactttttcttcttccagaagcgccttgacgtattcatcgacatctttgaatccgcagttttctgcggccgctttggcgttagggaacaagtaaaacgctccttcaggtttgacacaggtgaatccgggaatctcactgatctgagcgtaaatggtattcagtctgtgctcaaatgcctgtctcatctcttccagcggctcagccggcccgttataggccgcaatggcgccgtattgagcgatggacgtcggatttgaggtgctgtggcttgcaaggctcgtcatcgctttaataatcgtctccgaacccgccgcatagccgatcctccagcccgtcatgctgtgagatttcgaaacgccgttaatgatgatcgtctgctctttcaattcatctgaaagctgtgcgattgagacgtgtttttttcctccgtatgtaagcttctcataaatctcgtcagaaacgatcagaatgccatgctccagacacacttttccgagttccgcaagctcttccttcgtatacataacacctgtcgggttgctcggtgaattgataatgagggcttttgttttctcggtgatagcctgcttcagctgctccggtgaaattttaaactgattggattccagcccttctgcatagacgggacgcccccctgccagtttcacctgctcaggatagctgacccagtaaggagtcggtataatcacttcatccccttcatcgagaatgacctgaaataatgtatacagagcgtgtttcgctccggtgcagacaatgatttctgacggcttatattcaatcccctgatcgtttttgaatttttttgcgatactgtctttcaaggccggcagaccgcctgaaggcgtatattttgtgtggccttcattcatggaacgcaccgcggcatctataatgtgctgaggcgtattaaaatccggttctcctgctccgaggccgatgacatcatggccttctgctttcagctctttcgcttttgcggtaattgcaagtgttgcagacggtgttaatgcggatactctttttgccaatttcaacttgaactccccctaatacgtctcacggtgtgatgtttttgagaatcttgccgcttgtaaagtccacatagctaaagctgtactgcccgcttttgttgatataggtcacttcccataacggaacattgttttctctcgccgagtgaacgccattcagcttggaaacaagcccttcgtcccgaacgatcttggcagccttgccgcttgaaatgccgtcactggctttttttgagagaatttttgcttttttgtcggccggaacccatacatacatatcttttccatgtttatccgttccggtaacaacataatatttctgtttgccgacaaaggtctccactttctcagcgtctgtcagattcgttttttctttagcggctgcggcagctgtttcgtggccttcttctttttgagccattgcagatttaaaaatgctggccgaaaataaaagaactgctaaaaaaataataccaaatacggctgtaaatattaatgctttttttctcatctttttcacctatgtgcgataaatggtgaagaccgcttcattttgattttcttcgtcgagcgcaaggccgaacatcaggttgtcccgtttcaaagtccggtttaatgtatcgacgattttatataaatcatctgaatgctccacattaatcgttgacagaatttcaattttgctttccatttttataccctccatcggtcgaacaaattttgttagtcataacgggatgcgcccgcggcataataaaatcacaaggcggcatgaacccgcttttactataaaaacaattcctcatcccacaccacgaaagccgcgtttatgcggcttttattccgtttggctgacataagccccgagttcggcatccgtcagctccaaaagggatgaagtcgggagcgcttcaagaaacagccgtccgtatcccgccgtctttacacgctgatctaaaagaacgatcgttcccttgtctcccgccgtacggagcaggcgcccgatcccctgtctgaacgttaacacggcctcaggcagggaaatcgtctgaaacggatttttcccctgcttcttggcaaattcgcattttgcggcgtgaagcggattatcaggcgccctgaaaggaagtcttgcgatcatgacggttgacaattcatcccccggaaaatcaacgccttcccagaaatgattcgtcccgagcaaaatcgcccggcttgccgttttaaaggttttcattaatttaccgggactcccgcctgaaataccttgggcgagaagctgaatgcctgagatctccatactgagtttcagttcctgatacacttttttcagcatatcatgagaggtaaacaggacaaggatcttcggctgttttccctttgacatgatttctgcatacttggcaatatgctcaatgacttcccgctccccgtcatatttaacggatttcatctctttcggaatgatgacgttcatctgatcatcgtaagaaaaaggagacgggatgcttttggtgcgcggataaaaatccgcaagtccgagcctttcaatcataaattgaaaagactgctccaccattaaggtcgctgatgtgagcacaacgctttttttgcgggcgaaaaactggtctgccagcatttcaccgggctccaaaggctgcgcatagatgctgacggcattttttgcgcccttcgcatcaatttcaacccaaacggcttctttctcatcattttcaaacagcagcctgctgaacgtatcgcgatattctttcagccccctgatacactttacatattcgcccgctaaaaaagccgctccgcttttcatctgatcaagcttttggtgtaacagtttctcctgtacggaaaacatgtcaagcagctgatccagcatcgcacaaagccgctccgctccgtccgttatcatgtgaaaccctttatcctggcttttatgattgagactatagacgagacggttcagatcgtctttaggttttcttcgtttgacaaaagaatgcactgaactgaaaaatgcgtcgctttccgattgaatatgcttcatccactcatcggcgtcaaaaaaactttccgccggcagttcatacgtataaaacagttttctcatccgctttaacagtccgtgttcctttaaggtcccgattcggctgagctttgtgtgcagtccgatgtatgaagctctcttccccaggtgctcgctggcggcgcgttcgaaatgatgcgcttcatcaatgatgaccgttccgcttgcaggcagttttttcgtttcactgctttgatctgaaaacagcaaagcatggtttgtgataatcagatctgcggcctgcgctttttctttagcccgttcataaaacccggcagccgagtccttcccttttttcataaaagaattctcatcgtaagccatgcgctcccacagcaatctgccgcctgatggaagattcagctcagcggcgtcgcccgtttcagtctccgtcagccagacgagaagctgcgctttcgtcaaaaccgcatcatagttgtcatcttcctcatgcagaatatgttcaaacttcggcaggcacagataatgtgatttcccttttaaaatagcagctttgaccggccaaggaaacatacgctccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaatcagcgcatgctcccgattgcggaaggcgccaagcacttcatccatcatcgtaagctgtcctttccgcttttcatagcgggggatgatgccggacaagatctgttctttttcttcgttccacttttcaaggtcaatggctgcattcaccggacgggaaaccggaatgtgatcgggctctttaattgaaaaagaggcgtatggaatgcagctcttttcttccgccggcctgctttcatgtataaaagaatccaaaagcagcgtcaaatcgctgataaaatgctgtgaaagccttctaagctgctttaacgtcggtaaaggcagatgtttcagtttatgtaaaatgtctaaaaagaccaggcccgtaacctccgcatcgctgtctgcgcggtgagggcggtcatgaacaatattcagctccgcgcacaactcaccgagcttatatccttcaaaccccgggaaaacaatacgcgaaagctcaaccgtatcaagcacttcacaatccggcagctcatagcccgcttcgctcagttcatgccggacaaatccgaggtcgaaatgaatattgtgggcaacaaaatacgcgccgtcaagcagatgaaaaatctcctctgcgaccgcttcaaacggcagttcattttcaaccattccggacgaaattccggtcagctgttcaataaacggcgggatggcctgattcggattgatatattttgaaaaccgctcagttatttgtccattttcaatgacaaccgctgcgatttgaatgattttatcgccctttttcggcgaatttcctgttgtttcgacatctatgacaacgaaccgttgtttgttcattaaaatggacacctcaattcttgcatacgagaaaagtgtaacacgttttgttgagaaatggagcggaaaaacagcttttgcccctaaatcttaaaagaaaacccccatgaagggggctcttttacaaaatcgtgtgtgccggctcctggcccagcatctgctcgattttattctgatcatccagaacggccaccttcggctgatggctttttgcttcctgatcagacatcatttgataagaaataataatgactttatctccttcttggacgagacgggcggcagctccgtttaaacagatgacgccgctcccccgcttaccgggaataatatacgtttcaagtctcgctccgttgttattattcacaatctgaactttttcattagcgagcattccgacggcatctaaaagatcttcatcaatcgtgatgctgccgacatagtttaaattggcttccgtcacggtagcgcggtgcagttttccggccatcatagtgcggtacatattatgatctctcccattcatcaatatcaataatgatattatcaatcagtctggctttagaaaattggacggcgcaggccagaatgaccttgccgtttaatgttttaagcggagtcagctccggataagcgtacagttcggcataatcaatgacaccgcttgtgttttcgatgatatcggtgacggtttttataacggtttccggatttctttcaccgtctctgaccagttcggcaccttgctgcaatgctttatagatcatcggcgcttctttgcgttcctgttcagtcagatagacgttgcgagagcttttggcaagtccgtcttcttctctgaccgtgtccactgcaaccaattcgatatccataaagaaatcctcaatcaatccgtccacaaccgctgcctgctgggcatctttcaggccgaagtaggcgcgggtcggtttaacgagattgaaaaacttcgtcagcacagtggccactccgtcaaaatggccgacgcgggaggcgccgcacaacacgtcagttctccttttcacttgcacggcaacattttgctcgcccttatacatgtcactcggagacggcgtaaacaaaacatctgctcccgcctgttctgcaagccgggcatcgcgctttaaatctcgcggatatgcttcgtaatcctcgcccggtccgaattgagtcggattgacaaagatgctcatcacgacaatatcgttttctttgtttgctttttcaaccagggtcaggtgtccttcatgaagaaaacccattgtcgggacgaatccgatcgtccggccttctgagcggtattgtgcaattaattctttcagctgttgagtttctgtcagttgtttcatcgcttactttcctccgtataagccttgcagcacagtttggtttatctgaaaggaatgcttttcttccgggaaaacccgttctttcacatcacggacataatcgctgagggccgactcaatcgtgccgtcgatgttggcgtattgcttcacgaacttcggtgttctgtccacgccgtggccgacgacgtcatgatagacaaggacttggccgtccgcttttgaaccggctccgattccgatgacgggaatggatacttcttctattattttagcagtcagttcagcaggcacacattcaagcacgagcatcatcgctcccgcctgctcgcatttgatgctgtcttcaatgagctttttcgcgctttgctcatcttttccctgcactttatatccgcctaatacgccgacagactgcggtgtgaggcctaaatggctgacgacgggaattccgccgagagtcagcgcgcggatggattcgaaaacgccgtctccgccttccagctttaacgcgtccgcgccgctttcctgaataatggccgcggcgtttttcaatgtatcctcttttgaaaggtggtaagacataaacggcatgtcagttacgataaacgtatttttcgcaccgcgttttaccgcttttgtatggtgaatcatgtccctgaccgttacgccgacggttgaatcgagtccgagcacgaccattccgagcgaatccccgactaaaatcatgtcgactcccgcctgttccgcaagctttgcctgcggataatcgtaagcggtcagcatcacgatcggctctccgttttccttcattttcatgaaatccagttttgttttcattctgtttctcctcctctaaacggtgaggagatgagccgccaattcttcgcaagcaaaaaagccttctgtataataagaaggattcccacttgtttaacgttcggcgaatgtcatccctctgtcccagtccttttttggatcaaggcagacttttcgtaatctctgttctgctgatcaggtgcagttcattatgatactgcccataggaagtataccaaattcacgaggcttgtaccaactaagattaattgagctcaatatcggcagaatagatcttctttataccgtctctcgtttccaaaagaagaactccctcatcatcaatgccgagcgatttcccgtaaaacgttccttgcagcgttctcgctctgagctcgttccccagtccgaccgcatagctttcccataacagcttgatcggtgtaaagccgtggttcaagtaatcctgatagcgtttttcaaaagtcagcagaatctcttgtatcagacccgctctgtcaattttttcaccggcttccatgctcaggctcgtcgcaatgtcctgaagctcgccgggaaaatcggtttcctgctggttcacgttgatgccgatcccgagaataaccgaacggacacggtcctcttccgcctgcagctcagttaaaatcccgacggcttttttgccgtgaatcattaaatcattcggccatttaatggcggcctgtacgcctgtaaaagcctcgatggcctgtacgaccgcaacggcggataacagggtgagctgcggcgttttttgcaaaggaacgtcgggtctcagaatgaggctcatccaaatcccgtttccctcctgtgaatgccatactctggccattctccctctgcctgccgtttgtttatcggccactacgagcgtcccttccggcgcgccgtcattggcaagttcatgagcggttttttgggtggacggcaggacgtcccggtaatgaagctgtttgcccaaaacctctgttttcagcccgaaacggatttcggattcactgagtttccccggttttttaatgagcctgtacccttttcgtctgaccgcctcaacctcatagccctctttgcggagctcctctatatgtttccaaacggcggttctcgagcagccgagcgcgtcacttattttctgcccggagataaagccgtcacccgcctcagaaaataaatcaattaatcgggttcttaatgttgatcccatgatgcgagccactcctttatgtcatgttttcggttaggaagcttccctgccaataccgcttcttcaatccggcgaagttcttcggccacccatttacccgcgcggcggtttctgagctccatcagatcagctcctgaaatgtcgaggtctcgaaggcttttgatcggcagctgctcatacaggctctgaacctctttcagcttttgttcatcaatcgtcttatgctgtttcagcatcccgattttaacggctgaaaacagcgcctctcccgcccggtacatcgcttctgcttccagctgcgccggataaacgcttatgatctgcaccgctttttttatgacttttcccggcagtttccattgttttaaaaacgcctcggcgcttttcggacaaagaccgagaaacaataacagcgctgcccagcgttcttcgcgtgcatctaaagaagaaaacggaaagccgcttgcttcaagcatttgctgctcataaccggaaaggccgggcagctcttgtatcagacctgtctgcaccatcgtttgaatcgcttcttgtgagaaagcgccctgcatcagcttttcaaactcgacggtctttcgttctactgatacatgtgccaaaagctccctgtcttttatgacggcctctcttgtttctttttctaacagaaagccgagctgactcataaagcggacggctctcatcatccgcagagcgtcttcccgaaaacggtcttcagggttacccaccgtacggatcagcttttgtccgatatcatgtgcgcctccgaaataatcaagcagctctccttcggcagacatcgccatcgcattaatcgttaagtctctccgctttaagtcttctgataaagaagtaatgaaccgcacagcttccgggcgccgatagtccttatattctgattcggcacgaaaagtggtgacttcataggtttcatcttcccacaggacgatgacggtgccgtgctcttttcctacatcgacagtccgcttaaagaggcgctccacctcattcggcgaagcgctggttgcgatgtccacatcacctatttttcgtttcatatagctgtctctgacggctcccccgacaaagtacgcctgatggcccgccttcatcagatgatgaaggatggggagggctttgacaaattcctgttccataagatcactccggtcctgccaattcgtcataaatccgttcatactgactgacgattctttgcgaagaaaaggcggtctccaccattttcagcgcatgatcagtcaatcgtttgctgagctgtttatcttctaaaacggcaagcgctttttcagatgccgcctgaatatcgccgacttccaccagaaaaccgcttacttgatctttaatcacttccgggatgccgccgatatttgttccgatgcacggcacgccgcaggccatcgcctcaaggaggacgagtccgaaactttctttttcagacagaagaagcttaagatcgctgatggaatacagctcttccaccctgtcctgatttccgaggagcagcacttgatcctgcagtccgtatttttcgacaagctgccaagcgacgcacttttccggcccgtcaccgacaagcaggagcttcgcctttgtgttggctgcgatattacggaaaacgcggatgacatctttaacacgttttacttttctgaagttcgaaacatggatgacgaccttttcatccggcaaaataccatgtttctcttttatactctctgtatttttcttaagataaacacgttcatcaataaagttgtagatggtctcaatttttttatccggcttgattaagtcatatgtttctccggcaagcgcggttgataccgccgtcactctgtcggacgcttcgatggcaaaacggattaaatcttttaatgacggatcatatcctaaaacggtgatgtctgtaccgtgaagcgtcgtcacgatcccgatgtcacgcttgagcatttgtttggctagataagcgcataccgcatgcggcagcgcataatgcgcgtgaatgatatcaagattttccctcgcggccacctcggcgattttgctcgccagcgtaaggtcataaggcggatgtttaaataccgcgtattggttgacttccacctcatgaaaatgaatattcggatgatatgtatttaatctgaacgggatgcttgatgtgatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaagccttcagcataccccgtcccggcttctttgccatacagtctttcccgcgcttccaccatttcgatataaccgttggtcagcggtgtgttcactgactgcgccgtaggaataaactggctttgataggcgtgcaggctttcttttttcagatcgatggtttccgttatgtcgattacaaagtccggacggtgaaacccgttgatcatataatagtatacgcgctgagccttatgagccggcagttcctgatgatctctgtatttatgaattcccgccgagaacaccgcctcttcgaccaaagccgccgcattgccgtggtcaggatggcggtctttcggataaggcatgaaaacggttttcggccgacaggctctgatgacactgacaatccggcggatgccgtcctcacttttcaaaagcccgcggtcgggaagcgtaagctggattctctcttttacgccgagaattcgtgccgcctctgccgcttcttcttttcttatccctaccgttccgttagatgatagttcggcctcggtcaaatcgcatatcaccgcggtttttccttgagccgtaaattttgcgatcgtgccgcccataccgatctcgacatcatcactatgggcgccgaacgccaggatatcaacgtgttcagacattcggctctcctccgcgcacaagattgcggaaatcaaatgccccgccgtccagcgtccggacgaggatttccgctgttcccatatttgtggcgagcgggatcgcgtatacgtcacacagccggatcagcgcggagacatccggttcgtgaggctgcgcagttaacggatcgcgcagaaaaatgacgagatccagggcgtttgccgcaatcaatgcgccgatttgctgatctccgccgagcgggccggattgaaaacgttcaacggacaatccggtcgcttcctggatttttaagcctgtcgtacccgtcgcgtataactcatgatggctcaatatatctttatatgcggtcgtaaactgaaccatatcctgcttttttttatcgtgagcaatcaaagcaattttcatttgatgttctcccccttgccgattcagtcgataatattttcgagtccgtatacaagctggtcgattttcatcacttgctccactgacagcttcactcctgacataaaggaagcccggttataggagtcatggcgcagtttcagcgtttggccgtccatgccgaacatgacttcctggtgggcgataaggcccggcagacgcacgctgtgaaggcggatgccgtttaattcagcaccgcgggcgcccggcagaatttctttttcatcaggatggccctgctgcttttctgtacggacgcttgaaatcatttccgctgttttcagcgccgttccgctcggggcatccagcttttgatcatgatgaagctcaatgatttctacatcttcaaaatagttggcggccatttgtgagaacttcatcatcagcaccgcgcccaatgcaaaattcggagcgatgatggcgccgattcctttttcttcagtcaaggcttgaagctcctctaaatccgcttcagaaaatccggtcgttcccacaacggggcggacgccgtgttcaagagcggctttcgtatgttttttgccgatttcaggcgttgtcaaatcgatcagcacatccggttttgtttcttggaaacatgcgcggatatccgtataaataagagcgtctgaatcagctgacatcacttcccgtaatgtttgctgatcgtatgtatggtcaatggcgccgacaagctcaaaatgaggcgtgcggacggcaagttttacggcctcctggcccattctgcctctcggtccggcaatgacgactttaatggtttcatttgacatggtttctcctactttccttcttcttttctagtccagcggtctttatcacgtgtattaaatttatgcatgacgcggttatgagcttcctccaatgaaatatcaagggagttggcgaggcagatcagaacgaacagcacatcgcccatttcctcttccatgcttttctcattttccgtcgttttcttcggcttttccccataataatggttgacttctcttgcaagttcgcccagttcttccgtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatcttatggaaggaaaaggggtttgatgcaatgcttggagaaatcagaatcaaaaacatttgctttattttaatcggcgccgctgttttttcattcggactggttcactttaatatgcagaacaatttggcggaaggcggatttaccggcattacgctgcttttatatgcgttattccacatcagcccttctatttccaacctggtattaaacattcctatctttttcatcggctggcgtatgctcggccggacgatgtttgtctataccctgatcggcaccgtctctctttccgtttttctgagtgtttttcagcgctacgaaattcatatgccgctgtcgcatgatttagcgctggccgccttgttcgccggtgtatttatcggcgcgggtctcggcattatttttaaatacggcggcacgacgggcggggtcgatatcatcgctcggctgatcaacaaatttttcggaatcccgatgggccggacgatgtttgcctttgacgcctgtgtcattctgctttctttgtttacgtatctttcttacaaggaagcgatgtacacgcttgtagccgtttttgtcgctgcgaggttgattgattttatacaggaaggcggctatgctgcaaaaggggcaacgattatttcttcgaaaaacgatttgatccagcaaaaaatcattgaagagatggagcgcggcgtcaccgttttaaaaggacagggatcatatacaaaagaagacagggacgttctttactgcgtcgttccgaaaaacgaaattgtgcttttgaaaagcgtcatcacttccgttgacccgcatgcctttgttgcagtaagcgacgtccatgatgtgctcggcgaaggatttacgcttgatgaaaataaaaatccgatcagacgataataaaaaggcggcttttgccgcctttactgttcgtgtttccatttgacaaccggtgattttttctttttcaatcggcgggcgaatgccggactgacattgagcgtctgctcgacgaagcgctgcggcgtcagtgccagccattggtttaaggagacgtcttcgaaacggtcgcttttgaagatttccagaaagcgaagcacggtgtcaccggtattctgaacataatgtcccattgcaaaaggaacatatcctacgtcacccgcttgatagttaaatgtccgcgctcttccctccgccgcaaacaccgtcattttcgcttctcctgaaaggtaatactgccactcgtccgtattcgggtgccaatgcaattctctcatgcctccgggttcgacctccacaagagctgcagcaatcgtttttgacaccttaaacgtttttgaatcgacaatctttactcttcccccgctggtaacaagaggctcctgccgggaaagcttgtagctgaacggctccaaaacggggccttccggggaagagactgctgcccgctcaattgggggcggcgcttccaactggaacatataacgctctttcttgtgaatgtaagccagctcataacccggaacaccgaagttcgcctccagcacgctgcgcggggtgtgggcaaaccagtccgttactgaaaaggtgctgttttctgagaaagagccgtcatcaaagacgagcaaaaactcacttccctgctctaacccttgaatggaatgaggaatgccggaaggaaaataccacaggtccccttcacttacgttatcaataaaattccgcccattttgatcgaccgcagttaaacgtactcctccgttaatcacatatccccattcggcttctttatgccaatgaagctcccgcacagctcccggtttcagcctcatgttcaccgccgcgatgtttttggataccggcagttccctgaccgtcacctctctggaccatccgccgtcttcaagcctcatatgcgtatcagaaaatgagaatttcaagttttgaaccgttcctgcatccgttgaaggcggaacgagcatgtcaggattctggaagtcacgcgcgaggtttcgcggtccttcgtcagtcgccccttttctgcctctgatcggctgcgggaggtgttttgaagccaattgctggatgagttttttcactgacttagctcctttacagcaatttgtgtttatttagacttaggatactcacgctttttctctttctttttttccgctctgtattttcggtagccgacatatgtcagcgcagtaataatgataccgcctgttgtcagaatgacccagagcagcgaagggtcagcgtcatcccgctccaccttgtcaaaaacccgctttaaatcctgctgcaggagcgtcagacgctcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaatttccacttccgtttccgctgacatcttcttttaaggcgctgaatgtcgccataatcggtctttcaagcgaaccccacagcggatcggagtggtcttccatcgcatccattaccaacctgaactgggcggctgcccggattttttcggtatctgaggcgtctgcctgtttcaggacgcgcactaaatcattgaagcccagagtcacctgcctgacttcggcgccgctcagtgagtttacgtgtgtcatttttttcttaaagtagccaagcacttgcagagcctcatcatactgcgaatgccgcgtcatttggaaaacggtatccgaaaggtcgttcagttccttgagaccgccctcatcttcagctttggcagttgtgatgaaacacataagagcaagtaaaagacagatcgtcagctttcgtttcatagaggtccctcccactccttctctttacagaatatgaggagcgggacaaggttagaccaagattctatcagtgtaagtcaagctttatccgtcttttagaaatcaccaaatagtatgcaaggccgagtgaaaatatgctcagccagaatgtagcatagccgatctcttgcatatagtcattgagcattgagtagcggggcatcatgccgaaaagataatcaatgacgtcattatgaagcgtccaaacagcggcaacggcaagatgccataaccggaaccgaaaatacgggctgtataaaacgccttgaacggccatggcaaaatgtgaagcaatcagcatgtacccttcccaaggcatctgccccattttgaccagcacaaagacattcattccgaccgcccacagcccgtattttacaagggttacaagagccagcgcttcaaacagcggcgcgtttcttcccatgagaaatgccagaagcacgaacaggaagaaaaatgtcgccgtcgggctgtcaggcacaaatatcagaaatcggaacggcgtgtccgcaagctgcggcacataccaataatagccgtacaccgtaccgataaaattaacggcaagaacaagcagaagcatgccgcgcaaccctaaaagataagaaatccacctcataccatcaactctcagtccgtaaaaagtgtgtatcatgcaaaaaaagctgacatccggtcagctcttttcataaagtatatcctgctgttgtctacttcacaatacgttatttcgctgtcgtttcagaaatgaacttcgccagctgatcaagctgtttgtcattccctttaaaaataccggctggcatctgccctttccctttgacggcgatttttttaatttcttccgggctcagcccgttatcgaccagggacggaccggcgcctcccccttgaagattatccccgtgacaggaaatacagccttgttctttaaataccttataaccgtctgattcagtatcaatggcggcttcttttttaattttcccttgctcctccgccttcgcccagtcatgtgtcgcgactgactgccacgttaaaaagaccgtagcgcaaagcgccaaaagcatcatcccgacagcaaccggacgcttccacggccttctttcagaccccctgtcgagaaacggagccaaaagcagcgacccgaaggcaagccccggtataatcatcgctccgataacggtgtagctccctgcggcatattcatattttaaaagctggtataaaaatagaaaataccaatccggcagcggaatataccctgtatccgtaggatccgccacccgttccaaaggcggctcgtgcacaatcgttaaaacgagaaacccgacgaggaaaacggccccgaccatccattctttcagcagaaagttcggccaaaacgcctctgtctttccaggatactctgaatagtctttcggtatattcggttttttttctgccggtatccttgaatctcctacaaacttcattcctttcccccggtgcatgtcatcccctcccttttatatcagatttgtattatagcggtcctgaaattccctgcttgcggatcataacaaagtgggcgcccatgagcgcaaacaaagcggcagggagaaaaaatacgtgaatcgcaaaaaatctcgtcagcgtttgggcgccgacaatatcgtggtggccggcaagaagagttttcacctgtgctccgatcaatggcgtcgcctccgcaatctgaagacctacctttgtcgcaaacagcgccttcatatcccacggaagcaaataccctgtaaaaccgagaccgagcatcacaaaaaagatcagaacaccgacgatccagttcaattcccgaggctttttataagctccctgaaagaaaacccgcagcgtatgtaaaaacatcatcacgatgactaaacttgcgccccaatggtgcataccccttacaatctgcccgaaagcgacttcattctgcaaataatacacagattcccacgcgttttttatatccggcacataatacatcgttaaaaacatcccggagagcacttggataacggttacaaaaaacgtcaaaccgccgaaacaatagacaaaagccgagaaatggtgagcgggatttacatgttccggcacttcatggtcggcgatatcccgccacatcggcgtaatatcgagacgttcatccacccagtcataaattttattcagcatgtcacccttcccccctaggctttgcttttccaagatacaaaaagccgtcctttactttttgctcataacggtcaagaggcgcgagcggcggcgtacccggaacgttcgtgccgtctttttcgtacagcccgtaatggcagggacaaaagaatttgttcggatttttaggatcattgttccagtttacggtgcagcccaaatgcttgcagatcggagaaagcgctataatttcatccccatgcttgtaaacccaggctgacctggattcttccgattcgtaccaggcgtcgacttgatgaattttaaagtcaaaccgcttcggctccttcgtcagctcatccacactgacaacctgcaccattttttgatctcccgtcggttttaataccggatccagcgcaaaacggaccataggcataagcgcactggcggccataaatccccccacgccggtgagcgcatagtttaaaaattgtcttcttgatatatcttgttttccgcccatctcttccccccctaaagattgaccaaaaattaactaaaatagaaaataattctgagatttgacaccctcataatatatgaatctttcagcaaggtcaacagaggcaaaacgggtgttttgcaggatacctggagtttttaagaattgttccacttctgtaacaaaacgttcaaaatttctccgcacttgtcatccgcaatttttctctttaaagagtctttcatatgttcaaacggaacgccaggtatgtatatgacatcagaccctatttcagaatccttccatttttcgtctgccgtcaggaacaaggcgtgccggaagttggtcatcacctcttctttgagtttttgaagcagggcgatttgtgattggtctatatcaacatatgtataagaggggaataaatatacccgtcccttcaattggcgctcaagctcttcagaaagcaattgggtgctttccccctgttcaacggcctcttttaagcctcctgaagacgttatggaaattaacggaatgacagcggtatcaatgtaatccgcagattgtaaataggcatcggcatcagcggccctccatctcatgtctcgttcctcctctttacgcaacaagccttgcatattctgcaaggctgtcatttatgtgagctgattcaattggcgggaaagcttttcaaatgtttctttgtcgtggcggtccagcgcctcgtcgatatctttaagcagcttttcccgctggaaagtggaaatggcatgttctaatattttttcagccatcccctgatcctgtttattttcaaacaggtctttcggcagatgcggatttgattcaagaacagcggcatattccggtgagctgtaggccgaacggaaattcagctggataaataaatcctgctgtttatttaaccggatgtcgtgaaaagatttttccgcgtccgtagtcatgacattttctttgtaaaacctaaacggcacctcatcaacgcaatgagtagacatgataatgcctctcgggcaaaattcggcttgttctacaaaatggactttttccattaatgaatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatcttaaaaattcatcctctatccgtaagattgtttcttcaagctcttcgtttgttccatccattgaaagcacttgttttaaaagcggcagcgcttctttctggagaccctcttccaataagaagttagcgtattcatataagaaatcccgatcatcctgataatggagatacgcagcttcgaagctttttttcgcttcagcgtattgctccaggcctgtataggcccccgccaaataccaattgtatttcggatcttcttctccgtagccgcggacttcctgaatcagatcaataatctcttcaaagctttcttctttatgatagacggctaaaagcgtgtggagcgcttccacgtaacccggatcgagcgccagcgcttcctgaagaagctttttgccttcctcttcgctgccgagctttaacgccattttcgccgcatagagaaaaagctctttattgtattcatcgtaagtaataccttctttagcggtttttaatgcatcttcatacatgccttctgcctcgtagctttttgcaagcggcatataaagcgatgaataggaaggatcaagcccttttaaatcagacagctgcttgatggctgttttgaccattcccgcctgataggctgtgaacccgtacccgaaaatcgtattcggttctgtatgttctgccgccgctttttcataccatgaaatcgcttcctcaaattcacccgccgcgctcaatgactcagccagcctctgatgaacatttacgccgccgatttcgtgccgttcttttgccgtctcttcatagtaaggaacggcttttgcatatgatccctgagtgaagtataattcccccagagcgaaatcaataacaggttcatcttgtaacatcgctttcgcctgtaacagcttttgttcacttacttcaaataagccctgcatctgatacagatcagccgttaaaaggaggctttctgcgtaagacgggtcttccggagaaatcgtctccagcacctcaagagctttttcttcttcatcaatatctattaacaattcggcgtaaaaattcgtcagctcagactcatccggatagaggtcatgcagatcactgatcagcgctaatgctttttcggcgtttccccattcatagtagagctgggctgcaatggctttgtcttcgtcatgaagttctgtttcagcttttgaaagcgctttgagtcccttttcggtttcacctgcttcaactaattttatggcttcttgaatcaatgtattcaaatcagaccggtcctttcttttcctatacctcatcaaccaaatgaaaagggtttttattcgggttattcttatcataattcagacagggcctgcccgcaaataagatgcttcacccggcattatagtttatcagaaaatggttaagaggaaaacggcaaaaaaggagacggcatctttatacgcaaacagcgcaatttgttccggctgtttctgtaacgaaaacgcattccccctttcttttagttttctgtttaagacaagctatgtcaaagcccaagattttatgacacatgaagaaaaaagcccgaagaatcgtcttcaggcttttttggctaattgatctaaatgctcaaagaatgtcggatatgagacatggatcgcctctgtatcacggatgtcgatcggctcttctgtcaggcatgaagcgataccgagcatcatgccgatgcggtggtcgccgtggcttgacacatcggctccgcccgcaagcgtttttttgccgtgtattttcatgccgtcttcagtcggttcaatgtctgcgccgattttccggagctctgatacgacggtgtcgatccggttcgtttccttcaccttcagctccgcagcgtctttaatgacagttgtgccttcagcctgcgttgccaaaagggcgataatcgggatctcgtcaattaaacggggaatgatttctccgccgatttctgccgctttcagagctgaggtttcaataaccaggtctccgtaaggctccgcactgtccgcttctgaaggaatcacttcaagtgaagcccccatttgctttaagacatcaatcattcccgtgcgtgtcgggttcaggccgacgtttttcagcacaatccggcttccgggaacgacagcgcctgccgcgaggaaaaaggccgctgaagaaatatcgccgggcacgaaaatatcggctccccgaagcttctgaccgcccgttacggaagcgctcgtctccgtttccgcaagctcggcgccaaaagcgttcagcatccgttccgtatggtctcttgatttatgaggctcagtgacggtcgtcgtcccttcagcctgcaatccggcaagcagcacggcagatttgatctgcgcgcttgcaacaggggagacgtaatctatgcctttcaattgtccgcctcttacggataaaggcgtaaaccctccgtccgctcttccgtcaatcgcggctcccatctgttttaaaggctccgtcaccctcttcatcgggcgctttgcaatactttcgtcacccgctaccgtactgtgaaatgggcgtccggctaaaatgccgagcatcaggcggatggtcgtgccggaatttccgacatcaagaaggctgtcaggctcacaaagtgcgtcaatgccctttccgtatatcgttacatcacttccgttttgttcaatggagacacccatttttctgaagcaggcaatggtgctcagacaatcggctccgggcaaaaagttttttaccgttgtcgttccttccgcaagcgctccgaacataacagaacggtgggagatggatttatcccccggaatatgaatttcaccgtttaaagacgtcactttttctcttttcaatgttttccacctcagtcagcgtaaaatgtgtcatatttggcgcgggattgaatgcaggtttccgcgcgcttccggtcatcatcagtctggaaactgattctgagaattccgttaatatcttctcttgtttcgataatgcggatgttggtgatactgattttttcttctgccagtatcgccgtaatttccgaaatgacccccggatgatcgggaacatcgacataaaggtcataaaaggacgggatcgctcctttttgacggagcggcaggccgtcgcgataatctttcgcttttttaaaatatccgaacaggctgtccgcatcttcattttctacataagattcgatcgtgtcaatctcccgtttccattctttgaagcggtcaagcagtttatctttgttatgaagaagtatgtctctccacatcgccggactgcttgaggcgattctggtgatgtcccgaaaaccgccggctgcgaaacgcttcaaaaacggataattttcttcagaatgatgagcctgatggacgaggcttgcagcaacgatatgagggaaatggctgatgacgctcgttacgccgtcatgctcctcgggagtcatctccacaaagtgggcgtttgccgctttcaaaagctccttcagatgcgttactgactctttagaagttgattttccgggtgttaaaatgtaaaacgcattttcgaataaaaattctttggcggcagcggccccggatttatgagaccccgccatcggatggccgccgacaaattgataatgagccggaagcactttgtcggcgtagctgacgactttctgtttcgtgctgcccacatccgtaatcaggagttcatgggtgatgtctgatgcggccagcatatcgagcattttcagcgtttgggcgacaggcgtggcgataatgacaacagacgcttgctgcgccccttccgtcaatgagccggcccgctcgtcaataattccgagcttcagcgcggcagtgagctgttcttccgaaatatccacaccgataatccgtttatgcggatgctcctttttgatggccaatgcgatcgatccgccgatcagcccgatccccgcaagcaatatagtatccttcatttcactcatttcctttttcaactattttaatagagcaaagaggtgatgcttgatcacctcttataatatttcagctaagattgtgagaatttcctcattctgctctttcgtaccgaccgtaatccttaacgctgtcggaaatccgagcgcctgtcctgagcggacgatatatcctttttccaacagagcttggaacagttcatccgccggacggttaaaatcaatgagcacaaagttggtttgtgaaggataacaagttaatccgtgagtttccgcaaaatcataatactgcttgaggccggctttatttttctcgacgcattcctgaataaatgtctggtcgtcaagcgctgccagtgccgaagcctgaccgattctgctcgtattgaacggctctctcgccggttcaatctggcggatcagcgcttcgtccgcaatgccgtatccgacacgcagcgcggcaagtccgtacgctttagagaaggtgcggaggatcatgacattcggatattgctttaaaagcggaatgctttcagggtaatcgtccgccgtaacatactcgtagtacgcttcatcaagtacaacgagtatatgctcggggactctgtttaaaaaggcaattagctcttgctcagaagtatatgtccccgtcggattattggggttgcatacccatatgactttcgtctcgccgtcaattgcttccagcatccggtccaaatcatgagcgccgtcactgcggagcggcacctcgcgcacctcagcgccttcaatcaccgcattgtgtctgtattgcgggaaagtcggggcggcggtaatcgtgtttgcctgatcatttaataaagaacggcagataatctgcactagctcatcagagccgttgccgaaaatgatcgaagattcactgacctgcagatgctcactgagccgcgttctcaaagcggcactgtaaccgtcgggatacagcgcaagctgctcaatctcctgatgcagcgcatcttttgcggcctgtgaacagccgaacggattttcgttagaagcgagttttactactttttcaagcccgtattccattttcacttcttctattggtttgcccggctgatacggtttcagctgccgcagctgttctttaatctgcaaatccagtcacctcattttacactgtacagtcgtccgaacgtcttcgcgtattcttcaaattcaagaagcgcatcagctcttgtgccgggattcacaagctttgttttaagctcttcaacttttttgacaagcgcgctgccgacaacgacaccgtcagatatttcattcatcccgtcaacctgtttgcggtttgaaatgccaaaaccgaccgccaccggaacagagctgaattctttcaccttacggatgaaagagtatacagacggatcgaattcgctgcgtacgcccgtcactcctaaagaggatacacaatacacaaagccgcaggcctgttcagtaattattttcaaacggtcttcacttgtcggcgcaaccagcgagatataagcgatgttctcctttttgcatgtcatttgcaaaagggcgctttcctctaatggaaggtcgggtacaagcaggccgtctatgtcgttttcccgcagtaaagcgaaaaagtattctttttctaattgtaacacaggattataatacgtaaagaggataattggaatatgaacgccgttttttttcattttgccgccaagttcaatggcttttacgatattcattccgttttccagagcccgttttgaagcccgttgtatgacgggtccgtccgcaagcggatctgtgtaaggaacgccgatttcaagggcagaagcgcctgcattctgtaatgatattgccagttcaacagaaatgtcaggaagcggatcgcccgctgtgataaaagggataaacaatttttcagaatctcgcagattaaacatgtgtctccaccccgttttccaaaacattcatcagcgtatgaacatctttatctcctcttcccgacaaactgacgagaatgattttgtctttatccatgtcctttgccatttcgaacgcttttgccagggcgtgggcagattcaatagccggaagaataccttctgtttcagaaagcagacgtaacgcggcaatcgcttcatcgtctgtcacgctttcgtacgttacacggccgcttttgtgcagataggcgtgctcagggccgatccccgggtaatcaaggcctgctgaaatggaatacggttcgataatctgcccgtattcatcttgtattaaataggtcattgatccgtgaatcaccccgagcgtcccttttgcgatcgttgccgcatgcagcggcgtatcaatcccttttccggccgcctcggcgccgatcagctcaatgtcttcgtctaaaaaggcctgaaatatgcccatcgcattgcttccgccgccgacacatgcaacaaccttgtccgggagcgttccttcaacccggcggagctgttctttcgcttcctcgccgatgattttctgaaattcgcgaacgatatacggatatgggtgcggacccactacagaaccgataagatagaaatgatcttcacaatgctggacccaatacctgattgcctcattcgtcgcatctttcagcgtgccgttgccgcttgtgaccggcaccacttccgcgccgagcagtttcatccggaatacgttcagcgactggcgcgcaacgtcttcttcacccataaaaaccgtacatttaaaaccgaattttgcggcggctgtcgcggcagccacaccgtgctgtcccgcaccggtttcggcgatgattttcgttttgcccatctttttagcaagcagaatctggcctaacgcgttgttaattttatgagagccggtatggtttaaatcttctcttttcagatagattttcgcccctcccaaatactctgacaccctgtctgcgaacgttaatgcagtcggtcttccggagtaatcaaacaatagttttttatattcggcatgaaaaacaggatcattttttaattctgtgaaagccgtttcgatttcctcaaggggccgcatcaatgtttcagggacaaatttgccgccgaattcgccgtatcttccgatttcatttggatatggatacatagtggttcatcctttcttctaaaagccggatcagtgtttgatccttgtgtccgtttttttcaattccgctggcaagatctataccgcacggacgcgatctcagtaagccggtaatcgtttcaggattaacaccgcccgcaataaaacagcgcttgcttgcattttgagcctgctttcggtacaaggggacacgggcccatgaaaacgcgattcccgttccgcctctcattcctgtcactgaagaatcaatgacatagccgtcgacagcaggtgtaaattgagccatctgacggagcgtcccttccccgtgatggagcgctttccatatttccgagcgcacaagcggacggaggcgaagggcatcctcaggcgattcatcaccgtgaagctggatgacgtcaagtgccagatcagatgcgatttgcgcgatgttttctatcgtttcatttacaaatactccgacatgtttcttgtctgtccggacctgctctttccatttccggacctcatccggcgttactctccgtttgcttgcggcaaaaataaatcccagataatccgcttctgaagctgccgcaagttcataatcacgcttcgatcgtattccgcagtactttaactcaggctttttcatatcgtcactctccgaacagtccgcggatcgccttttgctgcgaatcctctctcattaaggattctccgaccaatacagcctgcgccccgtgcttgttgacgaattgcaggtcagccaaagaaccgatgccgctttcgctgaccagcaggcagccgtccggcacaagctgcgctattttttccgtttgcgaaacagaagtacggaacgtttttaagtcccggttgtttatgccgagaatgtccggctgaaacacttgtaaaatccgttcaagcacagtttcatcatggacttcaacgagaacgtccatgcccttcccgcaggcttccagataaagctcatgaagctttgaaggttccagcgcttccccgatcagcaaaatggcatcggcgccgatcctgaacgattcctccacctgaagggaatcaataataaaatcttttctcagcacgggaagagacacggtttgtttaacatctgtcagaaattgatttctcccctgaaaaaaacgggaatccgtgagaaccgaaagggcgtcggctttagccgcttcataatccgccgcaatcgtttccggaacaaaatgctctttaatcaatcctttagacggcgaagcttttttcacttcggcaatcagcccgataaaacggttcgggttcaggagcgcttctttaaaggatctccgttcaatttgacaggtttccggcagcacgatggatttgatttcttcttttttctgcagaatgatttgatcaagcatacatttcttcctctttctgtttcagacgttcgagctgccttttggcatctccgttttgaatcgcttctaaggctgttttcgttccttctttcagatcgtttgcaagacctgccgtataaatggccgcgcccgcatttaaggcggtaatatgcagtgcggatgacggagctctatttgcaaaaatattctgaatgagaagcgcgctttcttctgatgaactcacttgaatatccttcaatgaaccttctgcaaaaccgaattgttcaggtgaaacggaatattccagacgttcaccgtttttcagctcaatgatatcggtcggtgctgtgatggacagttcatctaatccgtcacgcgccgacacaagcatgacgtgtctgacatcaaattgttccaaagcgcttgccatcaggcgcgctttatcaaatgaatagacgccgatcacctgccgcttcacctgcagcgggttgctgagcgggcccagcagattaaatacggttcggaagccaagctcttttcttgcggcggcgacgtgcttcattgacgaatgaaacagcggcgcaaacaaaaaccccatttgtttcatttcaatgctgcgtttgacgctttctggagtggcttgaatggaaacccccagcttttccagcacatccgcgctgccgcttttagacgaaacggagcgatttccgtgcttggcaactttagctccggcggcagaagctgtaatcgccgctgccgtggatatgttaaacgtagaaatcccgtctccgcctgttccgcacgtatcaacgacatccgccaagccacccgccgtctgtgcccgcgcccgcatcacttttaaaaatccggcaagctcctccgccgtttcaccccggtgggctaataccgataaaatccccccgatctcagactgcgacatggccccgttcatcatcatctccatcagcttttcggcttctccggttttcagcgtgcggccattaacgcacgattgcagaaatttgttcatccgtcttctcctccccgccagaaaagatgtcttctgcgatttgaatcgtttttaaaagcgcccccgctttgttacagctctcttcatattcggcttccgggacggaatcagcgactattcccgcgcccgcctgcaccgacgccgtaccgtttttgacactcatggtgcggatggtgatacacgaatcaattgacccgtcaaatccgatataagcgatacatccgccgtaggtttctctggaagtcggttctaattcatttaaaagctgcatcgcgcggattttcggagcgcccgagagtgttcctgccgggaatgccgacatcagcgcatcaaccggatggacgccctgttttaaacggccggttacaacagagatgatgtgcatcacatgtgaaaaagaaacgacctttgtgaattccggaacggctacggaaccgtactccgcaactctgccgatgtcattgcgcgcaagatcgacgagcatataatgttcagctttctctttttcgtcattcatcagctcttttttgaggcgatcgtcctcttcttttccggcgccccttcttctcgttccggcaatcggatgaatttccaggtgtctgtcatccacgcggatcagacgttcaggcgaacttccgacaatgtctctgtcaggcagtttgatatagtacatataaggtgaaggattgacgatgcggagcaccctgtacagctcaaatgaatgtctggataccggaatgtcaaacttttgcgaaagcaccccttgaaaaatgtctccggcttttatatattctttcagtttatcgacgccggccataaactcttctttcgtataattggatgtcacatcggcaaaacttggcgtttcaaatgtttctttagaaaaaaacggctctttcatatctttcggttctgtcaaaataccgataagcttacgaagctccgcgcaattttctttaaaaacggcccgcttttcttcctccgtctcccggccgttaagcgccgcatattgaatgaaatgcacttgtttcgtttcgtggtcgtacgcgatgattttccggcagacaaacagcatgcatttttcgaaatctgtttctttcgcgtggctcggcacggaaggctcaatcaaagggatcatgtcatagctcagataaccgacggcccctcccgaaaacgggatatcaagctcgggtgttttaatgcggaagctttcattcatccaatcaagcacggcttttaattctccggcttcaaacagcgtatgcccgtttggatcagcggcagtgaatgtgtgatgactctctttaatcgtgataaaaggatcgaggccgataaaagagtatctcgaccagcttgacgactcatccttgctttctaaaagatacgtaatgtttctgtccagtttttcaaccatctgaatgggtgtgatcgtgtcgaccgtaaaagtctctgcgattggaatggtgcggtgtgtcagactgtcctttaaaaataaagaaacatccgattgtaaattcatgattctcctccttacggtaaggagaatgagatgaagagtgagaggagtcttgcgtataagaaataaacccaaaagaaaggcttcttttgggcagaataaaaacgtgtttatctcagctcagctaaactcattctctgctaccctattctaaactcaactgttcaatatcttacttaccagctctatacacactcttgtgtatttctaagctttgtttatcgtattacatgtcagtattttttgtcaatgataaatccggccttaacacaacggctttttctagatagacatgcttgatttcatcctgaggcgtatccgtctgaaccgtcatcaggacacggatacacttttgcagagcgccggtgacatccatttcctgcatgcacgtcaccgggacgtactgccacccggaaagacggcggaccgcttttgccggaaatacggaatggatatcaggcgtggcggataacaggatctgtacaacgtcttccggtttgcatccattttgttcaatgattttttcaagcagctgctgtgttttttctaaaatttcttgttcggtgtcttgttccaccgttgttgctccgcgaataccgcgtatcatcatgctgtttcctccattcgccatttgttcagcaaattttcgagctcatcttttgaaagcatgcagtcccgcgcttcgcctaattcctttaacacgatgaactgtgtcatgcctccgcgcgtttttttatcattcatcatccgggcggagagaaccggcgtttcaatatcttgtctgatacttcccgggtagccgagcccaatcagccattgtgtgagttctttcctgttcatcttgcaacccgcaacctgttcactcacgtaaagggcaaactgcatgccgagggcgaccgcatctccatgagtaatccggccgtagccgtattccgcctcaacggcatggccgagcgtatggccgaaattcagaaaagctcttatgccctcttccttttcgtcctcacgcacgacggccgatttgattgaaattcctttataaatcatttcattcagctcagcgcttgtcagtccttgcaacgtgtcaaacgtgagaagtttttctaaaaaagcatgatcggcgataaacgcgtgtttgatcacttcagccatgcccgatctcagctcttgttccggcagggttttcagaagctccgtatcgtaaatcaccgctttcggctgataaaacgcgccgattaagttctttccgagtttatggttgacggccaccttgccgccgaccgcgctgtcatgggcaagcagtgtcgtcggcatttggatgaaatcaattccgcgcataaaagtcgctgcgcaaaagccggccaaatcacccgtcacgccgcctccgaaggcgatcatacatgaagagcggtccatatggaaagcgatcgcttccgtttgaatccgttcatactcttttagagacttcgcttcttctccgcttggaacgattacttttttcacgggccatgtttcgtttaaaagccggaacatctcatcgccgtaaagccggtcaacttcagcatcgatgacgagaaggatctttgtcagcggcctgttcagtgaagacaaaagagcagcggcctgtttccttatgccttcaccgatatacacgggatatgcggaggaagctgtccgaacctcaagctctttcatcagaattccctcgatagttttttcatgttttcaacattttctttaatgcggtcgatctggtcaagcccgaattgttctacgacggcatttgcgatttcccaggccactgcagcttcagccactacgcttgctgccggaaccgcgcagctgtctgaacgttcaatgctcgctgtaaacggttctttcgtttcaatgtcgacgcttttcagcggcttatacaaagtagggatcggtttcatgacgccgcggacgacaatcggcattcccgtcgtcataccgccttctaatcctccgagcctgtttgtggcgcgtgtatagcctttctcttcatcccatacgatttcatcatgaacttcactgccgtttttgccggccgcttcaaaaccgatgccgaactctacgcctttaaacgcgttaatcgacagaacggctgcagcgagcttgctgtccagcttacggtcatagtggacataacttccgacaccgacaggcataccttcgacgatcacttcaacgattccgccgatcgagtcgccgtttgccttcgcttcatcaatggctgccatcatttgacggcctgcttcttcatcgtagcatctcaccggtgattcttccgttacccgtttgagatcctcaatggatgtgtaatcggttttctctgcttttacgctgccgatttgcaggacgtgtccggcgactttaatgccaagctccgctaaaatctttttagcgacggctccggcagccacgcgaaccgttgtctcacgcgcggaagatcgttctaacacatttctcatatcgcggtgattatacttaatagccccgttcaaatctgcgtgtcccggtctcggtcttgaaatctgacgtttcatttcactttcttcttcttctgtaatcggtgctgcgcccatgatttttgtccagtgagtccaatctttattctctacaacgagcgcgatgggtgaaccgagtgtccgggcatgccgcacgccgcttgtgatcttcgctctgtccgtttcaatctgcatgcggcgtccgcggccgtgccctttttgacgtctggcaagctcaaaattaatgtcttcttcagttatataaagccccgcaggcacaccttctataattgtcgtcagctgcgggccgtgtgattctccggctgttaagtatctcatttctttcttctcccttcatcgcattaacgcttttaagtaaaactataccacaagttttcattaaatgtcttctatcttttttgataaaaaaatgtatcagtgctctcaaggccgaatttttccgggctgaaaatctgctctgtgcttccgacaaacagaattccgttctttttcaggctgcccgccatttttacatacagctcttcttttgctttttcagtaaaataaataaagacgttgcggcagacgatcagatcaaaatcctgttcatagctgtcggcgagcaggttgtgccgcttaaaccggatgtttttttgaatctcttgttttacttgataactgttgtcagcctgcttggtgaaataacggcttttcacggaagccggcacctcttgcagcgagcgttcctgatagatgccccgcttggctttgccaagcgccttttcatcaatatctgtcgccaatatatcaaatccggccaaacccgcctgctgactgagaatcatagccaaagtatagggttcctcccccgttgaacaggccgcactccatatttttaacggtttgttatgctttattaacggaagaattgaggtttcaagaacttcccaccgtttataatttcggtaaaattcagaaacattgatcgtcatcctgtccaatgtttcatttaataaaagcttgtctttctccaaagcggcggcaaattcctgaaaatctttgaatccctttttttcataaagggacgtcagccgtcttttcatctgtgcttctttgtataaagataaatcaacgccggttatttgtttccacttggtgataaaaatttcgtaaggctccattgcttctctcccaatctcgctgtcttttgtcctagtatagcctgttttctttctaatttgtacgatttcaataaaaaaatcagcccgcaggctgatttgtgagaaatgaaaagacagggcagcgcagcctctgtcttttttaaaatatgtaaaccttttcataacaagagaaaaagaaaggctgacggcttagtacacccagtcggccattaatttttgatacggtacaagctcttcctgtttgaagaaaatgtcaatttcccgctcagcgctttctaaggagtctgaaccgtgaatgatatttttgccgacaaacatgccgtagtcaccgcggatcgtgcccggcagtgcatctttcgggttcgtttttccgatcagctgtcttgtgatctctactacattttccccttcccataccattgcaaatacgggtcctgatgtaatgaattccacaagctcgccgaaaaacggcttccctttatgttcagcataatggttttcagccatctgttctgaaacttgcattagcttggctcctgccaattgtaagcccttacgctcaaatctggataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaaggaatttaaaatttccgtttgccgatatatttggcgatggcggccaatgatgagcgcgcccgtcctctcggcagtgtattcagtttttcaaacgctttttttaagtacctgtcactgacggccattgatttttcaattgcgtctgtgcgtttaatattttcaataatgggggcgagctgctcctgtgttgtttcactgttaattaatttcagctgatttttcaattcaggctgacggagcgcgtacaaaacgggcagagtgacatttccttgcagcagatcccctccgaccggctttcccagttcctcttccgttgaagtgaaatcaagaatgtcgtcaataatctggtaggacatgcccacgtaatagccgaaccaatataatgctttgtgaatcttctcatcagctcccgaagcgatggcgccgagctggcagctgacggcaatgagaagagccgttttccgtttgatgcggcgcaaataggttctgaggttttgttccatattgtatttatctctgatctgttcaatttctccgaggcatacttctacgatggttttggacaggatccggtgggctttcggctcatccaatctcgtcatcatctccagtgagcccgcaagcatataatcaccggtatacatggcgatacggttgtcccacttggctttgatggtcggttttcccctccgcagctcggcgtcatcaatgacgtcgtcatgcacgagggacgccatatgaatcatttccagcgtcaccgcaacatattttattttattaatgtcatagtcgccgaacatgccggaaagcaatacgaaaacagggcggatccgcttgcctcccgcctggagcagatggagcccggcttcactcagcaagggatagtctgaccgcaccgtttgctcaagttccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagttctttcataccgggaaattctcttgccgattcttgaagccaagaatattctttatagctcttcgcaaacatttttccgaagaaaggcatgatgtatttaaaatatagaaaatatgcctgtctgaatccgaacatttccggctgggatgtttccagacatacgacctgcccgcccggtttgacgacccgccgcatttctttcagcacggtcagatagtcgggaacgttccgcagcccgaagccgatggtgacaaaatcaaaagaatcatcagcgaaaggaagctccatcgcatttccgtgcaaaagttcaatttggctgtaaccgccctctttcacttttttctcgccgatgctcagcatatttttgctgaaatccagtcctttgatttcaccgctttttccggccgcttctgcgagggcaatcgtccagtcagccgttccgcagcagacatcaagcgcttttgcgccttcttttacattcatgatctgcatcgttttatcgcgccattttttatgctgctgaaaactgataacagagttcatttggtcataatttttatagattttttcaaacacgccgtgtacgcgctgttcttttgactcctgcatgttgattacccttcttccactttctgatgatatgttttgtcctggctgatcgctttaagccggttcagcatgaggttttggattggtgaattgagcggcagcagcgtttcaatgctttgctttgcctttcggaagctatcttccattatgtcagcctttgatttccctgactgtacaatattgccgatgacatcgagaaatatagcattgccgttcatcagccgcttatatacaaaaaaatcactcgccagctctttccagcgcggaagattaaagtggtctgacactctgtgaaacaaggccgcttccacaatcgccatgctttcgatcaattgattcaagtcattgacagaccgatcgtacagacggattttatgctcattgatttctttaattgccgtagcgagcgtccgaatcatatagatatccttcatttcagataaaagcgaataatacagtccgctgaaatagtcgccggcaagcacggtgagctgccggtttttattttcgtctcgctttaacgctctggctgttttcacttcatcgtgggtatcaagggcgctttggacaagcatcgcagttactatgtaattttctctgtcgttgttcttaatgtccgcctcttcaaacaaagcgtgaaaaagaagaagcttatcctcatcgattttaggcgcggaaatatgtttcgctaaataaggatgagacagcttttgttttaatttcgtatttagattcgctaaagttccgtagatgtcttgcaaaaatatcacccttgtccccaaattcacatttattctaatatgtatgagatttactcgtcattattatacgcaggtatcattatagcataaaaaaaagaaattggctgtattctcccgccgtttgcgggcatttggcaaaagcgggaaacagccggcttattttttttcgctgttcatttctccgtaagcggtctggatgagggcgttgcctctcactttgatggcagaggtatgctcagtaaactgagcgataatcacttcgcctttgtccagtttttcggaatggtgaaatttcgtatccgttcctctcgttaaaccgatgacgttcacgccgtcctcaaccgctttaatgacgacaaaatcacttgaatgctttgaattcatatctgcaccctctatcattattaatccgcacgtttaatatgttctaacacttcggaacgcgccgctgcgtcatctttaaaaatacctcttacagcggaagtcactgtttttgcgccaggctttcttacgcccctcatcgtcatgcacatatgctcagcttcgacgacaaccatgacgccgtggggatctaaggtctctacgatgctttctgcaatcgttgaagtaatgcgctcctgcagctgcgggcgttttgagacggcttccaccgcccgcgccaatttactcaggcccgtcactttgccgccgcgcggaatgtaggcaatatgcgcttttccgtaaaaaggaacaaggtgatgttcacacatggaatgaaacgcgatatcttttacaagaacaagctcctcatggtcttctccgaaaacggttttaaagtgttctttcgggtcttcatttaatcccgagaatacttccgcgtacatttttgccacgcgtttcggcgtatctaaaagcccttcccggtccggatcttctccaatcgcctctaaaatctggcgaaccgcctgttcaatctgttctttattaacttctttcattgtctgtgtcctccaccattgaatacatttaatttcgattctagcacatttgccacgccaaaagcaaaacgaaagtcctgcccggtgaccggggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtaccttgcttgcagggatttcgatttcttcacccgtttgcgggttacgtcctttacgtgcagaacgctcgcgcacctcaaagttaccgaaaccgatcagttggattttatcaccgtttttaagtgcatctaaaatcgtatcaaaaacagaatcaactgcttttgtagcgtcttttttagacaattcgcttgcttcagcaaccgcattgattagttctgtcttgttcatgcctttcacctcctcccaaaagggtatcaaatcagcagtttattatcatttcttcacagttcagcctgattctaaacctgtctgataaaaaatcaaagcagggaagaacagacaagtaaacggcttttcataagaaaacagacactttgaggaatgtttgtccaacaaagtgaagattttctgtatgtagagtaacacatataaaaagccatatcaagcattttaaagcctcaatcccttgctcgtcaaggttttcacgtgttttaccgaacaaatattcctttttttgcttttttcctcctaatccttgattgatttccagtatctaaaaagaataaaaaaagaccccccgtttcaggaagaggtccttcagcttacaaaataatggcgatcaggccgcctgagccttcgttaataattctctccagcgtttctttcagtttgtatctcgcattttccggcatgagtgacagttttgcggagattccttctcttacgatagagctcaatgatctgccgaaaatatcggaattccagatagaaagcggatcatcttcaaagtcctgcattaagtagcggacaagctcttcactttgtttttctgtcccgatgatcggtgcgaattcactttccacatccactttgatcatatgaatggacggagcgaccgctttcagccttactccgaaccttgatccctgcctgatgatttccggttcatcaaggctcatatcggttaaggccggggcggcaatgccgtagccggtctgtttcaccattttcagcgcatctgatacctgatcatattcttttttcgcgtgggcgaagtcctgcattaattcaagcaggtggtctttcccgcggatttcaacgccgaccacttcttttaaaatctggtcatataaatgatccggcgcatacaaatcaatttctgcgacaccctggccaagttcgattccggccaatccggcgctttcaataaactcaaattcactgaagtggccgacaacccggtcgacatcgcgcaggcgtttaatatcttttacggtttctttcactgattcctggtagctctctctgagccaatgattttctttcagcaccatgacccagctcggaaggttgacattgacttccagcacagggaactcgtaaagcgcttctctgaggacgcttaacacatctgtttcccgcatgctttcaacactcatggcgaggacgggaatatcatatttcgcgcttaattcagctctgagcgcttctgtttccgggtggtacggttttaccgagttgatgaccataataaacggtttgccgacttccttcagctcgtcgatgactctttcttccgcttccacgtaatcgccccgcgcaatatcgccgattgagccgtctgtcgtaatgacgaccccaattgtggagtgttcctggatgacttttctcgtaccgatttccgcagcctcatgaaagggaatcggttcttcataccaaggtgtattgatcattctcggaccgttttcatcctcatatcccttcgccccgggaaccgtatatcccacacaatccacaagacggatgttgacatcaagtccttccgcgacatgaacggacatggcttgattcgggacaaattttggttctgtggtcattatcgtttttcctgctgcgctttgcggaagctcatcctgcgcccgcgctcggtcggcctcattgctgatattcgggagcaccacaagctccataaattttttaatgaatgtagatttccctgtacggacagcgccaacgactcctaagtatatatcgcctcctgttcgttcagcgatatccttgaaaatatcgaccttttccaagtgatcccctcccggacttcctatccttatcatttttcattcaccattctccaatcaaatacaggacactatatgtgtatgacgttgtcctatttcaatatgacatctttagaaaattttcaggcagtcttttctatcaaaatcaaaaaaaacctttctccctatttgtatgcgcgggaaaaaggttcattcctgtttcgtttgactttctaaaaaaacgggttcctgtttttcatttacggtgtaagtgactgaaaaggccgggacgaaaggagtctctttccataaaatatcctgaatttccgcgcccggtttgattttctttttgttttccttcaggcagcgggcgagatcgacgcgatagtcggcatagatttctccgtcagcgccgattaaaagcggcagagacgtgcctgaaaccggacttttgactgaaggagagtctttcatgccgagcttttttttatttaaagtgaacaggccttttgaaacagcgtcctcatagggaggatatgtatgcttttcctgatacattttgacacgcagcttcatgtcgcggattgcttccgccatttggagatcgaccagcttgacggtcggcttattttccacatcgacaagcacgtattggtacattcctccgctttcataagctgaggccggcggctcctctatgtatctgggcgcgagccgcttaaaatctatcggatatttttgatagagcggtgttttcatatcttttgtctgaatcggcagaagtccgccgttcgcctttttaaattcatccactgccgcttgcacctgctgaagctgatgtttgtaagatactttattttcagttttttttgcttcagggtacagacagcccgacagcagaagcaccgccattgccgttatgacggccatttttaacttatgcattccgcgcccccttttggctttattcattgacaggcccgctgaaaacgaccattaacacgatcaatcccgagatgaccatgcaggcataagcgagtgaagaaaccgctgcttttatcagtttgtttttcactttgtacctgctgacataaatagaggcgaccgcaacaaacattaatcccatagcaccaagcgcaaaccacattttcatcaatgccacactcacgttcgtgccccccgtcccatcattgtaagcgttatatttcattttaatatacaaatgttgaaaagatcaacaggttttccatctattgaaaaaacaaaaaaactgaagcaaagagggggactttgcttcagtcaagttgactatattcacctgtacgtctgagatacactctcttggacttcgatgctatagtatgcgtagatgcgtacgtctgcatcctcttctgcctaaatcagcaaatgttttaagcgatttcagccggagagttctgcgttttggactttcgtcacttcagaatatgctgacggcatgttattgtcacttcacccggttttcgaatgtgttgaccaagtcttccatctcatgggttttcactctggccattaaggattctacggccgtttctaccttctgcccgttaaataatacttggtgaagcgcctctgtgatcggcattttcacctgatatttttgagacagctgatacgcagctttcgtcgtccgcacgccttcaacaaccatccccatcttatccaggacagcttccagcttatatcctttgccgagcaggttgccggcgcgccagtttcgggaatgaacgcttgtacacgtcacgattaaatcgcctacgccggtcaggccggaaaaggtgagcggatttccgcccatctttgtgccgagtctggcgatttcagcaagacctcgggtgattaaggccgcttttgcattatctccgtatcccaatccgtctgtaatccccgctgcaagagcgatgatattttttaacgctccccctatttcaacaccgatcatatcgggatttgtatagacgcggaaatgctggttcatgaataaatcctgaaccgcttctgcagccttgatattttttgaagatgatgtaacagtcgtcgggtgtcttaatccgacttcctcagcgtggctcggccctgaaagcacgacgatgtcttttctgtactcctcaggcagctcctcctccattaattctgaaatgcggagaagcgaatccggctcaattcccttgctgacatgaacaaaaatcgattgtttcgggatgtacggcagagcctttttcagcacttcccgaatggcttttgtcggaactgccacaatgatgaagtcagctccttttaaagcctcgcttaaatcggctgtcccgatgatagaacttgatagctccacacccggcaggtaatctttgttttcatgcagttcgttgatttgttcgatcaattcggcacggtgtccccacatcatgacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcgtcccggattcggttttctaaaaagcgttcataagaaaaatgcatcagttccggatcgttgacaaaaacaacgaagctcggcggcttaacagcgacttgagtcgcataataaattttcagacgggagccgttgtgcgtcggagtcggattcatggcgaccgcatccatgatgacatcatttaagacatttgtctgcacgcggagagagtggttttcactcgctttaataatcgcaggcatgagtgtatgaatccgctttgtcgtcagtgccgacataaacagcaccggcgcataatcgagaaattggaaatgctcccgaatattctgttcaaattctttcatcgtgcgctcgtccttatcaacggcatcccatttgtttacgataatgacgacggctttcccggcttcatgggcgtatccggcgatccgcttgtcctgctcaaggatgccttcttctgcattcagcacaacgccgacgacgtctgagcggtcaatggcttttaacgcccgcagcacactgtatttttctgttgtttcatatactttacccttttttctcattcccgccgtgtcaacgattacaaattcctgctgattgtaagtgaacgccgtatccacagcgtctctagtcgttccggctacgttgctcacgataacccgctcttcgccgagcatcgcattgacaagggatgattttccgacattcgggcggccgatcaggcagaattgaacgacatcatcactgtacttcgtctccggaatgtttttaaaatgctcggcacaagcatcgagcaaatctcccaatcctaaaccgtgtgtccccgaaatcggatacggttctccaaagccgagcgcataaaagtcataaatgttcgctctcatttcggtattatctaatttattaacggctaatacgaccggttttttcgtccggtacagtatttttgccacttcttcatccgcagacgtcacaccttcgcggccgttcaccataaagatgatcacatcagcctcgtccatggcaatttcagcctgctggcggatctgtgtcagaaacggctcgtctccgatatcaattccgcccgtatcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaaattgttcaaccggttattaataatcatcttcgctatgaaaagaacccttcaaacagaagggcttaactcatttattatatcagttttcactgagatcacaatgtattcttcaaaatgtttcgcattcatgtaacagtctccgtctgttttcaagacatttttgtcgctcctttgccctgctttttgcttttttggctgatgcgcgccgcaagctgttcatatgtagtcagcccgacgagaagaatcactcccgccgaacagcctgatagccatttataatcaccgacggctgctgcccccgcaatgttgcggatgaccgcagcatacaataactccccctggcacatgccgagaacaaaaagacaaagcctctcagggaaccgcccctcaacagaaagcgtaataacggtaagcagtataaccgctgcccattcaggttttatgataaaccaaacagggtcatataatgcaaaaagaaaaataaagccgtacgccgcagccgccgtcagatgaattacaatatgacggagccgtttatgcatgccgaggcttcccgcataaacaaatgccgcagcaaaaaacatgacatatgccgcgttcagcgtaaaataagccgttatctgatgtatgcttgccatcatattagtcaaaataaagactgatacgtaaaaacggctttttgttttggcaaaaataaaagtcgcaagtatccataaaaaccacattgaccagtaataataaaacggttccataatcgctcctcctctgaccagtatggagcgggaacgcattttttaaaccaattatgcctgaaaggagcggataaaaatgggaaaagacagacaggagaaaaaactgaaagcctcccgccgggtggaatctgatcgcgatgattcaattcaccataaaggagcgacgagccttgaacaaaacggtgaattccgaaaaagaaaatcgtaaaaaacagagaaaggcatgcgggttcgcatgccttttaacgtctgctgaaacgggatgtgtcaatcccccgttccgaaagccagtgatgtgtgtcaccttttatgaccaaaggcgccttttgcaattgggcaaccgattggcacccgagggcggtcataatcattttcagctcttgtaaaagcgccgtcatctcgtcaaacagcccctcttctcctttggaggtgagagctttcaggaaggtgccggccattcccgcgccagaagcgccgagggcaatcgatttggcgacatccaaggcactttgcagcccgccggatgcgataattgattgatcagcggagagcgagtggatttccgctaagcttgcggcagtggaaattccccacgtattaaaaaattgaagcgccttctctctgcgcatattttcaatcttagagaaatttgtaccgccgtatccgccggcatcaactgctgccgcaccggcatcaaataactgccgtgccgactccctgctcattccgaagccgacttctttgacaaaaacgggaactcccgcttccgccgcaatccgctcaatacggccgagagcgccggtaaagcttctgtctccctccggcatgacgatctcctgaatcacatttaaatgaatctggagggcatccgcttgaatcatatcaattgctctttttgcctgctcggcatccgcctcgctgcctaaattggcaaatatcagcccgtccggattctcttttctgacgatctcgtaagaataccgttcggagggatcttttaaagccgacatttgcgaaccgacagccagcggcatgccggctttgcgcgcggctcttgccagcgatctgttaatttcgtatgtaagctgtccgccgccgcctgtcatcgcattgataaaaatcggcgaactgcttgtgagtccgccgattttcgttgatatatccactttttccaatgctaggttcggtaggctgacatgaacaaacgtaatatcatcaagccccgtttcccggttttggccggtagacagcgcatgatttatatgttctctttttcgttctgctcgtgtcacgttttatcaccaatttattttaatttattaagcttgtctccgattaaatcgccaagctggaagccggtgctcggctcttctttcgcctggtattgacggaagtcctcctgatcggctttcggcgcttcttcaagctcacgcatgcttaaggaaatgcgctcttcgctttcgttcacgtcaagcactttcactttaacagtctgtccttcttcaagcacttcatgcggcgttccgatatgtttattggaaatttgcgaaatgtgcacaagtccttccacgcccggaagaatttcaacgaaggcgccgaagcttacaaggcgctgcacttttccttcaagcacatctccctgttttaccttttcgccgatctggctccaaggtcccggcagcgtttctttaatagataaagaaatacgctcgttatcgcggtctacggacagcactttcacttttacgtcctgaccttcttccaccacgtcagacggtttttcgacgtgtgaatgagacagctgcgaaatatgaacaagcccgtcaattccgccgatgtcgacaaatgcgccgaaatcagtcagacgctgcacttttccttcaagcacgcttccaacctcaagcgtttggagaaaatcatgctttttggctgtctgctctttttccactacagcccggtgtgacagaatcacccggtttttatcacggtcgagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtgtcgaattttttttcaaggtcttcccaagcgcggtcagcatcaacggcacgtttagataaaatcaaagcatcgtcttccacttttgttactttcaggtcaagctcgtcgtcaacttttacgacatccgatgctttctctacatgaagacttgataattcactgattggaatgattccggactgtttgacattgacaatttcgacatctacatgcttgtcctctacctttgtcacaatcccttttactacatctccaacctctggcacttgaacatcaatttgattcatttcctctgtcatttgaataacctccttggtccaaacctacacagcttaattaatacggtttgaaagctgaacatgtgaatgtccgcttttcagccgaatatgtattaaagaatcatccaaaaaagattttgaatgatcaataaaaagttttattagtattaacttctaataaaaggactggtttgtcaagcaataacatcttgtcttttgaaaaaaattaaaaagcgctccgcccgaagttaacgtgatttctgttcgacgatctccagaatttttcctgcgacttcggcaatgctgagtgacgtcgtatcgatttcaatcgcgtcttccgctttgcgcagcggggaaacttccctctctgaatcgagtttgtcgcgtctggcaatttcttcaatgagcgtctcgtaattcacgtcatagccttttttcttattctcttcatatcggcgcttcgctctttcctctacggacgcgagcagaaaaattttcacttcggcatcaggcagcacgtgagtaccgatatcacggccgtccatgacgacaccgcctttttgtccgagctgctgctgtcttttgaccatttcttctctgacgcctttatgcttggcggcgatggatacttggttgctgacttcgtcttttcggatttcttctgtcacatcttctccgtttacgagaacgatttgtccttccggagcggatacaagctcaatttccgtacgcttcaaaagctctgtaagcgcggcttcatcggttaaatcggcattctgcttgagcgccgtatatgtaatggcacgatacatcgcccctgtatcaatgtacacatatgattttttctcagctactattttagcaacggtgctttttccggcagcggccggcccgtcgatcgcaattgataatttcttgtccataatctctctccttgctctttactcctctatggattgtatcatgaactgccggaaaaggggcgaaaaaattgagctgatttaccgctttaccgtttcaatccattcttttttctccattttatcaactccctcatatttcacagctttcgaaatataaggttcaataggctgataatgaagcaaaaactgcaccgcgcccaaaattataagctgaatgcagaccaatttgaccagcagacgttcaaacgttttcatacacgcgcacctccattaggattagtatggaaaagtgcgctgctgtttattccgacagactgtttcttctctgctgcagctgcgcgcgcatacaatattggagtaaaagctgctgtgctgcggggccgatttctgtaaattcaagcgtcattttttgtttatccgccttttcatcataaaaaatccgctgggtaagagcctcggccgttatatccgccccattttccttgccgggaagagaaaatgagacatacagcttttcacctggttccgcggaaatatgctcaggcatcacaacagcgattccgccggcgctgatattagaggaaaccgtttgaaaagcggtttttttcgcttccaatttgacggatacatccaatactgcgtctgcacggacgtatcggcgtctttgaatccgcttcatttcctcctgaggggggatgtccaatccgatcatcgggatgggttcttttttctttcctttaattatgcttttaaattgatacggtacttggccattccccataaattccgctgttatttccaatcctttatgcaaaaagaccgtccgtcccgaatccagatcgacgggatatgagatgtggagttcgccgttttcaacgcttactgctttactcctcgcttttttgggctcattgttctctatgtattcaatccaaatataatctccgacagctatcatggccttcactctttcattatttatgcttttattaaagcatgtaatgaaaaaaaggaaaagacttttagtcctttcctcctttatttttataggtctttatatataggctctgcgctttttaatttttctattttttcctcttttccgtcgtccgcattaatgaacatttgatacgtgtctttcccgatcgtcccgagcatttcgtagcaaagcacttcctgaccgagttcattcgtgatcagcgcctgccgggtctcccgcacttcaacatttttattcagcttcgctttcgcttcatcagctgacaaagcgggagccggaatcgttctcgtgcggtgggccgccaggtaatcacgcgcggaaaaaccgacgacttcaccatcatccagcgccactttcattcggatggcttccggataaatgcggacgtttttctccacgggaataaaagaaaagacgccgatgttattatattgcgcgctttcatcaatttcgagaccttttgtttcatatccgtttttctttaaaaacgcgacagcccggttagatgcttcattgaggctgatcttttgtttcttcacggcccgtttttgaatcaaatagacaggatgtccccctttttgggtaatatccatatagataaaagatttgtgatccgcgtcattcatgcggatactgtatacatcgcgattcgtcttccggccgcttttgaccactttaatggaataattatgatcaggcgcaaaccgttgtgcgatttttaccgcttctttttccgtaatttgttttcctttcagatgcgtaaaaccttttcgttctgtatttgctcccgtaaatgtggggctgatgctgtcttcagaaaaagcgcctacatttttttcgactgttttaaagctgtcgacgatcgtattatcgctttgttttttgtcagaggcgagcgccatttcaacatccatccaccgtaaatttttgctcatgacgagatgctgaacgctgcgaagctggttttgaatgttctccgcctgtttgtacaggctgttcagtgttgtatattctttcttatcaagcggtttttggtctaaatcccggacggatgttttatagctgaaatctcctatattggataaaaactcctccgtcttattaaaaggcatgagagtcaggggcagctggctcacattgttatgcgcttcagatgtaattctccatacatcaatgagcgccggagacagagattttttactgttcatcgcaagcgtcgtcccgattttgtcgtgaagctgatcaacatggtacgtcagttcatgaaaagccctctgataattattttccgcgtgcagaaggaccgcatctttttcctgatgctctttatatccccagtatccggttgcggcgatcgcgacaccgagaacagcgataatgattcctctaatcatgttaacacctcattttgcgtacttttactcacagaaaatgtgctttccgattcttttaatctgcggacgtccccaaatccatttgcttgtcgccgtatcaggattgaaataataaagcgcgttttcagaagggtcccatccgttaatcgcatcaagaaccgcttcttttgctctttcattcggctgcatgtatatttggccgtcggcaacggcggtaaacgcgagcggttcgaaaatgacgccggccaccgtattcggaaataacgggcttttaatacggtttaaaataaccgcggcaatggcaacctgtccttcaaacggctcaccgcgcgcttccccgtacacagcctgcgccagaagattgatgtcgttgtttgagaaaccgccaggcatattagccgctgtcgtattttgcttttgatttgactgaccgcctgtattgttttgcggcttttgagcaggcttattcgtttccgcaggcttctgcgctccggctctcggttttgtttggttttccaatgggacgttgccataatgagtgaacgtattccctttttggatctgctccattacatattcacggtaatattttgattttgaaatcagcacctgtttggttttcgccccgacgaggccgtcaaccggcttcatgccgaatttctcctgaaaatttctcacggcccagtatgtggtccagccgtaaacaccatcgattttcccgttataaaatccgttatattgaagacgggcctgcaattctataacatcatcacccgttgcgcctctttgaatcacttgatttgaaaacgcatgaaccgtttcatgatgatcgaagaaagcggcggcgaaagaaaatagaatgaaacatgccataaaggctcctttgcacttcatctcttcaagcctcctactgcaaaatttaaagtgtatccgtattgtctgtcacgcggatatttttatacaccgtttccttcttatccctcatcaaggcataaaaaaagaaaccgcacgcgatgcgcggtttcttcacacttggatcatattgacggagcgtgctttttttgcctttcgcagcccgaaccaccataaaaacagcataaacggcagcatataatatacccaatgattgagggcggtaagaataaaatcgtaagaaccgtgcagacatgaaggcacggccagcgaaatcacaagccatttgacacgggcttttttctgcgaaaagcgggcttttccgagataaaagcccataatcactccgatcagcgcatggcaggagaccggcagaagcgctcttataaaagcatgctcaacgccgtggccgaataaatacagaatattttcaagcgtggcaaagcctaaagacacactggccccgtaaacgattccgtcataatgctcatcaaaatgagcatgcgggtacacactgatcatcagaacgaaccatttcaccgattcttccaaaaatcccgaagacaaaaacgaaacgaaaaagcttcctccccccacatgctctttttcaagaacatattggataaacatggtcggaaacacaaggacaaccccgagaaaaaaagacctcagcaccatatgtacaggttcattgtcatactgatcttttaaataaaaatagcttaacagcgcaatgccgggagcaattcctgcagagatgattgcaaacatcaggcaacctctttcctttatattcctatatctatggtaccatgttgttcatatttttacatctttcaattttttaaaaaagagcatatgaatgatcatatgctctctgcacccagccgttttgatatttcgtttgcgatcaagccgccgtgaaaacggccgttctcgataaaaatttcattggcgttatttccagccgcaatgactccggcgataaaaacaccgtcaacatttgtttccatcgtttcttcccggaaaaacggccggcctgattcagcatcaatctgcaccccgattttttcgaggaaaccgtgatcgggatggtaccccgtcatggcaaatacgaaatcgtttttcagccggaccgtctcatttcggccggagcggaaaatgatttcatcttccgtcacttcttcaagacaagcgccgaattccatccggattgtgccgtttctgacaagggcctcaaactcaggcagaatccacggcttgatgctcggggaatactcatgtcctctgtagagcaccgtgacgcgcgcaccggacttcacgagttccaaagccgcgtccacacttgagtttttcccaccgatcacagcaacatctttatcaaaataaggatggccttctttaaagtaatgaaataccttaggaagcccttcacccggtatgttcatataattcggatgatcataatatcctgtcgcaatgatacaaaacggagtgaggtagcggtcttttgacgtttctacaagaaaacggccgtcttcctgtttcgttacgcgctccaccgtttcaaaggcgtttacgcgcagctcttttcttctgacaacctctctgtagtaagagagagcctgtattcggaccggttttctgttttccgtaataaaggcgacatcgccgatctccaatttttcacttgaactgaaaaaagtttggtgggtcggatagttataaatgctgtttacgacattccctttttcgatcacaagcgcgttcacgccaatttgcttcagatgtatagccgccgataatccgcaaggacctccgcctattataattgctttttcttctgtcatgtccttcaactcctgcgattggcatttccatcataagtttccactcatataaaaaatctcctatattatcataggagattttttttgtttatgcaaacgattggtttatatccagcctctgaaacgcgaagcctcagccattttccgcacgccgaccatgtaagccgcaagcctcatgtcaatccggcggttttgggacatttcataaatattattaaacgattttatcatcatattttccagtttttcctcgacttcttcttcactccagtagaagccctggttgttttgaacccattcgaaataagaaaccgttacaccgccggcgctcgccagaacatcgggaaccagcagcgttcctttgtctgtcaggattttcgttccttccagtgtcgtcggtccgtttgccgcttctaccacgattttcgctttgatgcggtcagcgttttcttctgtaatttggttttcgatcgccgccgggacaagtatatcacagtccagctcaagcagctcctgattcgtaatggtgtcattgaaaagcttcgtcaccgttccgaagctgtctctgcggtcaagcagataatcaatatcaagaccatccggatcgtaaaggcctccgtacgcgtcagaaattccgacaactttcgcgccggcgtcatgcataaacttggccagatagctgcccgcatttccgaaaccttgtacgacgacgcgcgcgttctgaatatcgagaccttttttcttggccgcttcttttatgcagatggtgacgccttttgccgtcgctgattccctgccgtgggatccgccgagtacaagcggttttcccgtaataaagccgggtgagttaaattcatcaattcttgaatattcatccatcatccaagccataatctgtgagtttgtaaatacgtcaggtgccgggacgtctttagtcggtccgacaatctgactgattgctcttacatatcccctgctcagcctttcaagctctctgaatgacatatttctcggatcacaaacaattccgcctttaccaccgccataaggaagatcaataattccgcattttaaactcatccagatggaaagtgctttcacctctttttcagttacattcgggtgaaaacgaatgccgccttttgtcggacctacggaatcattgtgctgcgcacgatagcctgtaaatattttcacagacccgtcatccatccgaacaggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggctgccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcaaatcttttttatgaaaaatgtttctggatggtttccacagcattgccgtccatgatgagttttccgtactcatggagcctgtaaatcgtaattgtcgccgggtgtccgtattcagccagcaccgcgatgacgccttcggcggaacgggagccgaggtcttcaaggcttacatagtattggttctcatagtggtagacggtgccgccggtaatcccgattcggtgaaggcttccggcaagctgaatgatatcttcaaacgaatggaactgataaataatatccgggctttcgtcaagtttgacctgcatctcgatataatcatcgtcatattcgtcatcttctgcgtccgcgtcatgatttttcgttacaatcacaaccataccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacactgtgtacagcgggaagacaagcagaatgccgttttttatcaccgcggccggatttgtttcaggaaaacggctcatccggtccgcacagcgtaatcatatgcgtctccggcttcgccccgagcctcagcggaacttttgtcgtcccgtagccgttgctgatcagataatgcgctttttttaccgttcccgtaccgcccaattcgtacggcccgaaccggccaaaacggatttggccgccatgcgtatggccgctgaacacagcgtcaatcccgtctgactccctcatctgctcatggatgtcggggttatggcaaagcaggaggtttactttgtcagcatccgtatatctgattgcagcttcgtaatcatccatcatcatcctgatatcatccaccccgcagatcgtaacggtttcccctttataagcaaactgaaccgattcatttctcagcggaatcactttgtatgcccgtaaaagtgagagcaatttttgctggctgacctcgtaatcattatttccccacacataaatgacaggcgcgagagccgtcagacgtttgatgttttcttcaattctggcgtaaggaactccgccctccgccaaatcaccgccgagcaaaacggcatccggcttataaactgccgcttcgcggagaagcttttcatcaattaaacggcggtgcacgtcagatataaagaagatggtgagcggcttcatccctttcattttatcaagcgtaaatgtatgtgttttcagatggctgccgtttgccgttttgtacatgacggccgccataaccgcagccgctcccgccaatgagccgagaattcccgctgttagcttcataaacgcactctccattctgtcattgtcttacattagacggacaaacaaaaaaagacgtttctatcctttccggaaaacgcctcattttatttgctttcaaaataaagattgatatcataccgatgtttcatcaagtgaaaaacagattctctcgccctccatttttcaggctggggccataaatccgtgcttttttggataatttcacatctcagtttatgaaattcaccctcagctttttcttccttttttttaaaataataagaaatgcaatacgcaaaagcggaagccataatccagcacaaataaaccgtatggcctaatatttcctgcagaatcagctgcggagaggcttggggggcgttaaagcttttaaacatcagcagtatgcacatcagggaaaaacaaacgagggacgcccactgccatcttcggcattgtgcggcataattttcgtattttaatttccgtttcaccagcgcctgaagcatttgtttcgtcggtccgtcagcaaatcggtctaattgcttccataaagaatccatgcgcttcacaccttgtccgttttcattagtacactatatgaaaaacgcggtgaaaacatgcatttattttaatcagacagcggaatgttcagaacctggccggtgtacacgtcgtttccgtttaatccgttgtagctgcggattttttcttcgcccgcccggcttttataatatttcattgaaatgcggtaaagcgtttctttcggctgtacagtatgctgtacggtccgcacttttttcgggacagtcccagcttgatcacttgcggcagccggagccgctttttcacggacagccggcggagactgctgttttgtctccgcgtattcggtgtctgtcggctttacttgtttttctgaggacgtttccgttttttcaggtgttttttcacttggtttttcttttgttttttcagatgcagccgcttctttcttatctttgtcgtcagacttttttttcggttgttctaaaagagcggtttctgacgtatctttctgagcgcctttcggaataacggcaggcgcgctttcactgtggtctatgaagacatcttcatagtccttcgggtcaaatctgctgctgttcgtcatataaagaagaccgaaaaagacaccgattgttacgataatgaacaggacggtcagaaaagtgaacagcggcgtttttgttttggttttttccttcacctgctcttccttttttttacgctcctcttttacagattgtcttgtcgggaggctgtcttcaagatattcaatttgttcatccgcggccgcggcaacctgctgctcggcacgcagctgagcttttcttctttcaactcttgacatttccgtcatgcaaacccctcctaacatattgaaaacggatctgacaggcaaataccgcatcaataataaaatgcgctgtaaccggaacgaataaattgccggtccattcatagataagccccagcaaaagactgatgcccgcaaccatcataaacagaagccacttcgccaagtatctgaaatgaagcacggtaaaaatgaagctggcggcccataagccgatatgtgtctgcagaacgcctctgaacaaaatctcttcgctgaacgaaatgagaagcgtcaaaaacaaaatgtgcagaaccggcctgttcttaaaaagcaatacattaatgccgccgtcatcatataaatgtgaaggacaccacttcatcaccgccagatcggcaaaaatgacaaggacggcaagagttacaccgtaccatatgatattatcgtcacgtatatgccacagctttaaaaaatcgtgaatgtcggtgaaaaagaaaaagccgataacagctgaaaccgccaatatgagcaattgggtggcatacagctgtatcacaatctcccggtctgagagctgctggatcaattcgctttgccgtctcagctgaactcacccgcagactctgaaccgaaaatccggcctaattccagcttccaatcttcaaaccgttccatgtttttccgttctcctttttgctcgtacggagccagatcaagtccgcagctgctgcagcattgtccggtttggccttcaggctcatacgattcatcaaaataagacagcagcgcttttcttatacattctttccgctctaataacgccgaaaaacggttcattttacgcagcttcttttccacgcggtatgtcagttcttcctgcagctgctcttttgtggtttttccttgcagatacagatggacggccgttcgcgcctgtgtttcctggacgcctttattgatcagaacgtcccgaagctttcgctcatcatccgtaccggcatcccgtatgacggccaaaatgccttccagatcataatcagacaggctttctgtctgaataatctgctgctgaagctcggtatcgccgggcgccctcagcaaaatactgacactcgggctgccgtcgcgtcccgctctgccgatttcctgcataaaggcctcagccgtttggggaggataaaagtgaatgacaaagcggatatctgacttatccacacccatgccgaacgcattggtacagcagatgcaatcaagctggttatggataaattgctgctggatcaagattctgtcccctgtatccattccgccgtgataataatccgtccgctttcccgttttttcattcagctcagccgcaagctcttccgcccattttctggtcggacaatatatgataccggggccttcaagcttttcggcaagctccgtgagcctgcttattttttcggcattatcagccaaatgttctgccgccaggagaatattcggccggttgactgaataaagatgacgcaccgcatgctcaagtccgagcacatccgtcacgtctctgagcgtttcttttgtcgctgttgcagtcagcgccaatacaggcggctttccgagtgcctgtctgaaaggcccgagcttcgaataatcaggcctgaaatcatgtccccattccgatatgcaatgagcttcatcaataacaaataaactgaccggaacgtttttcaaacggttcagtacataaggtgaagaaagggcttcaggagacatatagagaaatttataccggctgatgttgctgagaataaaatgccgctctgcggaattcagcatgctgtttaatgccgcaacccgcttttctccttttgctttcagctgctgcacctgatcttccattaatgaaagaagcggtgaaataatcagcaccagcccgtccatcatgtaacccgggagctgatagcataatgatttccccccgccggtcggaagcatagcgatcgtatcctttttttggagcacgctagtcataatctcttcctgcccttttttaaaggaatgcaaaccaaaatacctggataaagctttatgcagctcagtcatgctgattcaccgtctttgccagcgccagcctgatctggaaatagctgaagcgcatctgcattccttcgcgaatccgtttaattttatttgtttgatgctgttttgcaaatgccgttatcatacgctgttcctcttcagaaagatactgttctataaaaaatgcaggctgatgcaatgatatttctacgatatgatcttcgattgtggcggtttttaaatttctgaccgcggcgatccgttcaatcggaaaccctttttccaacagctcaaaggtttttctggcagactgtgtcagcgcgctttccgcctgcagatcggacaacagctcgcgcagagcgggatatgcacattgcggaagcgattgaataacataatgtaccgctccccaaaactggacggacacataccattcatcttcgttcagctggagagcgagctgcttattcgttttgccgattctgttgaatgaagttaaagaatagacaaaaataagcgcctgcctttcacttacgccttgcagaagctgaaacagcgcgtcgtgcatttggacggaaagctctttagcatctctgtttttccgcatgaaccatttgacccatctcagcgtctgcacatcgttggtaaccgggatatattgactgcattgatgctctttgtttgacaggacttgaatgagcagggaaagccgcctccacaggatgacggcaggcgtttgataatttgcgccgtggcagtgcttcggccaaggccgctcagcaaacgcccgttcaagcctttgaacgccgcgcgcagtcactttccgcgttccctcttcttttccggctgtgatgtatgagttctcggtgagtctatgcatagaagccgcaatatcgccgcgttcacactgtgaagccatgccgaaatatttagcgatctgaaataagccggcatcctgaatggtttgagacgacttttttccttttaataaatgaaacacagcactcggagtccgttcgccgtctattttgtccagacagtcgagaaccacggtatcaaagtagtttatcgccaatctaaacacacctacatttcttttgtgacaagtttcgttttttggttctttttattttaacagattttcatataaatttgacgtttaaagtcatcttttagggggaagtgctaaagagaatcccttatgtgataagcattctcaatcatttttctgttgaaatttgacactaacatcattacaataagtaagaggaataggtgttatatttaaaaatatataaggtaaaccatttgttccaacacgaacaatctgggaggttttattcatggcaaagtacacaattgtagataaagatacgtgtattgcatgcggcgcctgcggagctgcggcaccagacatttatgattatgatgatgaaggcattgcgttcgttacgcttgacgaaaataaaggtgtcgtcgaagttccggaagttctggaagaagatatgattgacgcatttgaaggatgccctactgattcaatcaaagttgcggatgaaccgttcgaaggcgacccgctgaaatacgaataaaaaagccctccccgtgagaggagctttttcgtcctgaataagactccggctgttatcggccggagtcttatttttttgccgatcagcacaaacaaaaaaagcgtccggctgttcttcacagagcggacgctttaagcctttattgtgtttggatgctgcgtttttgttcaatccaaggtttcagcttcgtaaagatgaacgtaaagacgatggtgatgataatgccttttacaatgttaaacggcagaattcctgcgacaaccgccgttttcaactggctgtttgacaatgccggtgaatgtaaaaaccaagtatacgcgggcaggataagaatatagttcaaaatactcatcagcacggtcatcgccgcggttccggccagcaggctcactgcaagcccttttgcagaattgagctttttaaacataaacgccgtcggcagaataaacagcgttcccgcgataaaattggctgcctgcccgacaggcacgccggccatgcttccttgaatgatatactgcagaatatttttaatcgcttcaaccgcaatccccgccgcaggcccgtaaaccaaaatggcgataattgcaggaacgtcactgaaatcaattttcaagtaatccggcagccccggaaacgggaaatttaacagcataagcacaaacgcaatactgctaagcatactgatgacaactaatttttttactttcacaatgctctctccttttcgatcaaatctctcgaaaagtggaaaggttctttgcgccccaataaaaaaaccgcttttgttaaaaagcgggagcttactaaggcttggcaaagaaacgtttgatataagcatcaaaacgtctgctgaacctccatcttctcccatccagactatactgtcggctccggaatctcaccggatcctgccgccgaagcagctcgcgggcttagagcgtgatgctcatcaccgccggtagggaatttcaccctgccccgaagattgatcttatgaatttattcacattatatatgatcaaattgtaattgtatagagaactgctcaattttatataaaatattgatgaagcccattttaactgaattatcggcttccttttctcctttactgcgtcaatacacattgacactctattaagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacaaaagtaaccgaagaattgtttaaaaagatgacttctttaaaaatcgtcggcagagccggtgtcggcgtagacaacatcgacattgatgaggccacaaaacatggagttatcgtgataaacgcgccgaatggaaacaccatttcaacggcagagcatacattcgcgatgatttcttcattaatgagacacatcccgcaagccaatatctcagtaaaatcaagagaatggaaccggacggcttttgtcggggcggagctctacggaaagactttaggcattgtcggtctgggccggatcggaagcgagattgcccagcgcgccagagcgttcggtatgacggttcatgtattcgatcctttcttaaccgaagagagagccggcaaaatcggcgtaaacagccggacattcgaagaagtgcttgaaagcgcggatatcattaccgtccacacgcctttaacaaaggaaacaaaaggattgcttaacagagaaaccattgccaaaacgaaaaaaggcgtccgtcttatcaactgcgcaagaggcggcattattgatgaatcggcgcttttggaagcgctggaaagcggccatgtcgcaggcgctgcccttgacgtgtttgaagtggaaccgccagttgaatcaaagcttcccgaccatccgctggtgatcgccacacctcacttaggcgcttcaacgaaagaagcacagctgaatgtcgcggcacaggtttctgaagaagtgctgcagtttgcaaaaggtctgcctgtcatgtcagcgatcaacctgcctgcgatgacaaaagatgaattcaaaaaaatccagccttatcaccaaattgccgataaaatcggaagtctcgtgtcacaatgtatgaaggaacccgtcaaagatgttgcgattcaatatgaaggcaccatcgccaaacttgaaacatcatttattacaaaaagcctgctgtccggtttcttaaaaccgcgtgtagactcaacggtcaatgaagtaaacgccggcggtgtagcaaaagaacgcggtatcagcttcagcgagaagatttcctccaatgaatcaggatatgataactgcatcagcgtaaaagtaaccggagaccggagcacatttacgttaacggctacgtatatccctcacttcggtgaacgaatcgttgaactgaacggctttaatattgacttaaatcctgccggccacctcgtttatatccagcaccaggatacgactggtgtaatcggacgcgtcggacgcatcctcggcgataacgatatcaatatcgctaccatgcaggtgggccgtaaagaaaaaggcggagaagccattatgatgctttcttttgataaacatttagatgataaagtcgtcaatgagctgacttcggttcaggatattgtttccgttaaactgattgaccttccgtaaccaacagaaaacccaaaacattcatatgttttgggtttttttacgtttaatgggtcggaagcggattaggcgcggcaggcacagcaatcggttttgtcacatcataattaccgattttctttgcgtgcgcatgtgtgaacagcacctcggaataaccgaattccttcgcggttaacaaaagcccttcgatcattaaaatgccttccagcgaatcttcagctttatgtttttcggacaattggatccgcagctgctcgccgtcttccctttccgataccgatgcaatcgcatctgcttctataatgctcgcggtctgtgcgcctccgtctgttgtcttcatcccgtcaatagcctgatatactgaataataggtttgttcagacgggatgagatactcttgtcccagactgtcgctgtaagaaaaatacgcccggtttgactgtttatgtacggacatctcagcggaaatgccgtaagatttataaaaatcctgtccgtctccgttttgaacctttttcaatttaatccgctcgtaaggactccatgtcaaagtctctttcagcatctttttcaataaatcagcatcggcagctgattcgatagaaagacgtccgtttacctgcacaagcaaatccttcttatccgccgttacctgcacaccgtccaaaaggttcggcacagagaggaaagattcgggcacttctaagttttctgcatcagataatgcctctgaaaccgattcgtcaggcttctttttttcaaaactgaccggaatgacggcggatgtatctgaatcggcaaacgccaaagtaatgtaattgtttttgttttcgttagaaacgacaaacgtcttctgatccggcttgacagcagctgactgactggctttttcagcttgaccgctgtcagctgtaagatcaccggcagatttgtttgtcatcaggtgaggagaaataatcagagcgatgcacaatgcgcagatgccggctgcggcggggccgatccagcttcgggccgtttttttcctgtacggtttacccgtttcaatattccggtaaatggcctcgggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagcggagagcggcggctgtttcctgaatggaatatccctgaataaatctcaagataataacagctctttgatcaatggtgcaatgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgtgcgatggacaacagccatgttttttcactgcttcttccttcaaatgtatgataggaattcaagacgcggatatacacttcctgcgtcaaatcttcagcctgcgacttatcttttaccatataaaataaaaattgatataaatcttgatggtatgcatcgtataatatctgaaaggtttcttccatgggaaacccctccgttcacttttttgtcgtaaaaatgcgttgaaaagttacattacaactatattacgagaaactggaatttggaagggaatttatattaacatattcttaaatttttaaaggagaaaaaaacaaaaaacacccgcatgttctgcgggtgtttcgtatggaacaagattgttcgtcaatttcagacgtcatcctgcgcttttgtcggaatataaaatgtaaacgtcgtccctttgtcgatgctgctgtgaaccgcaattgagccgccgtgggcttccacgatattttttacgatggcgagtccgagtccggtccccgccctgcctcttgttcttgctttgtccgctttataaaaacgttcaaaaataaaaggcagatcctcttccggtattcccgagccggaatctttgatatcgattttcagtccgtcttttacggtatgagccgcgatatgaacgtttccgcctgactccgtatggcgcagcgcattatctataaggttggtaaacacctgttccattttgtcttcgtcaaagacacactccggctgagacaccgagatgtcctctgtgagcgaaacgcctttttccttcgctacaccggaaaatttgcgggagatcttctccagaaattcatgcaggtttaccgtttcatagcgcagacccgtatgtccggattccattctggccaaatccagtaaatcattgacgagccggcccatgcgaagagattcatcataaatgatctgcgcgatttcttttttctcctcttcggtgcttgcaatgtcgtccactatcgcttcactgtatccctgcagcatagaaatcggggttctgagctcatgactgacattggcaatgaagtcttcacgcaatttatccagcctgcgctcttcggtcatatcacggagcacggccacggcgccgcggacgtgtgattccgcataaagaggcgacatcaataaaacccatgaccttccttgaagcgtcatttcaatcatttgctctttttccgtgttcactgcattttgaaacagctcttttgcttcagggggaaggttgtctccttctttaatgttcatgttctgctcataataccatgcctgcagaaaacgttcggccggcgggttggtcaccaaaatggtgccgtcgatattaatggtgatgaccccgtctgccatactgcttaaaatattggacagctgttctttttcctgattcagcgcgttaatatggaaattgagctgccgtcccatctgattaaaggcaatggccagttccccgatttcatcttgggtcagaatcggaatttttgtatcaaactttcctttcgccaagtcttgggcgccttcccgcattttccgaaggggatatgtcaccctgctggataaaaagaatgcgaaaaacgttgtcaagacgatggcaatgcccgccgcaagaaaaatatagcgtgtcgtatgtttcgtcgtatctttgacggcaagcagcgattgggataaaaagaccatgccttttttgccgtctttttcatagggcactccgacgatcagccgttcgttatccgaaccggcatttttggggaccgcgcgtttgcttactttattgcggtctgtcagcgccttgtgcagatcccggtcatgtttaatctgctctaatgtaatagaggataaatgattatcgtcattgggcgaataccagacatgcttatcatcctgaatgatcgcgatgctcgttaaattgtccgccagttcccacgtgatggatctggcaagcggctggtcttcatgattttctattatgaccgcgattttatcggcaagctgcgttaaatctttttccgcttcttcaacgtggtaattttctataaattccagaagcagcaccgttaaaataaataaaacaattaacacgagtgaaagaatggtaaaccaaagctttcctactacgcttttccaaaacttcattcagcgcctacctcaaatttgtacccgactccccagacggtgacgattttttttgccgctccaggggacactttgtttaatttttcacggagccgtttgacatgagtgtccaccgttctgaggtctccgaaaaattcatactgccacacttcttttaaaagcttttccctgtcgtacactttgtccggtgttttcgccaggaagtacagcagttcatattccttcggcgtcaggctcacctccgtgccgtccgcagtcaccctgtgagcatcgtgatcaatggatagatgcgagaagacgagcacattttttgtcggggtattggctgtcagataagatgtttgggaagcccttcttaaaagcgcctttacccgaagcaccacttctctcgggctgaaaggcttgacgatataatcgtccgtccccgcttcaaatccctggacgcggttggcttcttccccttttgccgtcagcatgataatcggggtcgcttttttttctctgagctgccggcatacttctattccgtccgttcccggcatcattaaatccaagagcaccagatcataatctgatgccagccccattttaatggcctcgtctccgttttccgcttcttcaatcacatagttttcccgttcaaggtacattcttaaaaggcgtcgaattctggcttcatcatctactactaatattttagtttcatttgtttgatccatcgttttccccctgctttccttctgttactttcattttaacaaactgtgcggcagcttgagaactgtatcggctttttgcatctatgcgtacgaatgaagtccggcaagcacgagattcacaaaaattaagttaaacataataatggcgaagccgatgacggcaagccacgcggacttttcgccatgccagcctcttgacagccgcaagtgcaaatacgctgcgtaaaataaaaaggtgatcagcgcccatacttccttcgggtcccagccccaaaaacgcgtccatgcaagctgcgcccaaatcatcgcaaacacaagcgcgccgagtgtgaataccggaaaaccgatggaaacagcgcggtagccgacttcatcgaccaagtccagattcacatttttgacgagcgggcttataagagcgctgattctctttctgaatatcagcctgagcgccccgtataaaacgagacctgcgccaaacgaccagatcaccgtattgacctttctgcctgaaaaaatggccggaagctcaataagcggcttcattgcgccttccgtaagcagttctccgtcatgcgggccgacaagcgcaggcatatcatatatcatcacgcttttagcctcttttttatccacccaattaaattctgctttgtagtccgccagccggaatgccgacgtgacggcgataaatgccacggtcgtcacgagtataaacatgatgacttcaagccagaacgtttttttgcccggtctggattggtcgacatgctttaacaggaaaatgacgccggctacaaaactgatcgcaagaatcgcctgcccgagcgccgcagtcgtgacgtgaatgtacagccaattgctctgcagtgacggaataagcggcgtgatgtctgtcggaaacatgcttgcatatgcgataagcaaaagcgcgatagacaatgtgaacatgcctaatgaaggcagtctgtaaataaagtaaataataataaaagcgagaacaagcatcatgccgaatgacgtcgtaaattcaaacatattgctgacaggcgcatgtccgcttgccgaccatctcgcaataaagtagccgaggtgacaaagaaatccgaaaatggttaacgtgattccgatagccgaccagcggcccttaccgtccttcgcaccttttgttccccggatggcgccgccgaaaaccgggacggcaattaaataaatcaaaaaggcagcataaagaaaatttgcgctcagctccgccatgacaccactcctttttcactaggcctgatttttggccaattctttttgatcggccggctcttgaatcccggtcccgctaagaacaaattcgatatcctttttcagaccgaaccagtttttgttcgtatgtcccgccacaagcacttcatgatcacctgttttgatccagatccttctgtgctgccaatacatcccttgaatgacgccgatcataaagatcgcgccgccgacggcaagcacccataaggttaagtcttttctgacggtgagtcctgtaatgtttttcgtttccacatggtcgaattttaatttgtacttgttactttcggaaccttcaacagtctgctgaatcgcaacaaaacttttctcccctttcggcttgtcgggagccgtgattttaaagacaaaagccggattgttaggaaccttcgttttcgtgctcggttctccgtccttgttaaaataaaaatcaggaagataactggcgatctgcactttgtaaccgttaccaagatcgtagtccgtgtcgggatcaagaagattgatcttcagttggccgaatgactgttttgttttttggtcgatcagctgaaataccatctgatcgagctggttttctttatagtccacctgatacacagaataggagtcaaagcgcagcggttcattgacgcggatattgttttctttgactcttttaagcttcggcttttcaccgaatacaatgtcgccttccctcttgtacagaaccgcgtccgttgtgaaggatttggcgactttgccgtttccggctctgtcaatggcgtcggcgaatacttttttctcagtgtctttgttatatgtctgcatcgtgaaccggttgttttttaagtaatatttgccgtctgtaccggggatctgggcggtttcgccttcacggacccagagcgtttcatcgacatacataccgggtacaaatctcagcatggctccgatcagaaaaatgatcaggccgatatgattgacatagggtccccaccttgaaaaacggcctttttccgccaggatgcttccctcttgttctcgcactctatagtgcttttttttcaatcgtgttctgaggctatcagccgcatccccgctcagctcggtttctgtccggctgtatagacgctgcctcttcaaaaagaccggattccgccgaactccttgatttttaagcgccctgtacaaaggaatcacccgatccaggctgcagatgaccagtgatatgccaatggatgcgatcaggagcatataccaccatgagccgtacaggtgatgaaaccccagcaaataatacagttggccgattatgccgtactgctgttcataatatgtatccggctgggcgcccggaggcagataagcttcctgcggaaaaaccgtgccgaaagcagacgccgccagagtaatgacgatcagccatattccgacttttacggaagaaaagaagttccataccttatctacgattgttttgttatatgtttgcgaacgccttgcgctgccgtcgtaccgcatatcggcaagcggcgatttttgatcatcaagcggcttcccgcacgactcgcacaaaaccgtcccggctggattcacgtgcccgcattcacatttgacctttttcatgaagacgcctccggcttaattaaattcatatagtcatgaaccatgcgttctgtcatcgtgccggtcaccactttcacgacctttccgtcgggattgatcaaaaatgtcgtcggaataggtgatacgccgtacgcgtccagcacttgccggtcagtatcaagcgcaaccgggaaattgacgccgtatgttttcataaaattatgtactgcaatttttgattcgccgacatttaccgcaaccacctcgacaccgaggtctttaaaatgcttgtattgattctccatgtagggaaattcctgcttgcacggctcacaccacgttccccagaaattcagaaaaacacctttcccttttaactgactcagttctatgagtctgccctctgtatctttcagcgcgaaattcggggctttggacccctcagatatacgctctccgtttgtgtaaacggcattatagatggtatatccgagcgcgcagagtaagatgagaaggatgccggtccgaatgaataaacgccgccgttttttgttcattgtacactgctcccctcccctgtctgcaaatccattcaattatatcatctacacgttttgtaatttttgaaggttatgtgaaaattagaaagcgtttttaccgtgttcagctaaagcccgcagccttttcacctcatgcggcgtcaattctcttgcgtctcctgtgcgcagacctcttaaatctaaaaatgcgtattcttcacgtttgagtttcagcacgtcatgaccgatcgcctcaaacatgcggcggacctgtctgtttcggccttcatgaatcgtcagctgaataatgctcgtctgctttcttttgtccagggaaagcattttcgctctggccggcgctgtcttgccttcttcaagctgaatgccgcgctcaagctttctcagaagttccttggaaggaatccccttcactttggcgacgtacgtcttatcaatttcgtatttcggatgcatgagtttgttggcaaactcgccgtcatttgtcagcaataaaagtccgctcgtatcataatcaagcctgccgatcggataaatgcgctgcggcacttctttgaaaaagtcggtcaccactttccgccctttgtcgtcatcagctgctgagatcactcctctcggtttataaagcagaaagtacacgggttcttcccgctccacctttaatccgtttacttcaatctgatcagaaccagtcacttttacgccgagctctgttattacttttccattcacctttacttttccttcttttatcagctcttctgcctttctgcgtgatgccacgccggcatgagcaataactttttgcagtctttccatgtcgttcacctcaagtataatcttacttttttccccttgaacaaacaagctttttcaaggagagttattctgatatataaaaagcgcctgatttcaggcgcttccaaataataacgtaactatgatgattgatgcaaccaccccgatcagatcagcaagaagaccaacctttaaagcatcccccatttttttgatgccgaccgccccgaaatacaccgtcaggacatacagcgtcgtgtcagtcgatccctgcatgaccgaggccagtctgccgataaatgaatcaggcccgtacacggcgatcagatctgtcgtcatgccgagcgccgccgtccccgaaatcgggcggatcagagcaagcggcacgacttctgcgggaatgccgagcgctgtaaagaaaggcttgcacagccccatgacaaaatccagcgcgcctgaggcccggaatacggtaatcgccaccagcatcccgaccaaatacggaatgatggaaaacgcaatctcaattccttcttttccgccttcaacgaatgattcatacgtcggcacttttttgatcgtgccgtatatcaatataccggcgataataatcggaatcatggctaaagacagccaattcaccatttccattcgcttacctcccttttcttttgcggcggtaccagaagtagcggtcaatgaaaatcgcgccgattcccgaaattaaagtcgctaagatggtcggcccgacgatatcggtcggtgatttcgccgaataagccatgcgcacggcaatgacggttgtcggtatcaatgtaatactcgatgtatttaccgccaaaaaggtaatcatggaacggctggcctcagacttacctccattcagctttttcatctgctccatggctttaatgccgagcggtgtcgccgcatttcccagtccgaaaaagtttgccatgagatttgataagatgtaccccatggccggatgatcagggggaatatcgggaaacagcttagagataaacgggcggcacattctgctgaatatatccaaaaggccggactgctcggctattttcatcaggccgagccagaagacgagcacgctcattaatccgaacgagatcgtaaccgcttcttttgctcctttaaaaacagcttcattcacatcctgcaaggtaccgttaaacatcgcaaagacaagtccgattaccgtcagacatacccagattaaattgaccatgacgaaccgcccgccgcgctcataaacaggctcgtaaacgtctcaatgaaatgctttttcggttttttatggcgctcgttttcataatagacgggaatcttggcgatcactttcccatcatgcataacagtcatccggccgacgacatcaggaatgagagaggcgtcctttttccaggcttttttcggttttattaaggttgtgcggatttttacatcgtcgatttcatcctcttttaataaatatttgacatcccgggcaataaaagcgtgttttccgtaaaacgtctttttcagcttcggaatgccgccttttttagcgacgacataggttttatagtgttcaaagacataattaaacatattcatatggtcatcccagtcatccggatcatttatggtgaccgcgatgagatccgttccgtcttttgaagccgtcgaaacgagcgtccgtttcgcgatttttgtgtaacccgtttttccgcctgtgctgtaacggtagagcccagtcagaagcttgtttttatttttccatacccggtccatcgtttccgccttatacacttttgtgcctgaaacggtccggtattccttgattttcattgcgtatttagtcaaaagcgccatgtcatacgccgttgaatataaattttcatggtcgtccagtccgtgcggattttgaaattttgtattttccatcccgatttgctcggcttttttgttcatcataaatacaaaaccgtcaaggcttccgccgacatattcagctattgccgcagcggcgtcatttcctgatctcagcataagcccgtatacaagatctttcagctttactttttgtcccggctgaagataaatggctgagccttccgtttttacggcattcggggaaaccgtcacggtctcttccatcttccctgattcaatcgccagcaccgccgtcatgattttcgtaatgcttgcaatccgccgcttatgatgttcatccttggcgaataacaccctgccagatgctccgtcgataataatcgcgctttttgcgctgacatgtatttgggcatgtgccgtattgccgtctgtaatggaaaaaagaataacaaaagtcaaaagaaatacggcagcttttttgagaaagcgcatgaatgctcacgtccttgttgtgggtttgtacaagtttatgcgcctgtccatgacttatgaataccaattgcatcactttcacataaaaaaactctcccaaaaggaagagtttttatctgactgatgccatatttgagcctgatgcttcatattgcgccaattcttcccgcatccgcagaaattcactgctgagcgaaagcagaaggctccgcagcgagtccggcacttgctggtagaattcaatcgcgctttggcctgtataagcggcgcggctgttttcgtaccatgtatccttttttggcatgaaaaattcttccacgcactgatgatacactttatacagcgttttttccgctctcacctcatgaaacggctcctgcattaagagccgccggcaggcttcctgggcgccttcgcaaaagacggtcatcctcctcagcacactgagcacgtcgcggcagtatgcctcatccgcctctccttgagcccgcatctccggcaatgttgtatgatttaaatagctgctgaccatcgtgacaacctcggctaaaaattcaccagtttcttcagtatgggccctcacaatcgaatttcccatttccgtccgtttccttcctctcttgtacgtcgtcatttgcgtcattcatcaatggcctttccctactatcgtatgatgaaaaacgattattatttaatatcctcaaaagtttggttgaagttttcaaagaataaatcggcttcctcctggagaacgtcttcctccgcattttcaggaagcggcgggagctcctccaatgtttttaagccgaattgttcaagaaataccggtgtcgtgccgtataaaatcgcccggccgggaccgtcggcgcggcccacctcacacagcagcgcttttgacacgagactgtgcagaatccgctcagacttcacgccccggatatcttcaatttccgcccgtgtgatcggctgcttgtacgaaacgatcgccagcacttccaaagaagcctgtgacagcccttttgacggcacttcgattagttttttcaaataaggcacgaattcttttttcgttccaagcatatacgtatccgcatattcggtaagctcgatgcctctgtcgtcttccttgtactgagcggccacttcttccatgattccggccagttccgcttcttctatttcaagcaccgtcaccaattgctttttggtcagcccttcatcacccgccgcatacagcagggcttccacaatcgctttccaattcacgatatcaagcgccatgaatggattcactccccgtaatgtatatatctgaaaagttttcttcctgttcaatgataatctgctgatttttcatcagttccaggactgctaaaaacgtcacgacgagatggtctttttgccgagaaggaaaaagctccgtgaagtttattcttctccccgccgtttttaagctttttacgatttcgttcattctgtcttcaatcggtatttcctgtcttgtaatggtcgtttctttcggccgcgtgatttttttacgctgaagcaccttttgaaacgcgccgatcatgtcataaacggtcaccgacagtttctgctcggtctgtttgatttcttttgcatactcacttaaatcactcggcggctttgtaaatgacttttgtctttcttcttcccgctcttttaaatccttcgcagcggttttatactttctatactcaatcagcttttcaatcagctcgtcccgagggtcttcttcttcaagcatttcgtcttcaaacagctcttcctcttgtttcggaagcagcattctgcttttaatgctgagaagcgtcgccgccatgaccagatattcactggcgacatcaagttcaagctcttgcattgtatgtacatataataaatattgttcagtaatggttgccacgggtatgtcgtatatgtcgatttcaagacggttaatcagatgaagcagcaggtccaatgggccttcaaacgtatcaattttcacttgatattctaccattatctcaccattttcagtatcactctcattgccggaaaaactggctaccctttagtataatccaccgaaatgctctcgtccaatacttttatacacgtcctccgttatttagaaaatactgaaaaagaagatatacgcctatacctttaaaggcggatgcacatatgatagccgtgtaaacttgaaacaaagggaggctgatttcacatgagcggagcttgtttcggcggaggttttgcattaattgtcgttctgtttattttgctcgttgtcgtaggagcatcttacatctgctagttcctcaggcttcagacaccaagccgctcttttttccttttcatagcgctgtggtacactggttttagcataaaaggaggaagcggcttgtatcctaaagcttatatcggctttttggccgaatttcacgcatcaagagattattttgagtgtcatgaactgttagaggaatattggaaagaaagcccggctgaaaagcggagcattcattgggtcggcctgattcagcttgccgtcgctctgtatcaccagcgcaggggaaatgaagtcggggcgaaacggctgattgccaacagcttacgtattctgcggtctgaaaagcaggcggtctgttctctcgggctcagccatccgaagctgattgagctgatagaaacgctgtcagacgatatagaagcgggcctgccttacagaagtgttatgcttccgattacagatgaagccctgaaagaagcatgtcttgccgaatgccgccgaaagggctatacatgggggcaagacggcgtatcagatacctttcttatccataaacaccgcctgcgggacaggacggatgtcattaaggaacgcgaacgggaaatggagagaagaaaaaaaagcagaggctgacggtcagccctgctttttctatatcaaaacagctcccgaaaccgtgaagattccgggagcatttgtcagttattatatgagatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgccggatttcaacctctgagtcctttttttcgactccgatcgctccgacgatatcttcatcctctttccaaagaaagagctggcggccagtatccgtttcatagtcctttattgtctgctgaagctgcttgagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgaacggtttaaatttgccatttcaatggcagatactgcgcaatccgctcccttatttccggcttttgttccggctcgttcgatggcctgctcaatggtttcagtcgtcacgatgccgaagataaccgggacgcccgtcgccgttcccgcctgggcgatgccttttgccgcttcattgcagacatagtcataatgcgttgtcgctcctctgataaccgtgccgagcgtaatgacggcatcgtattttttcgtttccgccattttctttgccgcaaacgggatttcaaacgctcccggcacccaagcgacgtcaatgtcgtttgattctacaccgtggcgaagcagcgtgtcttccgctccgcttaacagcttgctcgttataaattcattaaatctgccgacgacgattccgattttaagtcctgttcctactaggtttccttgtatgatattcatatgttatccatccttttttgtgagatttgtttttagaaatgaagcagatgtccaagttttttcattttggtctgtaaatactgcttgttatgctcactcgcttctatttgaagcggcacccgttccgaaatgctgagaccgtatccttcgaggccggcgattttccgggggttattggttaaaagtttcatatgctgaacccctaagtcgcggagaatctgggcgccgatgccgtagttgcgcagatcaggcagaaagccgagcgcttcgttcgcttcaaccgtgtcgtacccttgttcctgcaatcggtacgccttcagcttattgattaaaccgattcctctgccttcctggcgcaaatacaatagaacgccgcggccttcttcagcaatttgcgcaagcgcggcatgaagctgaggtccgcaatcacagcgatgggatgcaaacacatcgcccgtcaggcattctgagtgcactctgacaagaactggttcgctgttaaacgggacatcccccatgacaaaggcgagatgttcttttccgtcaacctcgtttgtatatccgtaaactctaaacgtgccgaagtcagtcggcagcgtaatatcaacttctctgttcacaagtgtcgtaatgttgtaacggtactctattaagtcttttatcgtaatcattttcagctggtggcgttcggcgatttcggctaactccggcactctggccattgtgccgtcttcattcataatttcacaaatgacgcccgctccctgagatccgcaggcttttgcaaggtcaacggctgcttccgtatggcccgcccgcttcaggacgcctcctttttttgcaattaaggggaaaatgtggcccggacgctgaaaatcgtcagacacagattcctcgttcaacagcgcctgaatggtaaaagaacgttcttgagcgctgatgcccgtttttgtcagcctgtggtcaatactgaccgtaaaggcggtctcatgtgagtccgtattatgatcgaccatcgggtgaagatccagccggccggcgatgtcttcagacagcggcgtgcagatcaggcctctcccatgggtcgccataaaattcaccacttcaggcgtggcatgctcagccagcgctacgaaatctccttcgttttctctgtcttcatcatcgacaacaatgatgactccaccttttttcagcgcctctaacgcctcttctatcggatgaaacatatcgatcttcctttctaaaagccgttctcgcttaaaaaggcttccgtgatagtttgattgcttttcgtttgttctgttttgtgcaaaaagcggtataagtatttgccgatcatgtcacactcaatatttacggtcgatccgactgttttcgtctgaaaaatcgtttctgagatggtatgcggaatgatggataccgtcacgctttcatctgatagaccgaaaatcgtcaggctcacgccgtctaccgtaattgaacctttcaatacgagcgtttttgtcaattccggcgaaagttttaaatcgtaatagaccgcgttgctttttttctcaatccgcgtaatttccgccgttccgtccacatgccctgatacaaagtggccgccgaaccgtccgttggcggacatcgctctttccaggtttactttactgccttttgacaagccgttcagcgaagtggatttcactgtttccggcatgacatcaaccgtaaattgattgtcagaaaatccggttacggtcaggcagatgccgtttaccgcaatgctgtcgccaagtttcacatcgctagtcacttttgaagcggcgatggttaatgccatggaaaggcctgtctttttgattgcttggatcgtgcctgtttcttcaacgattcctgtaaacatcgtcaccatcctttccatctttaggtatggccgtcagttttatatccggcccgatttgggtgatttgtgtgaattgcaaatgggggacatctttcattgattgaaaaccttcaccggagatcaagctgggagcaagcgttcctccgattaatttaggggcgaaatagaaatgaagctcttggaaacagccttccttgacaaaacttccgtgtacggatgctccgccttccacataaacggacattattccgttttcagcgagaatactgagcacctcagggatgtgaatgcggtctgtttccagcggaaaaacttttattccgagtgcggtcagccggtcttgcttttgcacgtctgcacctttggccgtaaatatccatgtcggcgcagcgccgtcagtgagcacatttgccgtttcaggaatggtcagctttgtatcgagaatcactctgaccggctgcttcaccgcatcaggaagcctgcaggtcaggctcggattatcggctttgactgtgcctgctccgacaagaatgctttgatgcgatttcctgtattgctgggcatcaagccttgccgcctctgatgtaatccacttgctgtcaccggtttcggtcgctgttttcccgtcaaggctcgcggccgctttcaaggtgacatacggaagtccggtccgcatgaagtgaagaaacattttattcagctcttctgcctgctgcctgagaagtccggttttcacttcgatgcccgctgcttccagcattccgatgccttttccggctacaagcggattcggatctttcacagcaatgaacaccctttttatccccgactttattatcagttcggcgcatggcggtgtttttccgtaatggctgcaaggctccagcgtcacatacaaatcggcgccttttgcgtgtctgccggccatattaatcgcgtgaacctcggcatgcgcttctccgtattgcaaatgggcgcccattccgacgatctgtccgtttttgacgacgacagcgccgacaagaggattggactgtgtctgtccttcaccgcgtctggcaagttctattgccgtattcatataatattcatccattgttatccctcccttcttccacgcaatttggcgtcaaaaaagccccgaatgtttacacagttcggggctttgccagttttaatccataggaaataagactatacagtaagtttattttttgcatagcttctctcatccttctcccatccagactttcactgtcggcttcagcttttcactgaatccaccgtatacagatgcatacgggtcacgggctgtaaagcgcaaagcgccttattaccgccggtcgggattttcacccagccccgaaggatacaatcaatatttttttgtccttatccgctattataacatcctttgcggcaggcgcaatgaatttgcacctcattattcagaaaaataaaaagcgcccttttcccataaaaggcgtctttatttattcgttcactttgacgaccttcaataagccgtcaatccggtttgatttgctgaaatacgctttaatcttatcacctttttgcacatcggagagatcctgcttcagcttgtcgccgttaaaaataatttttgtgccgttcgctgccgtaccgtggtactctgttccttctattttcgtaattttatatgttttgactgtatattcttctttttcctgggacagggtttgtccgattgcagtcggcacgtctttcagttcaatatcgtttatgaccatataaccgcccgctaataacagcagcagtacaagtaaaatggctgcttttgttttaattcttcccatttttctacctccagcccgtatcaatctattcattactatgtcatattcctttttttcatgaatagaaaaccgttcttccctgcgtgagttattcatataacgtttcataaagggaagatgtttcatgtatctgtaaaactttctatctattaaatagatatacgaatttatgttctgtttttgagggtggagagataaatttatataaaaaaagcagttttctcatgaagaaaactgcctgtacggtttatttcgtcttgcgaatttcgttaaacgggaagaagacgaattttgatgtgcccgctatttgtttttttgtaaaaagaccgaggccgttgcggctgtccatagattctctgcggttatcacccatgacgaaatatttgtcgtccggcactttcaccgggccgaagtcttctgtcagccggtcatagccgtcttgcttcgccttgtgcttatttgccgctaaatacggttcggacacttttttgccgttgatatacagctgatcgtttttcatttgcaccgtgtcgccgggaagtccgataatccgtttgacatagtgctcattttctccgttcagcacgacgatctggccgcgtttgaagtcgcttatgtatttgaccgtcatattgacaaagattctctcgcggtcatgcagcgtcggatccattgatctaccatcaacgagataaggggcaaataaaaagtttcggatgagcagtgccagaacgacagcgatgataatggctttcgcccaatcaagtacggcgctttttttagaagttttttctttttctgatttcaagtgatttcctcccattagccatggtcatttttattttaccatgaatccctgcacagagggcaaataagccccgcaccccatccctttttttcattttataagccggatctgctgattttacggtatttcacgaagcttccgatccgccaaatgcacaaatacacaaaagcaagctccatcgttaaaacggcgaattccgccgcgtcaatgcttttgaaatattggctgagtgcgatacggatcgcaataatcgcgataatgacatatttaaagtttttattccgcttggagtagacaaagccgtcttcccggatttcataggcggtttgcgacagcatgatgataccgaataccgcgcctaacagtccggcgatggcgagctcccaaagagcgggaaaatgaaacggctttcccgggatattcatgagctggctgatactgaatgtgaaaatgacggcgataatcaaaagcgggagaatgatgcctaagccgccgcctttaatcggcctgtttcccttttttaccctgaaccaaatcataagtgcgagaatgataatgacaaataaaacggttgccaattgaaccaacgtttctacctcttttcattgttgtaatcggtctttttcactataccagaatgatcaccgatgttcatatatgtattttttcatgatttacacatgagaattttcatatacataaaaaaaacccgcctgaaaaaggcgggttttccgtcattatccttctacacggatttctttcattttgtctccgttagacatgtttttcgcatgctctaaaccgcttgtcacttttccgaatacagtatgaacgccgtttaaatgcggctgcggctcatgtacgatgaagaattggcttgaacccgtgtctttaccggcatgcgccattgataaagaaccggcttcgtgtttatgcggattgccttctgtttcacatttgatcgtttttccgcttccgcccatgcctgtcccagtcggatctccgccttggctgacaaagcccggaatcacgcggtggaaaataacgccgtcataaaagcccgtattcgccagattttcaaagttagcgactgtattaggcgcttcattcggataaagttcaaattcgattctgctgccgttttccatttcgatgtaaccagttttcattctcattcctacttccgtattgttttttgtcaaagccttctttaatatgaatttcaattgtaagccggctttctttttgatattcttttgaaggaagaggcctctgctcttcttttcgcggctattataccacaccttcagccggaaaacgaatctccccgcttccgcagaaagaaaatgaaaccagaacagcttcacagccgtctatgtatcggaactgcttcacgcaggtcctcacaaaccgcttcaaaacggcatttgtgaaaagaaggaggttaaccgctttgaaaaaaatgtggattggattgctggcggcggccgttgtattgtgcacaataccgaaaatcagcctggccgatgccgcagtcggagatgtcatcgtcacactgggggcggatctgtcaaacgaaaaccgtcagaaagtgcttgacgaattaaatgtccctgataacgcgacaaaagtgacggtcactaataaagaagaacatgaatatctgggaaaatatatatcgaatgcccaaatcggcacaagagccatctcttcgtcatccattacggtggcaaagaaagggtccgggcttgacgttaagacccataatatcgattccattacggatgaaatgtacttaaacgccctgatgacagcaggagtgaaagatgcgaaagtatacgtgacggcgccgtttgaggtatcaggcaccgcagcattaacgggaatcatcaaggcatatgaagtctcatcagacaaagcgatttcagaagatgtaaaacaggtcgccaaccaagagcttgtcaccacttcaaatctcggggataaaatcggggataaaaacgcctccgcgcttatcgcaaacattaaagatgatttcgcgaaaaacggtgtgcccgatacaaaagaaggaatcgagaaaaaggtcgatgatgcggcttcaaaccttaatattacactgactgacgctcaaaaagaccagctcgtttcattgtttaataaaatgaaaaatgccaagattgattggggccaagtcggcagccagctcgataaggcaaaagacaaaatcacgaagttcattcaatccgatgaaggcaaaagctttgttcaaaaagttattgatttcttcgcttcgatttggaatgcgatcgtgtctgtatttacaggagacagcggatcaagttctgacagctgaacgcaaaaagagaccggacgccatttttccggtctcttttttatttattgtttgaccccagtcttaaacggcagatccagttttacaatgtcttcataagtttctcttctaatgacaagatgcgcttcgccgtcttccacaaaaacgacggcgggacgcggaatacggttgtagttgttagccatgctgtatccgtacgctcccgtgcagaaaacggcgagaagatcgccttctttcacttccggaaggtctatatcccaaatgagcatatccccgctttcacagcacttacccgcgatggataccgttttgtcgtggtgttctccgattctgtttgccgatacggcttcatatttcgcctgataaagcgcaggacggatattatcgctcatgcccccgtcaaccgctgcatatttacgggtgccgggcacttctttttgcgaaccgatggtataaagcgtcgttccggcatctccgacgagcgagcgtcccggttcaatccagatctccggaatgtcaaaagcgtgcagcgctgcgttttcttttaccgcttcgataattttttccacataaacggcgggatgaaggggttcatcctcttccgtgtagcggatgccgaagccgccccctaaattcagcacttcagagacaaagccgaatgattctctccattcattcagttttgcaaagattttttctgcggccagcacaaagcccgccgtatcaaaaatttgcgatccgatgtggcagtgaacgccgagaaggcggatatggtctgactgcaatacttgttcaatcgccttttctatttgcccgttatgcagatcaaaaccgaatttggaatcttcctgccccgttgtaatataatcatgcgtatgggcctctacccccggagtgatcctgagaagcacatccattgtgcgccctgatttgcggcacagttccgcgagtaaggatatttcataaaaattatcaacgacgatgcagccgatttgatgatcgagcgccattttcaactcttctttgcttttgttgttgccgtgaaaatgaatcctgtcagccggaaaaccagccgcaaccgccgtaaacagctctccgccggatacaacgtccaatgagagcccctcctgctcagcgagctgtatcatcgcaacggaagaaaacgccttgctcgcgtacgcgacctgcgcctttaaatccgcgtcaatgaatgcctgtttaaagcttttagcgcgctcacgtattaaagccacatcgtaaacataaagaggcgtgccgtaatgctccgctaaatacagcgcgtccacacctccgatttccaaatgacctagtttgttttgtctgcttgtgccatgtaagaacaatgctcattccctctttctgatccgcctatgggtgaaaaggacagcttcttttgagctgtccttatacaagtcccgtataagttaagacatacaatatcataatcttctgtcggtttcaatgcgattatgaaccgcttggctgtctttgacggtctttcgggtgaacaatgctcggtctgactttcgctcccggcactgtcgtccggacgagcacctgccacagcgccttgccgttaaacggtaaaaacggccataaatacggcgtatgaaacgaacggatattcgccattatgatcagcagcaatgtaaagcctatcacaaagcctttcacttggaaaatggccacgagcaccattaagatgaggcgtatcattttattggcgaggctgagctcatagctcggcgtggtaaatgatccgatggcggcgatcgatacgtacagaatcacttctgctgaaaacagccccaccgctatggcgatttgaccgatcagcaccgccgcaatcagacccatggcggtggataaagcggtcggcgtatggatcgcggccatcctgagaaactcaatccccaaatcggctaaaaagatttgcagaatgatcgggatgtgcgtatttttatttaaaccgataaaatccaatctttcaggcagaagagacggttcgagaacaaagagaaaccagatcggaagcagaaccgttgaagcgataataccgaagaacctgatccatcttaaaaatgttcccactgaaggcgcctgcctgtattcttccgcatgctgaacatggtgaaaaatcgttgtcggcgttatgatcacgctcggcgacgtatcaacgacgatgatgacgtgcccttccaaaatgtgattggcggccacatccggccgctccgtgtatctgaccatcggaaacgggttgtagccctgtttgacgatgaattcttccaccgttttatcagacatcgtcaatccgtcaatgtcaatcgcattcacttcgttttcgacgatgctgacaaggtccggatccgcgatgtcttctatatacacaatggcaagatcggtcttagagcgctcgccgactttcgtaattttgacgcggagcctttcgtccctgattcgtcttctgatcaatgctgtattaatgacgatattttcgataaaaccgtctcttgccccgcggacgaccttttccgtatccggttcttccggtgtgcgtccggggtaacttctgacgtcaacgataaaggcgaagcccgcgtcttcaacgataacggccacaagtccggaaagcacttgatctgttgcttcgtcgagcgttttgactttttggacctgctgattgacaagcctgttttcaacaacgtcaatcgcttcatccgcattctcatcataattattgacgtcgacgagctgttccattaaatgaatgataaacaaagtatcggttaatccgttgacaaagtaaatctggacttcccggtctaatactcgaactttgcggacgccgacatcatagctcgttcccataccgacgcggtctttaaaaaattgttcattttttctaggatcccggtataccttgatcatgttttccggtttttccggcatgactttcgctcctttctaaaatgaattcgaccgccttcatcgtaatcggcgagcctttggatatgtcatcttttctccccatctttcctatgtcgccgatgcccacaatgagaggaacgtccaatttatccagacaatacaccgtatctccgttcattctgtgctcgtccatttctctcattccggttttatcgacgccatactccgtcacttctccatcacggtcaatggagacatcgactttcgtccattcagcctgatgggtcttagaagcgaccgcaatcacccccagcacttcaatgtcccgatgtgaggcgacatatttcagcgccgtttcgcccggcccttccccttgcaggcctgaatcgtcaaacatgacaaacaccgggtcattcggcgcggctttaatcagctgaacaagttcggggccgcttctggttgacggattgccctttgattgggaaatacaccgcccgcctgctttttccgcggcatattcaattgttttggcggcgtatacgtccccgtctgtcacaagaatgaccttccgtttcgtcatcaggcattatcctttcggtttaaaaataatggctacaagaaatgcgaataaaatcgctgaagatataccggcggaagtaagttcaaaaatccccatggcgatcccgataaatccatgctcgtgagcttgatgcatggcgccgtgcaataagctgtgaccgaagctgacaatgggaaccgtcgcgcccgcacctgcaaattcgataaatttgtcatatattccgaacccatccaacaaggcgccgatgacgacaaaagttgtcatcacatgggcgggtgtcagtttaaaaatgtcaagcagcagctgaccgataatgcatatgattcccccgcaaacaaaagccaacagatattccatttatgatgcacctcccgcccgctcaaataccacaccgtgcgcgatggtcggaatggtttctttctgctggatcattgtcggacttaaaagcgctcctgtcgcgacaacgagcaccctgttcagagcccctgattttaattgattaaaaatatgtgtgtacgtaacaagcgcggagcaggcgcagccgcttccgcccgcaaacacctgctggtccggcgtatagatgagaagaccgcagtcatcgtgtttcgttccggcgggatagccttcttctttgagcaaatctttcacgatcggcgagccgacgcctgaaaggtctcccgttaaaatcagatcataatcatccgccgtgcggtttaagtcctgcaggtgctgtttgattgtgtcggcggcagcgggcgccatggcggatcccatatcgaacgggtccgtaatcccgaggtcgcttacttttcccactgttgcgcttgtaatcttgatatcagaagggttttggctgatgatgaccgccccgccccccgtgaccgttgaagtggcggtatccggtttttgcccgccatactccgtcggattgcggaattgccgttctgccgtcgcgttatggctgctcgtggctgcgatcgcccggttcgcaaaaccgccgtcaatgagcgcggatgcgacggcaatcgtttccattgatgtcgaacaggcgccgaacagacagaggaacggaattttcagatgtctggcgacgtagttggcggtcacattttgatttaaaagatcccccgcgagtaacaaatcaatatcgctctttttcaaattctgtttttgcaaagctgagttgatggcatcttccattaactgacgttccgccatttcccagtttttctgattgcaatgcatttcatcgtatgtcttatcaaacagcgaaccgagcgggccgtctttttctttcggtccggctgccgtccccgccgcatttacaaataacgggttttcaaacacccaggtttgctttccggttaatttcattttttctcctcctacgaaaacagtttttcacaagcaaaccgtatcaggcctacgatataggctgccacgacgccgaatacaatgacgtttcccgccaatttaaacatgtttgtcgctactccgagcacgagtccttcacttctgtgttccagagccgcgcttgtcatactgtttgcaaaacccgtcaccggcacggctgaacccgctccggcaaactgcccgagtctgtcataaatgccgaatccggtcaaaagggcggaaattaaaataagagtggcggccgtcgggttgcccgctgttttttcattaaaattaaaaaagtggatgtaaaagtcttgaagagcctgtccgatcagacagatcaaaccgccgatcagaaaggctttgacgcaattccaaacatatggcggtttcggctgatagtctttcacttttgttttgtaattttcttttaagtttgtcacgtcggttcctccttatgaatgatggataaaatacagccaatgaaataaagagccggctattttgccgaacacaatggccatcagcaatataatgattttgctgccgaagccgatccgtttggcaagaatgggaagcacattcagcacttctgtaagcgcggcggccagcatgccgataaacatgccggccaaaagcccgaccggaacggccagccattcagataaaaaaaaatgattcatatttaaggtttcccagccgccgaacacagctcctgaaataacagctccttcgtaggcctgtacaaagcgcattgtttttgtcagctgcataaggcgggggacgattcccataacggttaaaaaagccacaaagcccgcgcccacggtcagccctccgccaagcccgacaaatacaacgaaaagaatgctaacgatcatgcagatctttcatcgtctcttcattttcgtgcattgcgacataatgatcgagatcaagctgataattaaacatctcgacttccagcgggcttggctcttcattcaggcgttttttgaagatgtgattaaaaaagacgatcataccgagaccgaggccgatgctgtatggaatctgaagcagatacgggtattcattccgttcgcccgttatgatttcatataaggcgatatgaacttctctcatactgacatcttcatgaaaattcataatggcaagacatgaaccgataaaaagcaggagccagacaccgacgaataaaacggctgacagctgctttttctggtaatggatttccactatcgtttcagcgccgccgacggtctgtacatcaagcgcgggaaaagcggtatgaatggttttcagcacttttatgatgtccagcacgacgatatttttgtcttttttcgtgaccttatacagcggcagtgccgacagtttttttttcagcttttgctgtcccgcaatctgcgcggcgtcgccgactgtgatgatatctccggtatgagccttcacgcggtggcgaagtctgagaaatattcgtctttccatcttgcatcaccatctttcgggtggttatatatgtagtatgtggttcacttttgttctcattcatcagcggcaaaagaccataaattaccaccgatgcacaaataaaaaaagccggcccgtaaaaggtcagctttccgtatgatccatctgcactttaatctgctttaatatttttttctccagcctcgatacctggacttgggaaatcccgagccgttcggctacttccgactgtgtctgatctttataatatctcagatagacaatgagtttttcccgttcttccaaatcactgatcgcttccttgagggcgattttgtcaaaccacttctcttctgaatgatcggcgatctgatcaagcagggtgatcgggtctccgtcattttcatacacggtctcatgaatggatgaaggcgcccgcaccgcttcctgcgcaagcaccacatcctccgcatcaatttctaaatgatccgcgatttcctggacggtcggcactcttccgtatgtttttgacagttcatctttcgcccggcgtattttattgccgagctcttttaaagatcttgatactttgacggttccgtcatcacggatgaagcgctggatttctccgataatcatcggcacggcataagttgaaaaacggacatcataggacaaatcgaatttatcaacggattttaataatccgatacagccgatctgaaacagatcgtccggctcatagcctctgtttaaaaacctttgaacgacggaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgttcccatctccggcgaggaatcaatcgtgacatcatccataaagttttccataatggtaaagcccattccggagcgctcaagctcgggttttgtcgtaaagagcggctggcgcgcttcctcaagatccgtgatcccgaggccttcgtcacgtatggtcagatagacgacatgatcctccagcgtaacggagatgtacacctttccgtcgcagttttcttcatagccgtggatgattgcgtttgttaccgcttctgatacgacggtcttgatttccgtcagctcatccatcgtcgggtcaagctgcgcgataaaagaagcaaccgttacgcgcgcaaacgattcgttctgactgagggctgaaaattcaagatgcatctcgtttttcatgaagccacccccaacgttaaaagcgctttttgttccgattgttcgaacctgatgattttaaacaggccggacatgtcaaacagacgtctcaccgctggcgaaatcgcgcacacgaccatttctccgccgagctgtttaatttgtttataacgccctaaaatcacgccgaggccggagctgtccatgaaggtaagatcttcaaggttcagcacaatgtgacggatgctgtcagcctccagcgattcagtaaccttttgttttaatgattctgccgtatgatggtcgagttcacctgttaatcgaatacaaagcacggattctttgacatgaaagtcaattccaaggctcatgctcattcctccttgtatgatcggataatgagtgtttcgattttcgggaaagcaattccttcactatgacaaaactagtgcccgttcgccatgattatttaaattttgtccaatctcccatcgtccgcttcagaaaagtgagaaaacccgctttttccatgtcgtcttttgccgtgaccgggctttcaacgagcacctttccgtcttttttcagaacgaggctgccgagcacctctccttttttaaccggagccgttacattgccgttgattttcacttctttttttactttgttcatgttctctccctttttggccagaagagaaatcggctcagatgtggtcagcttgatcagtttctgttttccttttttcacttttaccgttccgacgatttgattccgtttgtacagcgggtgtgttttgaactggctgaaggcgtaatcaagcattttggtcacttgggcgtttctttctttcggggtgctggctccgaaaacgacagcaatgaccctcatattcccttttttagcggtggcggttaaacaatacttcgcttcgcctgtaaagcccgtcttcacgccgtctacacccgggtaaaatttgatcagccggtttgtattgacgagccagaactttttgtctgtattttctcttaaataatcctcatacgttcccgtaaattgagtgattttatcgtactttaataattccttcgccattttcgccatgtcataagcagagctgtaatggtctttttcaggcagtcctgtcgggtttttgaaggaggtatctttcaatcccaattcttttgcttttttgttcatccggctgacgaaatcctcttctgaaccggcgatatactccgccattgcgacagatgcgtcatttccggaagctatcgcaattcctttgagcatttcttttaccgtcatttcttctccgggttcaaggaaaatctgtgatccgcccatggacgcggcgtgttcactcgtcctgactttatcgctcatctttattttccctttgtcaagcgcttccatgattaaaagcatggtcatgatttttgtcatgcttgccggcgccagacgctcccggctgttcttgttataaagaatgcttcccgtatcgcgttcaatcagcacggcgcttttggcttcatgagcgagctccgatgtatgttttccgtccggctttgcaaaagcggacggtgctgatgccgttaataaaatgccaatcaacaaagtggatataagacgtttcatctccaaagccctccatttcataatcctttttattttttccaaatccggtggttttatacgcctcatctggaaaatgtttcgtgttgagggcacaaaaaaacagctgcttccgaagaaacagctgacttatgctgacttatttttgagatcgtgcgactacggctttgacaagcttcaaaaagccgccttttactttttccgtcatttccattacttcttcatgagataacggctggtcaagaatacccgccgccgcgttggaaatgcatgagatgccgagcacgcgcatccccgcgtggttggcgacgatgacttccggcacggtcgacatgccgacagcgtcagaccccatcgttcttaaaaaccgaacctcagcaggtgtttcgtaagacggccccgtaacagctgtatacacacctttttgaacaggaatgcccagctcatcggccgttttttcagccaagcttgacagctctttgtcataggcttctgacatgtccgggaatctcgctccgaattcagcttcgttcggcccgattaacgggttggtgcctgtaaagttgatatggtctgtaataatcatcagatcgccggcgcggaattcagtgttgataccgccggctgcattcgtcacgacgagagattcaacgccgagcgctttcatcacgcggactggaaatgtgacctgatccattgagtagccttcatagtaatgaaagcggccctgcatcgcgatgacctgcacgccttcaagcgttcccatcacaagctggccggcatggccttctaccgttgagaccggaaaatcagggatcgtttcatatgtaagcttgacggctccttcaatttcatcggccaatacgccgagccctgaccctaaaatcagaccgatctttggtgtttctttcacgtgttctttaataaatgcagcagcacgttcgatcttttgtttcaaaaaaagtccccctactgtaatcttgataaaaagctttttccgtattccggcttttccgttttaaaattatcggcaatggttgcgccgatatcggcaaatgtatccgcaagcggcagctgttctgtatgtttgtgctttttgctgtaaacaagaagcggcacatactcccgcgtgtgatccgtgccgtgatggacaggatcattgccgtgatccgcagtgatgatcaaaagatcgtcttctttcattttttcaaacacttctggaagcctcgcgtcgaattcctcaagcgcttttccgtacccttccggatcgcggcggtgtccgtacagcgcgtcaaaatcaacgaggttggcaaagctcaggcccgtaaactcttcaccgagcgtttcaatcactttgtccatgccatccatattagataccgtgcggcgggaagatgtaatgccttctccgtcataaatatcagaaattttgccgatggaaatgacgtctaatccgctgtctttcattccgttcattaccgtgcggccgaacggtttgagcgcataatcatgacggttcggcgtgcgtttgaagctgcccggctctccgacgaacggtcttgcgataatccggccgaccatgtacttcggatcaagcgtcagttctctggccgtttcacagatgctgtacagctcttccagcggaacgacatcttcgtgagccgcaatctgcagcacggaatctgctgatgtgtaaacgatcagcgcacccgtttccatatgttcttttccgagctcgtccagaatcgccgtgcctgaagccggcttatttccgatgattttccgtcctgaacgccgctcaagttcctgaagaagttcatccgggaatccttccgggaacactttaaacggtttttcaatgtagaggcccataatctcccagtgccccgtcatcgtatctttcccgtttgacgcctcctgcatttttccgtagtacgcaagagggtgctccgttttttccacgcccttaatgtctccgatcagtccgagaccgagctgcgccatatggggcatatgtaagccgttcatgtgctctgcgatatgtccgagcgtatttgcgcctatatcattaaaatcggcggcgtccggcgcttcaccgattccgacagaatccattacaattaaaaatacccggttatatttgtattcagacatcataaaagcctccttttcttccatctgtccattgtagcttacagaggtcagacaactcaagtataaaccgtttacattcttgttgacaatgccgattcaaataattagaaccttctctgtattccgccaatccggcaaaaaaagccgcggcccctctggcagcggctcctaagcgcgcggatgatactgtttgtacacgtccttcagccttgttttcgtcacatgcgtataaatttgtgtcgtggaaatatcggcatgtccgagcatctcctgcacggcgcgcagatccgcgccgttttcgagcaggtgcgttgcaaaagagtgccggagcgtgtgcggtgtcagctcttttttaatccccgcttccagggcgatttttttcaggtttttccagaatccctgacggctgatctgcctgccgtgatgattcagaaaaagcgcttcggttacgtttttctttaataatttccctctggctttttcaatgtatgcttctatcgcatgggaagcggcttcaccaatcggcacaatccgctctttccgcccttttccgaagcagcggacaaatcccatcgtcaaatggacgtcggataatttcagctcgatcatctcgctgacccggatgccggttgcgtacagcagttcaagcatggctttatccctgagaccgaacgggctgtcaagcttaggcgtgtccaataaccgctcaacttcgtgaagcgccaatactttcggaagtgtccgctctgttttttgtgtttcaatatgtaccgaaggatctttatccgcggctttttcccttaacagaaattgatgaaaagaccggatcgacgccaaatgcctggcagacgtcttgccggatttcccggagtcctttatatgctttaaatattgaataatatgaagacgggtcacatcattccatgaagtgatctgaagggtttcagttaagaagagagaataacttttcagatcacgctcataggacatcatcgtattttgggccagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagcgcggtaaaacctgtgaacagaataaacactttgatcgtatccgcggctgttttcaggaatctgcccatctttcgatcgaccctttcttttggcggctgttagtacaccttatgccaatttcaaaggcttttatacataaaaacagcaaaaaaccctttcctggcagaaaaggttcataggcttttactctgtttcatccccgcggcagcggtggcagattccgtgaaaagtcaatctatgatctttaattttaaatttccaatcacgttcaatcacttcttcaacgtcttcaagcagatcttcttcaatttcatcgacggctccgcactccatgcacaccaaatggtgatgaaagtgagccgcgccttctttgcgaaggtcgtagcgggatacgccgtccccgaagttaattttatcaacgacttttaattctgttaataattctaatgtacggtatactgtagcgagaccaatttcaggagatttctcttttacgaggaggtatacatcttctgcgcttaaatggtcttcttcgttttcaagcagcactcttaccgttgcttcccgctgtggcgtaagcttgtagcttgacgagtgcagctgctttttaattcgatcaatacggttttccatgtctttccctcctacgccgcattccatgactcattataacaaaatacgcgcagagttccaactataattattataaactgataaataaaagtattattttgtgataattattctaaaatatgcatgaagacagcttttccataaacagcggagacacgtacgcttcgagcagtgaagcgatgaccgagaagaaaacgatgagaatcagtacgaaggcgtagcgtccgaaccattggatcggcgcgtcatgaaggctgcgtttgacaaacagctgccggatcagtttcagtgaaaaagcgatggagcatgtccccatgataagatatgccggaatgagaacgacgttttgcggcagaaccgaaataaatgacaggaaaaacccgttcattcccatttgattcactaaaaaaccgaccgtgaagccgacgacgattccttttaaaaacaccataatgaaaataaccggaagaccgattacggaaataccgagaatccacatcagccccaaatattttacatcatgaaagacggcctgccaaaacatttctgaagcgccggcatgttttccgtcagacagctgtccgaaaaacttgcttaaatagtaatacaaatcttctttctgcgtgatggtcatgctgttgacgatgatcgccccgaaaatgacccccatcaaaaacaagacaaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaaatcatagaaaggcgcgagattcgggcataaaaaaagaacccccgtcatcactccggtgatcatagggcttcctttttttatgctttattctttcaagcctgtcttttttagttttcgtcactctttcatgggtgctgaaaggcggcgccgtcccccttgacaagactgcgtcacgcatcccgtttcttctgagatgctcccgcatttttttcgttttgctcttcgccatgtgccaatcgctcctttttgccttttctttatcataacaaaaaaatcccgatgtgttcatgaatacggctcatgtttcgaccggtaagcgcgcagagacgttttggcagatgaatagctccccatagcggcgtatccgtaaaaaaatcccatgaaaatccccgcatacacgtgttcatggtgaccgaaaacgatagacacaacatttccggcagcaagggcaatcgtgggaacgaatatgcccggaacccggcagaacactttgatcagctgtgtaacgcataagacgaccggcacgccgatcacagcatcccaaatatttgtatggatcagcggaaaataatccacattgacacctctttattccgtcttttgctatctgttagcctgcctaagaattccgtttcctattcatctaaaaaaacagcaccggcacatgtccggtactgtaagagttgtttattttcctgccgcggcccgttctacggctgctgatacagcctgatgcacgtccgcatccaaaggctgaggcacgagatcgccgtgttttgtgcaagaggcgatggcttctgcggccgccacaagcatttcatggtcgattttcttgcttttggcgttcagcgcgccgcggaaaatccccgggaagccgagaacattattgaccgagcggccgtcggctgcataagcggctccggcttgtaatgcgtcttccggttcaatctccggcttcggattagataaggccagaatgacatgtccttttctgacatcctcttttttaatgagacccggaactccggtggtgctgatcacaatgtcacacgtgtccattaaatctttgatgcttccaagcggctgacctccgtactgagcgaggcggttcattgcgtcttctgacttgtccgttccgcagaccgctttgactccgtatgccataaacatccggcagatggcgacgcctgccgcgccgagaccgatctgtccgaccttcgcttcttttaaatcaagaccggcgcttttacaagcggaaatggcggcggcgagcgtgacgaccgccgtgccgtgctgatcatcgtgcataaccggaatatccagttcttctttcaggcggtcttcaatgtcaaagcagtgaggcgaaccgatatcttcaagcagtattccgctgaaccccggagaaatatgttttaccgtgcgaataatttcttccggatcagaggtatcaagcaaaatcggaattccgctgatacccgccagctggtcaaaaagcgcggctttcccttccattacaggcattccggcgacagaaccgatattgccgaggccgagaatcgccgtgccgtcggtgacaatggcgacagaattgctgattgtcgtatagatggacgctttttcaggctcgttttcaatcagtcggcacacatcggcgacgcccggtgtataaacacggccaagctcagccaatgtccggatcggcattttgcttttcatttgaattttgccgccttcatgagcggagagcacttcatctgagactgtatgaagccggatgccttcaccgagagcttcaatggcttgaatgatttcctgcagctgctcctcattttcggcctgcaccgtgatgttgcgcattgtgtagttcgggccgactttaacggtttcaacttccccgatatctccgcccatcactccgatggcggttgccacttttccgagatttccgggaacagtcggcgtttcaatcattaacgtccgaatcatatgctttgtaatcatgaaatgaacctcctaacccaatttttgagattgcaaggatttttctttcgtgtaccaaatgaatttccccgtgtatccgtacaatattgccagtccgatagatacaaaactgagccacatgaacggcagatatgaaaatgtggatacgccgagaatgccggccatatagatgccgttatcagaccacggcaccatccctgaagtaagcgttccgcccacctctgcgttccgggataaaactcttctgtcaagtttcagtttatcataactgttctccatgattttcggcgtcaggatcaatgacacgtacatcgcacagccgaaaatgtttcctaaaagggcgacgatcaatgtcgaaagcgtcacatttcccggtgtggtcagctttttctcaaaagttgagacaatcacttttaatacgccgagcttctcaagaatacctccaaaaccgagaccgaacaggataacgactaacgtatccagcataccggtaatgcctccgcggtttaacaggccgtttaaaaattcgacgtccgttttaatagaaaaaccattataagcagtcgcgatggcactggcaaaattcattccctgaaagacggaagcccagattgcgccaagcaaagcaccgatgataataacgggcatagacggctttttcaaaatcagaaggacaacgacgacaacagccggaatgagcatccatatatgaatatcaaacgttttctgcaatgaagattttaaaaattccactttgtcgagatcaatattttttccgccgtatataaatcccgttacggtaaatagaatggccgtaataatataggacggaattgacagatacatcatcgctctgacgtgtgacagcacatccaccttagaaagcgtggaggcaagcaccgtactgtcagacagcggtgaaagcttgtctccgaagtaagcgccggacaaaacggctcccgctacgatcggaagcggtatacccattccctctccgatggcaatcatggcgattcccgcggttcccacggttccccacgatgttccggtcgcaacggacataacggaacaaataaccagtgtagccagaaggaaaatatgaggattaataaactctaaaccataataaattaacgtcggcacaacgccgccggcaatccatgtcccgatgagcgcaccgaccgaaacgagaatcaacaccgcttcaagaccgtttgatatcccggtgacaatcgaatcctgcaagtctttatatgaatatcccagcctgactccgagaataatagcgaaaaaccaggatattaatagagctagctggatcggcaggtctaaaaacactgtgaacgataagacaagtgctaaaaacccgaataataagataataatttccaataaatttggcaatctgacctctttcacaagaaaatccccctagaagaaaaaagctaaaacgctttcatcaaatgatataacaaattatactatactgcctcatccctttgtatggcaaccgcctattcactgaaaaacgtgaaaaggcggctgttgttgctttaaaatttatttttctaatagatcttttccggcaatccccggttttgtcatttcatacggattcaaaatgatatccaattcttcttctgtcagtacatcattttgaaggcagagatctcttacagattgccccgtcatgatggcttcacgggcaattcgcgcagccgcttcatagccgaggtgcggattgaccgctgtaatgacgccgacgcttttttccacgtattgcttcagacgtttttcgttggcttcaattcccgccagacaatgatcggtaaatgaacggaacccgttattcatgatgctgatggattgaagcaggttaaatacgagtaccggctccattacgttaagctccagctggcccgcttctgaagcgaggcagatcgtattgtcattcccgatgacctggaaggcgatttggttgatcagctctgccattacagggttgactttcccaggcataatggatgatcccggctgacgggcgggcagtgaaatttccgcaagtcccgcgcgcggacctgaagccattaagcgcagatcgttggcgattttagacatgttcatcatgcatactttcaacgcggctgaaacttccgtatacgcatcagtgttttgtgtggcgtcaaccaaatggccggcgccgacaagcggcagtccgctgatgtcagccaggtgctttacaacctgttctatgtagcgcggatcggcattaagccccgtccctacggccgttgcccccatgttgacttcatacagatgctggcgggattgtttaattcgctttatgtcacgctcgagcacgcggctgtatgcttcaaattcctgtccgagacggatcggcacagcgtcctgaaggtgtgtgcgccccattttaatgacagaatcaaattgtttcgctttatccttaaagacactcagcatatgcgccatcgtatcaaggagcttatccaaaagttttaaggtggaaatatggattgccgtcgggaacacgtcgttcgtcgattgggacatgttgacgtgtgtgttcgggctgaggtgaatgtattcaccttttttatggcccatgatttcaagggctctgttgccgattacttcgttggcattcatgttcatggacgttccggctcccccttggatcggatcgacgatgaattggtcatgccatttcccctcaagaatctcgtctgcggcctggacaatcgcatttccgattccttcatacagccgttttacatccatgttggcaagcgccgccgcttttttgacgatggcgagcgcattaatcatctcttcgtggatgcggtagccggtaatcggaaagttttctttcgcgcgcagcgtttggattccgtaatacacatcagcttcaatttgtttttctccgaggaaatctttttcctgacgatattctttttgcgcgtttgtcatgctaaaaccctactttctctttgtggtagtcatgtttttacagtacaacgtcgtctgcgatcggtgtctccataatgtttttgacttcagccaagttgtgagactggccgagcgcccacattaatttcggcacgatggcttccgtgttcatatttctggagcggataatgagatcttgattgactcttcggccgacttcatagacgctcatgtcctctccttcttcaagacattgtgtcgtaatgacgacgacaatgccgctttcaatcatttcattgactttggcgagaatgtctcttccttcaaacggcacgccgccgctgccgtagctttcaatgacgatccctttgtacatgccctttaatgcgtcaaacatttccggtttcagccccgggtggagcttgagcaggcacacgtccgtgcaaagtgaggtattgaccgtaaaggcatcgtcttttggcatgtgcacttgtttgttgtattcaattccgttttcggtaataaacgcgatatacggatagttaatgctctcaaatgcatcatagcttttcgttcttaatttaatggcgcgtgtgccttgaatgactctgccgtcaaatacgacgtatacgccgcccaccccttcacatgcgaagcggatcgcgtccgtgatattttttttggcatcggttttttgaaatgtaatcggaatttgcgaacccgtaatgacgatcggtttatcagcatgctgaagcatataagacagtgccgctgatgtatacgccattgtgtctgtcccgtgcgtaatgacgaacccgtcatatgcgtcatatttttctttgacagcatttgcgatttcggcccagtattcaggctgcatatttgtgctgtcgatgttcattaacgaatgggtttccatcgtgtaatcgttatcaagttttgatacgtaggttaacaattcgtctgctttcaccccgggtgcaagcccgttttctccttcgactgaggcgattgttcctccggttgttaacagcaataattttttcataccctgcacctcttcatccatttctcaagatgtgttaagcattcgcttttcgcatacttttaatcaaattatagacagacgattgaaattaatcaagtgattattattcaattcgcgtacacttttgcatatcgatatgatataatttgctcaagtgaaaaggagcggttttgaatatgaatttagatcgtttaactgaactgagaaaaaagaaaaattggtctcttcaatatacggctgaccgtctcggcatcgccaaaagcacgtacgccgggtatgaatcaggataccggcgtccgtcattcgaggcgctgggcacgcttgccgatctgtttgacacgacgtgcgacgatttactggggcgcactgaaaaaaaggcggagccgtttacccagaccatcgaattaacaaacgccgcacaaggccgcggcacactgaccgttgacggacagccgctgaatcaggatgaaatcatcgaattgattgcgtttgtccgcacgaaaaagaaggtgcaggaggagctccgctaaaatccggcttttacggcttgattctgccgtacgtccctccgcccccggcctcaaggacgagctgcccggtgcgcgctttatgaatgacagccgctattttaggctggacgacatgcgccaattcctcttcttgcgcctgatgaagaatcgccatctccgtcccgaaagcccgcttcagtttgtctaacgttttcggcccgacccccggaatgaactgcagcgggatttgatgaatatacggcggccgcggcacgcggctttttttcgggccgctcagttcctccagccgttcactgaccccttttgtcatagttttccccccgcactccggacaggcggaagctcctttttcaaccgggctgccgcagcggtcgcaagccgtccggtaatacttcccgagcttcgggttcagcccgtaattcgccgtgatttttcttccgtccttcccttttaaagccagcgaaaattccgtgaaattcgcttctttaagaagcatttcattatattctctgccgatttttcctaaggaatgcgcatcagaatttgttaaaaatgtatacggatcaagttccgttacccgcgaagccatgtcggtgtcgcagcttaatccgagttctgccgcatcaatgagcgccgggtcgaaaacttctgtcaaagaagatatgaccccttttccgtacaggcttttatgcggggtgaacatatgggcgggaataaacagcccgcccaattcctttgttttcctttgaagattcaaaccggtttcataaatacgctgggaactgagatggatatttttaagcctttttgcgagccactcagaaaacatcttcatttcggcaagagacggcataaagacgagaacgtgaatcggcccgcggcatgtgtgatcatagatttcaagctcactgcccaacagaagcgtcgtattccgataccggatgccgccttctttcagctcacggtatctgccttcatcaattccgcgctcgatttcttctatgacttccggggaatggcagtcgatgattcccaatagttcaattcccttcccctcactggcctcttctaaaatccgatgcagcgtcaacgttttggccccggtgattttgaccggttttcccgtataggtgcggccgatatgaatatgcagatccgcatagatggttttcatcatttttccttcagcgcttctttcagctggagatactgaatcgcgtacgccgtttttgcgtcatacaccctgcgggattcaatcagcttcacggcctcttcaagcgtgacctgcatgacttcgacaaattcatcctcatccagttcgcgcttttcttccagcggcgaaagcccttccgcaagaaagagatgcacgatttcatcagcaaacccgggtgatgtataaaaagcggtgattttcgtcaaggtttccgccgtatatcccgtttcttcctcgagctctcttaacgccgtatgttccggctcttcccccttttcaagcttcccggccggaatttcaacgattgtccgttccagcggctttctgaactggttcaccaaaatgatttttccttcttctgtcaccgcaagtacggccaccgctcccggatgtttgacgatttcccgcttgcttgtttttccgttcgggagctctacatcctctaagtaaagatctatgactttcccgtcatacagcttttttttcgcaagtgttttttcttctaaatgtttcatcatgtcatctcccgttctgtctctctattatgcctcatatattttatcatacatgcatgagagggaggtgcttttcgattgaaggtgtaccggaaggataaaagtatcgtattggtcggaaaggcgtgggaagtgcgggctaaactgaaagaatacggacggacattccgctatgtcggagattggatcaccgggccttaacagttgaaaacttcgcgcctttatattacggtcaataaaagactataaaaaggagcgaaacgatgagaaaacgcacactgggacattctgatttagaaataagcgaaatcgggctcggctgtatgtcgctgggcacggataaagctgaagcgctgtctattttggatgaagcgatcgagctcggaatcaattatttagataccgctgatctttatgatttcggcagaaatgaggaaattgtcggggaggccgtcaaaaaccgcagggacgacatcattttagccacgaaagccggaaaccgctggaatgatgataaagacggctggcattgggacgcctccaaaggatacataaaagaagcggtcaaaaacagtctgcgccggctgaaaacggactatatcgacctttatcagctgcatggcggcacgatggaagatcatattgacgaaacgatcgaagcgtttgaggacttaaaacaggaaggtgtcatccggtattacggcatttcctcgattcgtccgaatgtcattaaagaatatgtaaaaaaatcaaatatctcaagcgttatgatgcaatacagcctgctggaccggcgtcctgaggagtggcttccccttttagaggagaacggaatcagcgtagtcgccagagggcctgtcgctaaagggcttcttacggaaaaaccgcttgatcaagcagccgcaagcgtaaaagagaacggctatttaacatattcttttgcagaactggaagaaaccaaaaaagcgatcggcgctgccgcacctgacttgagcatgacggagctttcccttcaatacttactgtcacagccggccgtcgcttctgtcatcaccggagccagctcacttgagcagctgagagaaaattgttcggctgcagaggcccggcgtttaagcagccaggaaatcaaagccctgcaataccatacaaaacgggacgtatacgaagcccatcgttcttaaacaataaaaccggcaccttgtcagatgccggtttatttatatttgtgccaatcgagactgctttcattcagcagctcttcaaagcttttatgtttttctttttcttttcgctttctgatttgttccgctttttgctgcgcctgttttttctcgtcttcttccttcagctcacttttcatttgcaaaagcctggccttcagatcttcccccagatcgtcttttaagctgtgtttttctttagacagctgctttttcatcattacaccccccgtatctgaatttggtgaagcaagtgtaccacggagcgccggcggccggcaacgttcacggtcccaaaaagccggaggaaggatttttcatatgaaaggagggtgcctgtgtgaaaaaatggctggcggtgttcggttcggcttgcgcagtctttttggctgccggattcgcttttacgaatctcattatgtttatgaagaaaaagacggatgaagatatcatgaaaaaagaaacggcggacgggcatgatagatttgattcctttcaggccatggaaaaagaagaggccgtcatcctgtcacgccacgggtatgagatcaaaggcttttacgtcgccccgcatcatacggcaaacaccatgattatttgtcacggcgtcaccgtaaattcgttcaattcattgaaatacatggatttatttttagattcaggctggaatgtgctcgtatatgaccaccgcgggcacggaaaaagcggcggcagaacgacgagctacggctattttgaaaaagatgatttggaagaagccgtgaattgggtgagacacaaaacgggagacggcggtcaaatcggcatccacggggaatcgatgggagcggtgacggccttattatacgcgggcgggcatcaggatgaaaaaggcgctgatttttatattgcggactgtccgttcgcaagctttcgcgatcagctcgcctacagactgaagcgggagttccggctgcctccgtggccgcttctgcctttggctgatttctttttgcggatgagagaaggataccgtatccgtgatgtatcgcctctatcggttatcagccgaatccggcagcccgtgctgtttattcacagtaaggaagatgattatatacctcccgcttcttccgaattgctgcaccgcagaaaacgcggaccgaagatgctctatctggccgaatcgggcgggcatgccatgtcgtacaccaaaaatccggagagctaccgcaaagccgttcaaacctttttagataccatgacgcaaacgtaaaaaagcgaaagaacgtatgctggttctttcgctttcccgtcataaaacgtcggtaatcccgtccatattttctccgatccagtcaatggcgaggtcgattgtcgtaaactcctgcgctttgaaggtcatctcatcctgaagcagccagacatccttctgaacggattcagcgcctccgatggaccagtgcagcagactgtacgggtggttgttgttcagaaaggatacccacgttttatgctgtgccgtctgtttaatggctttcagcttttgattcactttccgtttctccctgctttactaatatgctcattctcgggctcagcatctctgccgggctttttaagacgagcgtttttgccttttcattgtaatcgattgtcatttcctcgtcaaaaaacactttttgtgaggtctggatgtaaagcggaagtccgttggtttcaatggcttcgcattgtcccgttaattcgtccgccagccagatggtcggcacgccgctcaccgcgcacccgcagccttctgcgtcatagcggagctgcgcttttttccccgggttggcgtccatcgtctgctgaagtgtgtgtttcgccgcatccgtcacatgtatttgcatagatgatcctccgtttttcattttcgccattgtagcataccgagccgctgtatgcattgtttctgctttctttacagaagcccgctctcccagtcctttgcctcttgttcagccgccttgatccagtcatttttcccttcactatactttgccgtatcgtacgggtatgccttagcgagccgccgtttcagttccatgtattgagccgctttttcaggcttttcagtgaggtaatcccggaacagcagatggcgcttcacatccggatggcctgtttcgtatatgtggacgtggtgtgtgcgcttgctgccgcctttttgaaagaaacgccggccctctatcccgttttccccttgcgcctcatagccgagtgcttccagctgcgggctgaatcggtcagcatctgaaatatctttgacctccgccagtatatcgataacgggttttgcggccattcccgggatggaggtgctgccgatatggctgacagaatgaagtgcggggccgaagattcggatcaagtccgccttctctctttcaaacatctctttccattccggcttgtacggaacaacttccgctttcctcttcggataaagatgaaaaaacgagagggtcagcccttccggcgtctctgtctgtccggcttctgtaaagccggtttttaaatagagagagactgccggaacgttttgactggcggtagccgcctctattttttgggcgtcccggttttggtctatcacaaattgaataagcgcccgtccgattcctttccgaaagccggacgggtgcaccgtcagcctgcatatgacaaggtcatatccctttttttcatacgaaatgacgcctgcaagctgatctttctccttgaaaccggcaaacgtctcccgtgaccgctgtatgtcaccgggtgtttcatgcagggctggaatgccgaaaaagccgatcagctcggcttctttttgataagagcagcgttgaaccgccgcaatttcccgcgccgtctgttcttgtgtatgccgtaaaaatgtaatcaatcttccgccccttttgacgcaaacatccgctgtgactccgtcttcgtaatgcggaccgcgtacgcttcataccaggcgctttttcctttttgttttgccgcccggtgatcagtatggtctttccaccttttaatcgactccaggctgtcccagtaggaaaccgtgatgccgcagccgttttcctcccgaacgctttccgcgcctaaaaagcccggctgtccgcctgccaaattcatcatgcgctctgccgtatgctcatattcctcatcatattttccctttattgatgaaaaaatgaccgcataatagggcggtttgggcgtgtcagctaaaaaacccatattcatccccctctacatatatttcacaaacagaatccggtcttctcccggaccgtcataattcgcaaaaacagggattccgtttacggttttggttcctttttcaacttcaaagcctaattttgtatgataagcgattgatactttattgacgggcgccgtcacgcaattgacttttgtgcagcccctttttttcaccgtctccataaatcgatcgtagagctgttttccaatttgcatttttctgaaatccggatgcacaccggaaaaatgaatgtaggctgtctcagggtctgattgtgactgaaaaccgattaaaaaaccggtcattccctccagcccgtacgtgataaagctcgtgtcctgaaaatgttcaaaaaacaagcgcggcagtttgtctttcatctgcctgccgccccaccattcattcaaaacagacgtaaccatttcatagtcttcagaggtaattgttcgaatatccattatcgattgactctccttttcgtccggcaaaatgaatgtcagctcttctcattggaatataaaaaattatatgtgggttgtttgcaattgtaaatgatttcttttcaagcaaacgaatcagcacgtcttccagccggggaatgatttaccagtataaacgtgatcattgttcgggtacaatgaaaaacagaacaaacgttcccggaggtttttttatggctgatattcttcttgttgatatgcaatcgttttatgcgtctgtggaaaaagcggaagcgcctcatctcaaaagccggcccgtgattgtctcgggagatcccgaaagacgcagcggcgtcgtgcttgcggcttgtccgctcgccaaacgatacggcgtaaaaaatgccgaacggctgtgggaagcgcaggccaaatgtcccgacgccgttattgtccgtccgcggatgcagcggtatattgatgtatccgtcatgattaccgaactgtttgaacggtataccgatcttgtagaaccctactccatcgatgagcagtttctcgacgtgaccggaagcaggcggctgttcggtgatccttttacaattgccgaaagcattcagcaagcgatcatgcgtgaattcggaatttatgcccgtgtcggcatcgggccgaataaggcgctcgcgaaaatggcttgcgaccattttgccaaaaaaaacgcatccggcatccacagattggatatgtcaaatatcagggaggatctgtggccgctgccggtcggaaaattattcggcatcggaaaacggatggagcatcatttaagacggatgggcatcagcacaatcggcgggcttgccgggcaccccgccgaactgctgaaaaaacgctggggcattaacggcgaattgcttcagcggacagcccgcggcatcgatccctctccggtcaccgtcaacacgcacagccggcaaaaagcgatcggccataacatgaccctcccgagagactacagccgctttgaggatatcaaagtcgtgctgttggagttaagcgaagaagtggcccgccgcgcccgtttcaaacaatacatcggccatacggtttcggtcagcatcagaggcgctgattttgaattcccttcaggttttcacagacagagaaagctggtctctccgactaatttcggaatggatatttttaaagcggcggtcaagctcttcaaagagcattggaacggtgagcccgtccgcagcgccggcgtctccctttcccagctggagccctgtgattatgttcagctgagcctgtttgatgctcaggaaaaaaagatcagtctcggcaaagtattggatgatattcatgagcggtacggccctgcgtcgctcctccatgccgcttcgctgacagaggccggccaagcctttcaccgggctgaaaaaatcggcgggcattacaaataattgaggtgatatacatgaatccgaacaaattaacacccgggtataatgtcatgtgggaatcaagccggatgatgctgcccgaacatcgggagcagctgcttgcaaaaaaacgaaaagaacgggaattccggcctccggaactgagcgcagagcaactgaacgacatgaaccgcatcattgcggcgtcgattgaagaagacagagccatctcggtcacctatgcttcagcacgcggcccccgccgcttttggggatgggtaaaacaagtgaggcatgacgaaaaacgtttaaaaatcataaacgatgaagatgcgttaacgctgccgtttcatcttattctctcggctgaactggaataaaagcctaaatcgtcctgacagaaaatatgatagaagagtgggaggatcacatgatatttagtagaataaagatgaatgacaagaataggagaatatatgatggatcaatttatagaaaaaatgctgggacaagccctccgccagtatggacggaatgtgtcgacagatccgctgagcccctatgaaaaacagagtttaaaaaaagctttagaagaaagaaggaatgaagaacccgatgaggatctccatgcccatgtagaagatattatctacgattacgtcaccaatcaggggcagttttcctgacacggacgtttatgcaccgggcgaaaagggaaacgtccgagagtaaaccctaaagattgcgtggtgcaggatatgcctgtcgggccttatttcaagatcggctatgccgttcttctgttatttctcatcatttatctcggaacattaatagactttttgttccagcctgttgtgattacggttaaaaccttgtttccgcccattgtattatcgggcgtcctttactatttgtgccgcccgctcgtcagagtgctgcatgcgaaattaaagctgccccaaggaatcgcgattttagcgatttatgcgggaacagccggcctttttgtcctcttcctgtatacggcgggccctgccgttcaaaaacagtttacagccttcacagatcatattccggagctttccgcaaaagctgaaaattggatcggacaccttcaggacagcaaatggttttccaggcttcagcatggggattcctttaaaaaattagcggacaaagccgcaaattattccggttcaatcgctgattctctcagcagtctggccggtacggctgccaatgccgccatcaccgcagccattattccgtttgcgctgtattacatgttaaaagaaggaaataaagccccccggcgactgctgcggcttcttccggaaaaacatcaaaaagaaggaaaacaaatccttcgggacatggatgaagctctcagttcatacatacaaggacagctgctcgtcagtttctgtgtcggcgttctcgtcacaatcggctattttatcatcgggctcgattatccgctcgttctgggcgcgttcgccatggtgacaaatctgattccgtttatcgggccttggatcggcacatttcccggagtcattgtcggattgttcgattcaccgaccgaggcggtgctggtgattacggtcgtcgtcattgtccagcagcttgaaagccagctgatttccccgcaaattatgggacggaagctggacattcacccgctgaccattatttttcttctgcttgccgccggcaaattctcaggaattgccgggatgctgctggccattccgggatatgcggccgcaaaagtggtcataagccacatgcagaaactattcattctcagaaaaaaacaaagctaggagagaaatgattcatcccccatgtcttcacatcggttaaaatgaaaaaacggcgggctgaagaagcccgccgcacacggaggtaaaaaagatgaacatcggtgatgtcatttttcaattgatttcatttattgcagccgcatttttcctgcttgccgtgatatacgtattcaaaagcttgaagcagcgccgcatacaattggacagaatcgaaaagaaactcgacgcgctgcgcgaagaaaaaaacgagaagttatagttcattcagaagcaggcgcagccagctccacctttatccgatccgggtcctccgtgtatacggcgtaatgcgtgcttccgcctgcatatggatggcggtccctgtaaagcacggggcatcctctggcaagcagcttttccgtcatctcgtcaacctgctctcttgacgcagcatgaaaagccagatggttcagcccgacccggcatctgtggtactccggtgttaaaaaacgctcctctgtctgtacaagcacaacataaaatccggcgtttttccagctgatgccggagtcccaattttgaaactccctataaccgagctcacctaaaaaccatccccaaaaccgggcggaggctttcaagtcagatacattcaatatgatgcatcataatattcgcttcctcctcacatcacacccgccttaccagcacctcttcaactttatggccgtcacctttcctcaaaatcaaatccgatctgaattttgtcggcaggatattttcatacagattcggacggttgacgctctcccagatggaggcggccatggtatccgcttctgcatcagacaaatccttaaatttatgaaaataagaagccggatcttgaaaagcggtttctcttaagaggcggaaacgctccaaataccacgtgaaaatccggctttcttcggcatccacatagatcgaaaaatcaaagaaatccgatacaaaaatccgcggatcttccctgtcgtcctctaaggtcggcgactgcaggacattgattccttcgataataacgatatccgcaccttcgacaacctcgacggcaccctcttccctgtcataggtaaggtgggagtatacgggcgcctccactctctctttccctgactttatatcgttcagaaactcaagcagcgctttcacgtcgtaactttccggaaatccctttctggacagaaggtttttcttttttaattccgccgtcggatacaagaaaccgtcggttgtcaccaggctcaccttcggcctgtccggcagacgggaaagaagcttttgcaaaattctcgccgtcgtgcttttgccgacggcgacgctgcccgcgattccgatgataaacgggattttcgctgaatgcggatgtttcagaaacacgttgacatgctgattccgtcttgcggcagacgtgacatgaagatggagcagtcgcacaagcggaatataaatcgtttctacttcttccaccgacaggtagtcattcagcccctctacggccttggcttcttcctccgaaacggcaatggaaagatggccgccgaatccggcccacgactcgcggctgtgctgcgtatacaatgtatgtaagttcaattctttacttttcacaattcacaccaatctctctgtatggctttccgattaaaaaacaaacgcttacaaagattgtaacggaaaaccgcctcactgtctgcccatttttttcacaaatgaggaaccgatccggctgtactcttccatttcctccttgggaaccatgcttccgccggtaccccacacaaggtgcacggcattttccatctcaagcccccgctcttttgtataacggttaccggcttcggtctgaacgaacttgacggctccggccataccggcgagtgcagagggttcaaggctcttattctcggccgctcttaattgataaagcagcgaaaaaagcgtgccgtcatcagcggtataacagccgctgagtataggctccatcagagggccggccagtccggacggccttcctaccgcaagtccgtcggcggctgtttgattatcaaggccgatatcctgcacgctgattccgtcatgcaagccggaaaacagtcctaacagcatacacggtgaatgcgtcggctcaccgaaaaaaatatggacatgcccgccatagatcagctttagcgcaagcgcgacgccgcccgggcctcctccgaccccgcacggcaaataaacgaaaagcggttcatctgcacccggctttatgttcatttgatcgagctgctttttcacacggcttcccgcaacggcatatcccagaaacagatcccgggaatgctcatcatcaataaaataacaataagggtcctgcttcgcctgcatgcgcccctctttgacagccagactgtagtctgcttcatattcgatgacgcgaacccccttttcccggagcagctcctttttccactgctttgcgtcactggacatatgaacggtcacacaaaagccgagcttcgcgccgattatgccgatactcagacctaaattgcccgtagaaccgacggctatagagtattttgagaaaaaagcggtaaaccgttcctcagtcaatatgctgtaatcatcgtctgttgagagcattcccgcttttaaagcgagatcttcagcatgcttcagcacttcataaatcccgccgcgcgctttaatagaaccggaaatcggaagttcgttgtcgcatttcaaaagcagacgcccggggaaagcctgagcggcgctttgttccagacgttttttcatttcattgatgaagacaagcggagactcaatgaggcctcccgccgcttctgtctccggaaaagccgacgcgatataaggcgcaaaccggcgcagcctttcttccgcttcggcaatctcctttttccattcagcgccattctttactggatcatcggttttatgcgggttgatccaaagtacttcacgcgcctccgccatttgcctgactaaaggctctgtcatcaatgccttgtgtatatcccggtcggacattcctttctcccccttgttactttttctttaatgcgcggccggccagtttttctgtaaacgaagggaaaagctgatacagcttcgtcccgaggctcatccatcgcggaagattcatttcccgtttatccgtcagaatcacggatgtaatacgctctgccacatggtcggcatcaagcatccatctgccgacgcttttcacataaccgccctctttatctgcaattgtaaagaagtctgttttgatcggaccgggattaaccgttgtcacggctacacccgtaccggccagctcaagccgcagcgcattggaataccctaaaacggcgtgtttcgtagcggaataaaggcttgatttcggcgtcgccaatttgccggcctgtgaggcgatattgataatatggccgcttttcgcatgaagcatcaccggaagacaggccttcgtacaggcgattaatccgaagacgttcacttcaaacatcgccctcatatcctccaaagatgaatcagcggccgtttcaaaaatgccgaagccggcgttgttgattaatacgtcaacatgaccgatcaaacgccttacgttttcagcctcttctgcatgccggacgtcaaacggaatgacatcacactgtccgccgcgcgcggtaatcgtttttttcacttcctgcaagcggtcctcccgcctggcggataaaaaaacatgagccccttctgccgcgcaggaatatgcaagccgttctccgagtccgccggatgctccggtgatccaaatccgcttatccattaatctgcccatttccttcaccccttcacagctttaaacatcagagtatttcccgactgaaaggattcagcctccccttttgcagtcagtacgtcaagatggccgatcgtttctgacatcgttaaaaacaattcattttcatacacagccggaaacagccgccggcatacctggaaagccgtcagcgtttcctctgacaacaggcgcagcacatattccgaccggtttctctgtttttcaagccgcctgtcaaaagcaggctttacgtccgtcagcagatcgccgtgtcccggatataaaagggacgggtttacgtcatacagccgcttcattgagttcaagtagtcgagcatcggggccgcgcgcacgccccccttttccggagcttccagaatcggattggtggagctgttggacaaaagcagatcgccgctgaacatttcaccgcttttttcatggtagagcgcaatgtgagaagcggcatgacccgggatttcgagcaccgtccagccgttaagcccgtcgattttcccgccttcttccactgttttcgttaacggacggtttgcagaaaataagtacgacagcttaactgttttctgtatgtcttcaggcgtcaggggaacgcccatttcagtcataagcgacagaaaaaagtcctcctgccgggcgatatacgactgatcctgagtaatgtacctatcattcagcggatgcccaatcacttccgtatcctcggaaaaaaggtgcagcagacctgaatgatctgcgtgatgatgagtgagcaccacctgttctatatccgccgcagaaacgccgtgttccttaagctgaaatgagagcgattcagccgcttcctttgtattcgggccgcagtcaataagggttaaggcttcatcttttattaaataaacgataacgtcgccgactgcaaacggagtcggcacacgtatcgggatgatctttctcgctgccatgtttacgctccttcgttcttttcattcctgaataatcatattttagcgttttcttttcactgtgtcattattgcgcatatcggaaaaaaagattgacatcccgctctttcgcatagcataatgaacaacaaactagaaaacacggaacgcgatgacgaggaactagtatataaacaacggcagcagagagcaatgtccccggctgaaagacattgcggccctcttgtttacagaacctgccctcagagcggttaggaaaacctaaacgtatccctcgttacgggatttgagctgagcacggctgattcgtgctaatgtaaggtggtaccgcgaaaccttttcgtcctttttgacgggaaggtttttttgtgttttagaagaaggaggatttatatgaagaaaatcggttttatcggggccggatcaatggcggaagcaatggtgaacggactgctgcaaagcggaatgacagcccccggacatatatatatgacaaaccggtcaaatgacagccggcttgaagagctccaaaaaacgtacggagtgaaaccgtgccgggataaagaagagtttttcagcaataccgacattattgttctcgcctttaaaccgaaagatgcggcagaaagcattgagaacattcgcgaatacgtgaaagatcagcttgtgatttctgtcatcgcggggctgacgattcacacgattcagcaatatttcggcagaaagctcaccatcatccgggcgatgccgaatacatccgcggccattcagcaatcggcgaccggtttttccgcaagctctgaggcgagtgaagctgaaatccggacggcaaaagagcttctggaaacaatcggagaagcgacgctctttgaagaaaaacaccttgatgccgtcacagccattgccggaagcggtcccgcctatgtgtaccggtatgtggaagcgatggaaaaggccgccgttcaagccggcctgccggaagaaacggcaaaagagctgattttacaaaccatggccggggcgacggaaatgctcagaacaagcagcaaacggcctgaacgcctgcgtaaggaaatcacaagcccgggcggcacgactgaagcaggccttcgcgcattagacgagcgccgctttgaagaagccatcatgcactgcatcgcaaaaaccgcagcccggagcgccgaaattaaagaacaattcgcaggctccgttctgcaaaagacggaccagtcataaagcatgggggcatcccatgcttttttcattctgtttaactgccgtataagcggctgattctctcttttacttcaggaagatggaatgtggcttcgtgcatgtttacctcttcctcaaccgcttttgtcagctctcttttgatccgtgcggtcacattggttttcagcgcaaccagtgaggctctcggtttatccgccagcagccgggccaattcgcggcctctttgaagggcgtcttttttcggcagcacttcaaacggaacaccccgtttttccagagcggcgccgctgaaattcgcggccgtaaacagcatttcttccccgaggacaattcccagtttttcaggcacaatatacgtcgcgcccattcccggtgtaaatccgtacttcatataattacaagaataaaaactctctctgcttaaaatgacgaaatccgagctcagaccgatcgtaaagccggctccgatcgcatgcccctgcatgacggaaatcacagggatcctgcaatccaataaaagactgtgaagctttaaatctgtaaattgaagctttccgctctgaatggtcaaaagcccctcctgcgttcctcccgtgcagaaataatttccgtaacccgtcagaaggacagttttataggacggatgggcattgatgtcttggaatacccggtgcagctctcttacaaactcttctgacagcccgtttttcccggccgtatcctgcattgtgacctgcacaatgcccggttctgtttcctgtacatcaatcattggattcatgtgtattctccgtttctttaaaaatactcaagcctttccggctcttatactaggtcgtccattcatactttctgtgaaactcttttatttcagtcagcactaatcgcgtttttccttgatgcgcattcgggatgtctgctgcgggcgcggcatttcttgtgccgaattttacgatgccgctgtcttggagcagccggtcataatcagtcattgataaacggacgcgttcatccaaatgccggctgatctgaaattgattctgccgcgcacggctttgcggcataacgacaccgctgtaaaattcagagcagcagcccgaaccgtatgaaaaacagccgacgcgtttcggcgtttcaaaagagccgttatcaatcgtgctggcaagagataaaaatacggtggcccccatgatgttgccgacgcgctgacagtattgaatcccaggcagcacgcgttgctgaaaatccgcttcaatgtcctgcggcttagcctttgccaattttctcatcatcgtccgatgcgctccttttaccattccgccaaacggagtatgaaaagaaaggtattgaaatgtattcttataatccgccccgctcacacgctttcggtattcctgaaatgaattttcacagcaatccaaataagacatgagcgacagatcagcatcccccgcttcactatccggaatcgggcggcaggtatccatgacttcatacccgtaatacccgcttgcaccttgatcaagcaaaaagacatgaggggtgctgctgactaaaagcgcgacagctcccgcccccgcactcggttcggcataggaccattcctccgtcaacgcgtcaccgccttcagccactaaaaagcgggaaatatccgttccgatgatgagcgctttcgctcccggcgatgtttgcgacaagatgaaattcacgcccatttgaaacccggccgttaaagaatagcaagcctgcttcacctcaaataaccggcaattccgcttcagctgcaaataatcatggacatatgtactgatggatttgccaaaatcaatcccggattccgtacaggtaatgaccatttcaatctgattccgttcctcttctgagagagaatcgataatcggttttgcggcatttacggcgaacgtaatcggatcttcaaacggaagcgccaccactttttctttcatcagcaggttctcaaacctttttttatccaggttccgatgttccgcaagctccatgacgtctacatacgcggttccgccaaacacgttcattgcttcgattcctacattcatttctccaagcccccagagtaaagaggcttcccgtgaagcctcttttattttttcgttcaaaactcaacaagcagcctgtcaacgccgtgaaatacagggctcggaaccagattcggctcttgatcctcagtaaaacgccatgcgggcatctgttcaaaaaagtgggaaagcgcgattttcgcttcaagccgggccagcggcgctcctaagcaataatggctgccctgaccgaatgacagatgctgattcggctttcgttccaagtcaatctgatcgggattttcaaacttcttttcatctctgttcgccgatccaatccacgcatatactttttctccggccggaatcgtttttccgccaatctcgctctcaaccgcggtgtagcgggttacccgctgaatggaaggtctgaggcggatgacttcctcaataaagtcaggaaggagcgccttattttcaagcagccggggcagaatatgcggaaactccttgagactgagaaatgaatttccgatcacattttccgtcgttacgtgccccgcgacgatcaacaagccgcaaaaaccgattaattgcttgtctgacagcggctctccgtctaaatcagctgaaattaaatggctgattaaatcattttgcggctgttttctccgctgtaaaataaactgcataaagtatccgatcatctgcttttgcacttcattcattttcttttcatcttttacattctggctttggtcgacccagcttttaaagatatccctgtctttcggaggaaatcctaaaagctctgcgatcacgataatcggaagcggaaatgcgtaatcttcaataatgtccatcctgccttttgaacggacggcctgaagcaggtcatcagcgatagcggctatacgcggtgcaagagactcaaccgatttcggcatgaacggctgattgaccaattttctgaagacggtgtgttcaggcgggtccattttcaaaaggctgtctttgttaatatgccggatcattttttcctgcttgtccgcacttaagtatttatgatcggaagaaaaatgactgtagtcagaaatcacccgcttcacttcatcataggtgaagatttcccagcaatcttccttttcattgtaatgaacaggagaggtttctctcatcgtttggtaccacttgtacggctgctgctgtctgatttttgttaaactggtcattttcattcctccaagatgtgtccaagatttgaaatgacccgccaaagcttacgagtaaacccggcgggcggatatgtgaatttacggtcttattttggcgggctgcttcagcatctcaccatgcacgttcagtatcttttcctgcagtttcagaaagctgtgttctgtcattccgtctgccgaatataaaacgccgcaaaattcagaaatcgtttcggctgcgctgtcttcagccaataatgtcatatggttggataccgccacatccatgatggcgatgtttgtcatatgctcttgccactggctccagtagttgacgaaatcagcggataaaatatcggccctgatcgtaaaatacggatcaagctcacccaagaaaataccgtttttatttcggaaataatagcatgtcaccccgttcggatccggaagcggcaggagttcgtaatcagtgatttcgtaagcgtcctgaacgtttatattctgcctgatcagatttttcaccaacgcgtccgtcttcgttaacccccgctgtttggcttttgctattaattgctctaaaaatatgtcttcatgaagatcggcatctagttcatcacggtgaatcaaggtttcagaaatgcgttccggatgttgatagatcggtgcaaataaagccatgttcaccgtctgcagcatcatatttttatcaaataattcatcaggaatgtttatttcccgcgcacccgccgagtcaaaggagtcgagcatgacgattgactcaacggtttctccagccagctgcaattgccgggtgacttcataagcgagcatgccccctaatgaatagccgcctacatcgtaaggcccccggggctgcacggtacgtatgagcttaacgtaatattccgccatgtttttaatgccgcggatcggttcccggtctgtcatccatcctcttgcctgaattccgtaaaaaggacgcccggtccgttcggcaacaggctggtacagctccactgcccccagcgcggaatgaaaccagaaaatcggtcttccctttccccccgggttaagacagatcagttcgggcggttcttgatcatctgtctcttctgatatatcgttttgtttcgtatgttcctcatgtacttcatcagtgtctttttggacagaaccggtcagatacccggctaattttgcgattgtcggatattcatagaccagatttgccgtaatagacgcttgatacgttttattaatagactgaacccattccacaccgataatagaatccagccccatgtcaatgaatgcctcatgctcatcaatatcttccggcttcagaaacaggatgtccgcaaggctttctttaagctctttgcgcaaagtgccgtcagcgatgccggcaaggggagtttctgcttccgggatttgcggacgtaccgctgtttcctccgcttcagcatactcgggtttctttatttgccccgctatatattccgcaagctcctcaagcgtcgggtgttcatacaccttattggcagtaatctcagtgtggtacgttttatttactgtttgtatccattcaaccccgataatggagtcaagccccatgtcgatgaaaggctcatcagcatcaatatcttccggtgacaaaaataaaatatctgccaggcttatcctcaattcttcaagcaatgttctattgtcttcggaaacggcgttttccggctgctggacagaaacagtacaatccaaaggctgtaagacgatcgttttttgcaatgtctccggttcaaacgctgtcatttcgatctcagttaaaggactcagagaaatcagcccttcatgttcaggctgtggcgaagacaggggaacggtttgcgtttcagactttttcatggcttggcctggtaaagaactgtttacatcagccgcccaatacctttcttttaaaaacggataggcaggaagcggcgttttataatattgccctccgtcaaaaagccgtgtgaaaggaagatcatatcctctgcaaaaaaggtcagcgatatgtgccaggctttctctgtactgtgcgggcgaagccgccgagcggcactgttcaatgcattccattccgaatgttttcattccggcttcgtctgccggcttctggtccttcaaattggacataaacacacccggaagctctctttttacaagccactccgataatacccgcttcagttcgtccgcactgcttacgatacaggcaaaccggtgatgcagatgctttctgccgagcaggagcgtataacttatatttcccagatcgctgtctttgttcttgctgagtgaatccagcaggcgttctgcctgaatttccagctgacgctccgtccgcgcagataaagggatgaggcaggccggttttgccggtgaccggcgcacggtttgcggcgcctcttcaataacaagatgggcatttgttccgctgaatccgaatgaactgatcgcggctctgcgcggtgcatccgaattccgttcccacggtatcagcttttcattcacaaaaaacgggctgtccgcaaattgaatatgctgattggcttgatgaaaatgcagggaagccggaatctgccgatgcttcagcgacagcaggattttaaacagtccggccatccccgcggccgcagcggcatgtccgagattggttttcacagagccgatggcgcaatatccttttttatccgtatagcggcggaaagcgcgcgttaaggcgctgaattcgatcgggtctcccagtgcagtgcccgttccgtgagcttccaccatttgaatggtttccggattaatgtgaaaagtatcatagacatgccgttccaatcgttcttgagaaagcgcgcttggagcggttattccgtttgtagcgccgtcctgattcattgcagagccttttatgacgccgtacacatgatctccgtcactgacggcgtcgctaagacgtttcagcaccacggctcccacgccttcacccggcacgaagccgtccgcgctttgatcaaacgtatggcagcgcccggtcggtgacagcatattcgccttatttgacgactgataaaaagcgggagtggattgaatgaaaaccccgcccgccaccgccatttcggtttctttcgtccagagtccctgacatgccaaatgaatggctgtcagcgaactggaacatgctgtatcaacagtgatcgccggcccttgtaaattaaggtgataggcgatccttgccggagtgacggaattgtgattgccccaaaaagcctgcgcgggcccctgctgtttaaaaatggtctggtaatctccgccgcaggagccggcatacacgccgcattcccggcctcttaccgagtctcccgcatatcccgcatcttcaagcgctttccatgattcttccagaaacagcctctgctgcgggtccatataggttgcttcacgtcccgatatatgaaagaaaacgggatcaaaacagtcaatgccctctataaaactgccatactggcattgactgtcagagacatcccatctgtctgcttttttaatcagatcccgtccggcggctaagttttcccaaaactcatggacattctccgattcagcaaaccgcccgctcatcccgataatcgcgatcggttctttttcaggtaacacagctgctgattttaccgtttcggccggatccttttgttcggggcggtacgtcatttgatacggctcagaaacgctgatgacgattttcccgatatttccgcggtcatccagacagtgatacgcttcttttatgtcttcaaaggaaaagatttttgagatgacaggctgaatgactccctcttccgccagccgctgcagttccaattgatagtccttgacctgatccggattttgaagagacagcttccgcaaatccacgctgtgaaacgattgattgttatgaaggacggacaagtcgactgatttagcggatttcagcgcagtcatggcaatttcgatatatcttccgcccggcgccaggcaattcattcctttttgcatggcatcaccggccagggtattaatgacaacatccaccccacggccgccggtcattcgcatgatttccgtttcaaaatcttcttccaaatagcaaatggtattgtggatcccgagcgaatgcagatactcaatttttttctgtgatccggccgttgcatatatttccgcgccgatatgccgggccatttgcaccgcgatcagccccgttcctcccgtcgcggtctgaattaatattttttcgccttttttaagtccggctttccggaaggcgtctatcattgtcaccgccacggtaggaagagcgcatgcttcttcaaaggtcagccgggccggtttatgatagacttgatgttctttacatgtgatgagattcgcctgagagccaaattcctctcccatgccgacaatcacttcatcacccggaatgacggatgttacatgcctccctgtcttgatcacgacgccgcttgcttcgaatcccggagtgaacggataaggcggcatcgtcggatacagccctctgacacaaagcaagtctccgaagtttaaagaaaaggcgcggacggctatttgaacttcgtcatcttttatctcgggcacttcactgcgggcaatcgtcagatcttcaatgccgcccggacggtcaatcacaacccggaacattcccgagtcatcggactttgcgaaagaaagcggcatccgttcttgtttcggtttctgataaccgttttcctttctttccgtcttcaaaggtttttcagcaggccgttcttcctgaagcgccgggcggattttcgctctttcggtctccagagatgaggctatgatggtttcatattctgccgagatataaccggtcagcagtttcacatgatagtaatcaaataaaatcgttgtctgcagtgtaagattcaatcgcttattaatctctttaatcacattgacggccaaaatggaatcaatgccgtattcagagaaattcagttcttcctgaatatcctcttctttcatttttaatacatcggcaatacttgttttgatgacagagcggacatgggaagcgaccgattccccatcagccttaacagcttgatgctcctctggcgcgcggctgcgggaaacgggctgtgcgggctttcggaaaacttcggccggggcggcgtatggctttctgccgtctctgatcccttgcatccgaacgagtccgtcactctcagctgcgataatctgctgacctaaatcatgagccgtttcagcagggaaacaaaccgctctgtatccttccgaatgcagcacacgctcccacgattttggatataggccgggacttcccggaatccgaagctcagcatcctcataggaccaccagccgtcaagcagcccgaaggttaaatgggtaaaaacagaacgatcgctgatttcgtttatcaaaatcatcccgttgtatttcaggagcgctttcagacggcgcagcgtcaaaccgatattttttgtggcgtgaagcacattggcggcgatgacaatatcgtaaacacccgttttgatattttgtgattcgcaaggctcctctgcattaaacaaggctgttgtcaaatacggcacatcaggtccgtattcctgttcggcatgcattaaaaaagctttagaaacatccgtataacaatattccgcaatctgttttgcaaatggtttcagttttgtaaacagcatggcgctcgttccgcccgtcccggcccctacttctatcagcctgatacgggcatcgggatgttctgtaaggtaggctttcaggtaagcggccgcggaatctgctaacacttcattaaaataatccgcaacgggattatgcttataaacaccttcaacgagccgcattgatgaatcgggaaatacgatatccgtagccggacgttctccttttaaaattgaaggcatcgcttttatcgtcgcctcggccaattcagcttgcgcaagctcccccttgggaagcaggcgtttatgggcattccactcattccagactgtgcggccgtccgggcgctgatccgcgagaagagtgatcgtgtatccgtcatacgcgatatatccgttttcttttaatagattcaggctttcttccagccatctgccgtatgtgccgatcacgccggcgctccccatggatgctgcaggtgtggtgacaggctcgctgaaaaacccgattgactgtaattggtaaaagagcagtttgcaaagaaggctgttcatatgcgcaactccatttctcgttttaaagtctcaagccgttcattccgatccggattttgccgcttgacgctttccataaatgaaggctccgggccggatacaaccgatattgcatcttgatccgtcagtgcggctaagccgtgcggagcagctttgatgaatgccgcttggctgaacggttctgatagtaagacttccagcgcctccattgcttcatcgggttcaatagaaccgatccctgacgcctccatccgttttctgtaagacgggtctgatacaacgcccagactgccccaatatccccaattcatgactttcacttcacaatcaagcaaggaagcgatatggcgggcaaaggcgtcttgaaatgtacaccctgccgcatagttgctttgcccggcattttttgtgaaagaattaacggatgagaaaaacagcacaaaatcaagcggttctcccttaaaagcttcgatcattcggacgctcgtattcaccttagctgaaaaagcgtttctgaaagaagcttcatccatattcgccatacttttgtcggcaagcgttatcgcggaatggatgactcccgttatattgccgtatcgctctcttatggaacggacggccgctttaagcgctgcggcatcttgagcatcagcctgtatataatgcggcgcggggcctgatagggccagcctgtctattttgctctgaatctcctgatccttcggccgcctgccgatccatatcatccgtgccttgtaacgggtgatcatgtatttgctccatgcttctccgatgccgcccgctccgccgatgacagcataaacgccgccttctctgtacgacatacgcggagcggaacttgtcagcacccggactgttttttgcttgtgccaagctccgttacggtacgcggcagcatttccgtccggatctggaggaaggcgccagatgtttttcatctcagacgaatcactgccttcttctgcatcaatcagcctgatgtcccagttcggatattcttttgccaatgaaccgatcaaaccgtgtacgcctgcatgctcaggctgcgggagatcacccggatacacggactgtgtctgccgggtgaccgccgtaaagctgatgtttcggtttccatacccgagtgacagcagcgctttgatgaaacggaaacattgaatcaccccattctcctgctcatcaagcatttcctgactggcggatgcgggtgcgaaacgatccggcgcaatccataagaaatggcggatatcttgataaccggctgtcaattcacgtaatgtttgctcgcttgaatgatccggcgtctccgccagatgggcgcggggccacatttttgccgcggcctttatggtatttcccggctttccgatgatcagcaattgttcctgatcaaccgctcgattttcttccagggaaaagaaagttttgtcccaaacaggggtaagcatcgccgtctgaacttcctgccgtttgctttcggtttggtttgtctgccggacagcccggcaggagaagcccgtcaatctcatacaaacagcgccgttttcatcacataaatcaatatccagcgtcagcgctccgttatctgaccgatcgctctgtttgcggacaagcgcccacatcgttttctgagtcggctgaaatatttctgcctgccgcagggaaaacggcagcatcggagtgtctcctgcagtatctgaaccggcacccagtgacgcctgaaacgcggcatccagaagactcggatggatgacaaactgatcggcggtactgtctgccgtttccggcagcgacagccgggctgcagcccccctctctccgatcatcagctgatcaatgccttgatggctcggcccgtagatcatacccgcatgccggaaagcctgataaacctcatcagacgtcataaccgattggctgcagccggacagccagccctctaaatgaacagacggagccgctgctatctctcccgatacggcggtgcctttactgtataaaatccgttctcccccaggttcttccgataggctgtaaatcgtaaattcaatgtcttcattttccttaagaataaggctgatatggacttctacatccgtccctttatgaatgacaggcctcatccatatgagatctttcaaatacattcctttacgtccgtccggcacagcgtatgcggcacgctcaacggccgctctggccatttcgatcacggcggctcccgggagcaccttctgtccattgactgagtgatcagtgaaaaagaattcccgtccggtaaaaacagaggtgaatttcagctcccaaagatcggatgtgttttcatgaaggagcggatggatcaccgttttgccgtcatccctttttgaaaccgcctcggcttcatcttgaatccagcatctgacctttgcaaacggataggcgggaagactgattctccggggtttttgtcccgaatatagcaagttccagtccacatcgactccctgcacccacattttcagcaaatgaccgtactttctctttttcagccatttaaccatggcttcctgcaaatcttcatcagattcaaacacagccactgtctcatgatttcgcttcgcccgtcccctgtaaagatgcggtgcgttttcattttccaagtacgatctgagcttgtcctccagctccttaagggagtccgcaatgagagccagccgctcatccatcgcttcgcgccccgcttgtaaagtgtacgcgacatcaaataagtccggcttatcaatatgcttcttttgaagaaaagcaagaaggcgctccgcatattctgtcagacgctcgccatttttcgcagacagcagaatgaccgccggctcttggctgctgattgcttgtttgacaggagcctcatattcttcaataatgatatgcgcgttagaaccgcccgcaccaaagctgctgattcccgccctgagcggctgttcttctccgtctgctgaaatccgtttccaatctgttaattcacggcagacggaaaacagcccttcatcaaattgaatattcggatttaaaacatcagcatgcagagatggggcgatttgtctgtgcttcatctgcagcagcacttttgtgacagcggcgatgcctgctgccgattccccatgtccgatatttgatttgacagacccgacaagacatgtttcagaaacatcaccgaatgcctcggttaaagcccggatttcaatcggatcgcctaatttcgtccctgtcccgtgcgcttccacatagctgatccggcccggagatacccccgcttcctgtaaagcttgagaaatgacttcgctttgcgccttggggttcggtacggtgtaaccgctcgctctcccgccgtgattaatggcagctcctttaatgacgccgtaaatccgatctccgtcttgtacggcgtcttctaaacgtttaagaagcagcaccccgaccccttctgccggaatatagccgtcacccccggcgccgaaactcccgcagtgtcctttagatgagatgaactgcccctggctcagcatgaagtacttgttaggatgaacggtgagattcactccgccggcaagcgccgcgcgaatccgatgatcccgcagatcccggcacgccatgtacaatgaagtcagcgaacccgaacacatcgtatcgaccgacatgctcggcccttgaaagtcacaaaaataggagacacggttagcaatggatgaaatcccgccggggagcccgatatgccgtcctttcactcccgcttcagccgcgaatagcgggtattcctgatacatgacaccggcatacacgcctacctgacggcccagttcaggggatgtcctcgtatatcccgcatcctccatggccatccaagcatgcattaaaaacagccgctcctggggatcaaggtgttccgcttcccggggggaaatcttaaaaaactcaggatcaaaatcggcgatcccgtcaatgaacccgccccatttgctgtagatcgctcccggcgccgtccggtcctcggaaaagtaatgttcccatttccagcggtctttcggaatttcggtaatacaatccttgccttgtttgagattatcccaaaacgcatcgatatcatcggcctgcggatacttgccggaaatcccgacaacggcaatatccagcggttttcctttcgtttcctgacggctttgattcccggacggggcaaaagacgcattttcaagccgatttggctgaagcacttctttcacagacgcatttttcaattccgccagctgttccccggtatgactgaggattgcggcatcaaatgagagaaacccgtcttttttatgtttgattgtattcaccacatagacggtatcagacatgacaggtccgtaaagcgtcagcctctcaatcatgagcgggacgtgaatccgctttttcagctgcaattcttcttcaccgagcgacatataacatgaattcaatataagcgggtcaaatgcaaagtgatgcagatcgcctttttctttttttcctgataagtccagctgcaataaaaaggaactctcactcattttgtatcccgccgttaccgttttcagcatcgggcctatcgtgaagtcggcaaccgaatcgtacagacgggaaatgacatccggccccaccttttgtgcatgcgactttatttgttcaacgtcatatgatttttttatgggtgcctctgtatatctgcttatttctccttcggcacatgtctttcggctttctttaccggagacagtccagcttgcggtaaagcgttcggcactcttttctgccgcaaatgaaatgtcaatctgtgcggcctctcccggctccagcgtgacgggcccgcccgtaaagcggatatctttcagctcggcgggatacgtgccggaacgagatgctccggatgcttcaagcaccagacacggatacactacacccatcagtgccggtttgccgaaaaccagatgatcctgaaggaatgcttcatgttcatagaaagtaaatgtctgactgcctgattgtgtttcagagaccggtgctgcatccgcgacaaggccggaagattcatctgttccttttgtttttatgtcttcaagcagttcggatatgctgctgcactcaaataaaagagtcggattcagacgcagatcaaacgacccttcgatgtctttaataatggccagaagctgtgacgattcaagacctaattcaaaaaacacggtgtgcgcatcatttcttgtgactggacggcctacgtatgtcgagaaaatgcggtataaggtttcctccatctgctgaacgcctggtgtcagctgccggtctgtccgcacctttttggctgtcaggccgagcagtgaagcaatatgcgcaccgctgaggttgtaaaagtcaatatccattttcaccatttcagaaggcgtgccggactttttcgaaatcaccgcgtaacagcgctccgtaacggtctcagcggcaataaacgactcaaaataaatcggtaaaaacaactcggcgcctgcagctgtctgcaatacgccggaggccatggcggcaccgtccatcagcgcgggatgaaagagcgtgccggggagattttcccggcatgaaccagactgccgaatatcaaggaaacatgcctcttcataagcatagatctctccctccggcttcatcagcccgtcatgcgacagtccgcggcttctcgcggcttcgtaaaccgcatgcaaggagactgatggaagtgcggcttgttgttttttctcccctgcgtcaagacgcctgtctgatgagaagacttcttcatgcatctccgcggataagaaaaccgtcccggaatccgccccgcaaatcgaggcagtccagaactccttttctttactgaatatgacactcacatcaagccgctctgaccgcttcactgataaaggatgataaatggtcacccgtttcagacagattgaacggaatgaaagatcaaggctttgctttgccagctgatacagcatatcaatataggccagaccgggcatgacagattctccgtgaacaagatggtttttcataatgggatgctctgccgtcaggcgcagattcactgtttttttcatggttagtccccttttaaaaacgtcacgttgtcacctgccagaacgagtctgcaggtgcagtgcttgtctctgcttttttctcatatttctttaaaagatccgcaatgtccgttttttcattacttgttttttccggttcactttccgtgctgttccagccgcccaaaagcgggtagtgtttttttctgaattccggcggctgaggcgaccggtgatgttcccgctgtctttcacctctgtattcttcaacgaggatatgagcatttgtcccgccgtcaggaaatgaactctgagctgcgacgcggggtttcttctctgaatgccaatcaacgggttcacgattaaaatgaatacgcgacgcttcaaagtcataatgttcaaatgggtcacgcgctgataagaaaggcggaatccgcttataatagacgctcagcacacatcggatgaagcccgcaagacctgaagacagaagcaaatgccctacattcggtttcaccgatccgatccggcagggcagaagcgttttccggttcagctgatagacatctgagagcgccttgatctccaccgaatcaacgattggggaaccgcctccgttcacttctatatatccgatgtcttcaggcgacttttccgccatgtcaagcgcagtttgaataacgtctctctgcgctcttatattcggtgaaccgggcccgagcgtccggccgtcattgtttaccgagacggcttttatgacgccgtaaatacggtctccgtcccgcaccgcatcgctcaatcgcttgataaaaaccgcccccgctccttctccgagcacttctcccgctgattcacggtcgaatatatgaaacacgccgttctcatttaaaatatggcgcgctccgaataaccggtgcgcggacggagataagagcagactcaccgaaccgactaaggccgcgtcaatccttccggccaaaagggcgtcttttgcaaaggacagcccgatcagccctgaggaacatgctgtatccacgacaaggctcggccctgtgacattcaaaaatcgtgaaatgttggccgccaaatagttttgccccgcccccaaaatcgggttaggcgcctgcaggatatgttccataccggctgaaggctgcgccctgccgccgatgtacacgccgactttccggcccgacaaatccttttggccgtacccggcatcataaacggaatgaaccgcttcttctaatatgatccgcgcctgcgggtccataattgccgcgtctttttcagagatgccgaaaaagcccgcatcaaacatgtcgatatcatcaatccaccccgcataatcctttgcatttgctgttgcatgccagcgcgatgcggggacaggccggatggcggtattccctttcatcagcagctcccaaaaagcatccgttccgcccgcccccgggaaacggcaggagatgccgacgacggcaatatcgtcttcggtatccgctttcggcttcatggatgttctctcttcagcggcggcggttacatcaggctgaacgtccccgtcttgaacgaaaccattttcttttgtcacaaaatcggcttcatgatgcgctgcgaaatagtcaaccatttctgtaatcgtttgatattgaagcattaaggacggtgttaactttatgctgatccgtttttgcaatgattgaaccaattccgcaaagagtattgagtcaatcccgtattcatcaaacggcatatcatcttttatctgctcatccgtcattttcagttcttcgctgaaaacggtgcgcacccattgacgaatcatatccttcaccttttggtcaccggcactgctttttttcatgggaacttcagttttcttcaccttcagaagatcaccaaaatcagccttactgtcttcgggaacacaaggaattccgcagctttgtccgtttaatatgatgtaatctaaaaacttcagtccgtcttcggcagacagcctggaaagtcctgatttttgataagcaggtgtttccggcaggccttcagccatgccggtttctttccagacgggccattgaacggctttaacaaacacgtttcctttgcctgcctgatgattcgcaaaagagtccataaatgaattagccatcgcgtagtcactttgccccgcagcaagcgaagggatcagacccgaaacggatgagaacaaaataaaaaacgacagcggctcattccgaacggcttcatagagaccgcaaagcccagttactttcggcgtgcaaacgctttcgatctcagtttcggctttgttataaaaagcggggtgttctcccattgcaccggcgcaatgaaaaacgccggtaatcggtcccatcgtgccgcggatgctgtccgtcatgttccggagccccttttgatccgtaagagaaacgctgtaataacggatctccgcgccccgctcggctaacctctgcatccgctcggctttttccgggagaatgccatcctttttcatgtctgcccactccgaggaatcgggaagcggctcccgccccatgatgaccagttttctgcacccgcgtgaaacggcatgctccgccgcaattgcgccgatcccgcgcgatccgcccgttattaacagcacatcatcagacgaataggaaagctcaggcgccgcagacacattcgtacccggcttcagaaacggcacataacggcgattcagcctgtagcagcattcactgccgcttttggcccgcggctgtaaaaattcagtttcaatctgtctgcttaattcttctgtatgctcaatcgcacaatcgctatctatcgtaaaagaatgaatgttggcatactcagcgcccagcatccggtacagccccgccgttttcgccccctgcatcagaggtttactttccttgaaaggctggaggcggtgtgtcacttggctgagcacagcgccgctatgacggaatgattccagaacctgctgtaaaaaggcaagctttccgtattctatatcttcccgccgttcatattccgcatcatatgcggttatgtcgacgaccccgagtatctgtttgttttgaagagactcccgcactctgccgtaaaggtttcgccccgatgcggcagcgtaataatcggcgccgtcttttgcctgatggatgaaacagatcgtttcaatatggccgtttcctttaaatagagcatcggccaatcggctcgtcttatcagttgcaagtatcattactgttcctgataatgcttcagactccgccggatcttgctgcttccagtctttttgaagaatgatcttttggttttccgccggttcgtctgtctgtttccggatatccgcaggcacaggcacccaataccgctccttcgcgaacggatatacaggaaggctgacccgtttcggcttctctccttcgtataactggatccagtcaacggcggctccttttgcccactcagtgagcaatctggaatattgcttgtttttcaaaagttcggccattccacttgttgaaatatcatcttgagcacgtccgcggaaacacccttcaatttccgttttccgttcaagcacatccttcagtttcgcttgcaggccgcaaacggatgtaacgatcaatgccagccgttcaggcatcgcttctctgcccgcttgaagcgtgtaggccaggtcattaagattgacttctttttcccgtaaaaagcggtcataccgtttgacatattccaatagccgttcttcattttttgccgaaagcagaaacagaaccggctcgtcttcccgtatactcagcgatttcttttcagcctgcggcggcagatattcttctatgacaaaatgggcattgctcccgctggcgccaaaagaacttaaacccgctcttctcggctggtcaggatgtgacggccgttcccattcttccagccggtccgccacataaaacggcgtatccggaaatggaatatggggattcagcgtgtccgcgtgcaatgacggaaagatttctccatgcttcagctgcaaaagcacctttgttaatccggcgattccggcggctccttctaaatggccgatatttgatttggcagagccgatggcgcaaaaccgcttcttgtttgtccatttgtggaaagcgcggctcagcccttcaatttcaatcggatcacccagagacgtacccgttccgtgagcttcaatataactcaatgtctcgggatcaatgccggcactctgaaaggaatctgtaatgacttccgcctgtgatgccggatcaggcacggtcaaaccggatgtttttccgacatggtttaaagcggagccttttatgacgccatatatcggacagcccatcttttccgcttcttgaacggttgtcagcaacaccgcgccgacgccttctcccggcacatagccgtcaccgccgtcggcgaagcttttgcagacgccttctgaagacagaaatccggcattcgccaaaaacgcatatttatgcggatgtgtgaccgcattaacaccgccggcaatggcgaattcgcactccccccttttaatgctttcacatgccaaatgtatggatgtgagcgaagaagagcacatcgtatcaacagccattgacggccctgtaaagttcaggcagtgagacacgatattcggaacggaggcaggcgtcacgcccatagacagcggtgtgccccgctgtgtgatttcagcgccgaacagctcataatggctccaaaacacacctgcgaataccccgacgcgttttcttttttgtgaagatggcccgcgcgccgttctgtcctgataaaaaccggcatcttcacaagcttcccaagccgtctctaaaaacagccgcgcctgcgggtccatcatttcagcctggcgcggagtcagattgaaaaacagcggatcaaagctgtctatgcgatctaaaaatcctccgtaacggtagaactgatctgcttcatatgagaaaggataacctttccatctgtctttcggcattgttgtgatacagtctttacctgagcgcagattttggtaaaattcatcgatgctttccgcctgcggatatcttcccgccaatccgattacggcaatatcgtgctcttctgtatgtctctcttgttttcggcttcttctcttgacagctgcatgggataatgaagagcggttcttgcctgccatcggaaccaatcgggccatgctttcagttacagcgggctccttcccgtataaaataacggattgcagcttgccgagacgcagcatatattctagtgaagccatcccttccccggccggaagcgggctggtgccggttgcatcattcataatctctttcatcaagctgtcaacctgcatgccgccatcttcccaaagcggccagttgatcgtcatagaagccccggtccgttcgcctttttctgctttgcaatctcgatatttcatatattcatccataaaagcgttcgctgcggcataatctgtctggcccgcatttccggtcaacgccgagaatgaggaaaatgcggcgaaaaattcaagctgttcatgccgtgaagcttcgtccgcatgaatcaggccgctgattttcggcaggaacacccgcttcaagtcagaactgtctttttggatgataaattgatcttttaaaacaccggcacaatgaaaaatgcccgtcagacggccgaaagtttctgtaatctgagcaaatgcccgctctgtttcggctttgctgccgatgtccgcttgaacgtaaagaacttctgctcccaatgctttcagtctgctgatcttctcagactgttccggcgaacggccgatgagtgcgagcttcaccttttctttttctgcaaggtgacgggcaagcagaaatccaagaccgccgagacctcctgtaatgacatatacgccgttttgtttccaaggagactgtgtctgtccgcccggtttctcaatacgttcgaacaatctgatctgccgcatatcgtctttataccgaatgtctgtgcagcctgcatgggagcagtctgcttctgttctaatgattgcggccgtctcacttggcaatttctcattcttgtcacagaaggtgatcacctgagtgcgaagagccggattttccagatgtgccgttttcagcatagccccgagagcggaagacaatgccgctccattctcaacggcgcatacaagctgaatcaatgtatgttctttcggatggtctgtcagttcccgtttgagcatacgaaatataagctcggcatctgctccaaactgctcatctgcaacctcatgctcccttttcagttctatcacttccgcttccgggcaatgtgtgccgagttcaccggtgagacggggtcctgcatcggcagcgataataagatgacgggtgtgtttttgcccgttctgcaccgccgtttccagcggatgatctttccaggcgggttcaaaaaacagaacctcatcagcaatgtcagcgtctgatgtatgccgttcttcggccgaatctttcagcacacagcccgcttcattgataaggtaatccgcaaggcggcggacagatgaatattcaaaaagcagtgtcggataaaactgctgctgaaaagtctgctctaatatctttacaagcttcagcaaatgcgccgagtcaagccccatatcataaaagcctttccgcacatcaatatcctgtgccggacgattgatcagcctggcgatttccgactttatgtaagtcaccatgttttgttccggcgtttgctgttcagacacgtcttctgcggccacaggactttcgggctctccacggccgtttctgttctgctgaggcggcttctctttgtctatcagatgggtaatcatattcgcttgtctgaccctttttactgtcagtttctcacattcggccaatacgttcccttccctgtcgtaaatcgtgaagtcggccgaataaaaatcaggttcgctatctgatgcgccgctttcagtgcggctgtttttcgcagaataagtgtaaatcgttttcggaaaccgctgatatatgcaaaaacgattaatcataaaaggaatataaggtgtgtcattctgcttttgggccgacaatgcaaaggaagagccggcaagggtggacgcatctaaaaaagccggatgcgccttgaatttctcccggaatccttcagccaaatcactcagagtgagctccattaattcttctttatcctgaagctgataaacggccccttcatttttcataaactcgccatgctcaatatggcttcttcttgcaattccgtaaatgtcatgcatgtcccattttcggcttgcgtttttcatgaatgcttcaatattcagctcttttgcccggggcgtgtctttttgcaaataaagctgacattccatattctcatcccgttttccgccaagcggtgtgccgttttttgctttttcgcttgtaatctcaactttccagctgtcacgcgccggcgtaaaggtgacatacaggtgtttatcaaactcttcagatgttacaacaggctgcttaaaaataatctgtcttaattctataggcctttcaccgagatacccggcggcgagccgatacagcatatctattaaagtcacgcccgggaggacgcggatttggtgaacgcgatgatcccggacgatataattcgtatggctgattttctgcaggaacgttttgacttgatcggtggcaactgccaatctatcacacctcgcttatttcaaacattgcttctgtgcccgcctcattttcttccgcttcggacaactgcgctttttcaggccaataccgctgttttcggtatactgtctggccgcctttcggttccatggtcgcttttcgttctttcggaattccttcgttgctgacaatgatatgggcgttgttcccgcccaaaccgaacgcgctgaccccggccctgagtatctctttttttccgtcccaccgcttcagctcaagcacaggataaagcggcgaatcatgaaattgaaagcgggggttcggtttatggcaatgcaaagtcggcggcagttcttcattggcaatcgccagcaaaactttgatgattcccgccgcgcccgccgcactcagcaagtggccgatattgcttttgacgctccctacaccgcaaaattgtttttcatcggaataagcagacaagacattggttaatccttttaattcaatcgggtcgccgatcaaagtaccggttccgtgcgtctctacgtatgtcatggtgtccggctcgatttgcgctgattgaaccgcctgctcaatcaagtcctgctgcgcccggggattcggcgtcgtcacccccattgtgctgccgtcattatttatcgcagagccgtcaataacgccgtatattttatcttcgtcttctatcgctttttcgagcggcttcagcatcagcacaccgcagccctctccgattcctgttccgtccgcatcggcatcgaaagattttgaacggccatttggcgataagattctcgccgcgctcattgtgagaaaaggtttttcatcaagcaaaatgtcaaccccgcccgcaaaggccgcctccgcttctccattttgaattgcctgcacggccaaatgaattgccgtaagcgaactggagcaggccgtatccacgaccagattgggccctgtaaagttataaatgtgcgccatatgtgcggtaataaaattttgccccgcgccaataatcgcgtctttttgcaaatattgaaatttctgatgaaacgcacctgcccttgcaccggcaaaaacgccgatacggcggccccagagatcctctttttgataaccggcatcggccaaagcttccgcgctcacttcgagccactgcctttgcagcgggtctatcatcggtgccagcgtttctgaaatattaaaatactccgggtcaaattgatcaatatcatgaataaaaccgccccatttactgatgctttttccttcttgatattcacccggctgatagtgttccccggcgttccatctgtccggcggaacttcagtgacggcatccgttccgctgcggagattcttccaaaattcttttatatcccccgcttccggaaaatgacaggccatgccgatgatcgcaacctttccccgtttcccgggcttatctgccgtttttttgctctgtttcggcgttttctgcaaagggaccttctccgcgggaaccgctgcatctgccgaaaaagcttccggacaatgtgcggctaaataatccgcgagctgttctatggtagggtgttccagaaggacagtcggatcaattgaaacggacggcagtttttgatcgatctttgtcagcacttgcgccagaaagatagaatccattccgtattcctgaaaaggcacatcgatatccatatgcgtttcatcgatactcagctcttttgccaaaagcgacttcagccaagattgaatatcagtccggctatggacccgtttttttgtttcaggaggtttggaagctgttttcattcctttatgggcggctggcttagcgttttcaagcgctttgatgtcccaatcatatttcacttgtgccggcagcacgacagttccgggtctttctcttaaaatgtaatcaagcatcttgagaccttccgcgtcagagtgacgcagcaatcccgtttgctgatacatcccgctttttgtatccctgctcatgcccgtctcatcccatgccggccattgtatgctcatgatgccgccctcattgttttctgcaaaatagtccatataagaattagccatcgcataatcgctctgtcccgccgcaagaatcgggacggcagccgagacagatgaaaacaggacgaaaaatgccggcgcatcatcctttacactctcatacagactgtgaaggccgtctgctttcggggcgagcacccgcgcgatactgtttttggatttgcggagaaaagcagggttttcacggtccgcaattcctgcgcaatgcagaatgcctccgacaggtccgagcgttgtggttacctcttttataagccgtccgacggcctgcttatccgtcagatcaactgctgagacgcacacttttacgccctgtgattccagctttcggataagctgtattttttccgaaacgacagggtctgtttgctcaagatcccactcggttttcggcggcagctcctttctgcctgtcagaagcagtttcttcacaccgtatgcggaaacgaaatgcttggcgcataaagcgccgagtccgcgcgttcctccggttatcatgaggacggcgtcttttggaaacacagtccggtctgtttgcacggcttctggttcaatctgatcagtctgccgaagaacatagctgaagcgcatgccgtccctgtagcaaacagcagattccgttaagtctgattcaatttcttgtttaataaaagcggctgtctgctccagcggctcttcaggatcaatatcggcgtgacaggtgagaatatggctgtattcatgccgcagcatgcgataaagccccgctttttcaataccatgcatagcggccgcattatttttgaaggattcaaggccttttgtaagataaagcattttcatgttttcttttccgcggccgtattcaatcagctgctgcagcgatgccacccagctgatgtcctgccgcttttgtcgggagccgcagccggtgaagtcaataaacccggaatagatggccgcattcgcatcctgtaagaaagagatgagctgattttcctgcacaatgtcagcatcattcagctgttttttcacctcggcggcaaggtcttttgtatcctcggagacgatgagcgctattttgctgaatggctcggatgaagacactgcctcgcaaggctcccatgttttctgcaatactactgttttttgattcgaaagcggcagctgctcccgtttcggcacccaatagcggtctgctctgaacggataggagggcaggctgatgcggcgcggcttactgtccgtatacagctgctcccaatctgtgtcaaatccgtttacccagagccgcagcactttcttgtatttctttttctcaatccaggcgctgacgaggtcagctgcgtcttcatcgtctgagaacatggagatcgtgttattctcgcgttttttacggccgctgatgatatcttcgctgttttttcccgtcagaaacgcgttcagtttttcagtcagttcctctgcggagcctgcaatgattcccagcctcgcttccattgcgtcccgtccggtctgcagtgtgtatgcaacatctgcaagatcgatatggcgggatgatccgttttggataaaatcgcgaaggagacgcgctctttctttcagccgctcttcatttttagccgacaaaacaaaaagagatgacgctttctcacgggtttccggctgttccgtctcacttttgcccatgtattcttcaataacgatatgcgcattgacgcctccgaaaccgaatgagcttacacccgcccggcggggcaggacccggccgttttcatcacgcagcgcttcccactcctttgtttctgtcacaatgtaaaacgggctgtccttcaatttgatatggggattgatgttctcgcaatgcagacttttggcgagcgtccgatgtttcagctgcatcaatactttgataacgcccgcaatgcctgctgcgagctccaaatgtccgatatttgtcttcactgagcctatcccgcaatatccgcccggagccccgtctgtttggaaagcttttttcaatgcattgatttcaatcggatctccgagcgccgtacctgttccgtgcgcttctatataagtgatcgttgacggctgaataccggctttttgataagcgcttttcagcacatccgtctgagcctgcgggttcggcgcggtaagtgacgctgagcgtccgccgtgattttccgctgtaccgcggatgaggccgtagatgtgatccctgtcatgctcagcctctgaaagctttttcaagacaatcatgccggcaccctctcctctgacataaccgtcagcctgatcagaaaatgttttgcagcgcccgtcttcactgagcatgcctgctttttgaaaaccgatatgcccttctggcgtgacgatcgtgttgacgcctcctgcgaccgccatatcacaatctcccgtttcaatggcttttaccgcgcggtgaatggcgactaaagagcttgaacaagcggtttctatcggctcgctcggcccgtggatatcaagaaaataactcattcggttcggcccgacggacggcacgattccggtcatcgtatacccctcgacaggaagacccgccttattgattaaggtttgatatccgcttcccaatgtgccggtgaaaatgccggtttttgttccggcaatccgttttgccgagtaccccgcgtcttcaatggctttccacacatacatcattaataggcgctgctgaggatccatcatttcagcttctttcggagatatcccgaaaaacagcgggtcaaacccggcgattccatctataaaaccgccccatttaattgacgttttatttgcatccgctgccggatcgccgtaatattcgcgccaatcccagcgatcccggggaatttctgtgatgcaatgctctccttttgataaacgtgtccagaattcatctatgtctttcgcttgcggaaaaataccgctgattccgataatggctatcggttcggttttttcttctgattttccttttacggatacgggcgtttcccgtttgacatgaacggccgccggagcttcagcttttcttattccggcttttggggcggttttaaaattctctctttctaagccgctgaatgcttctttccattcagatatcaaatggccgctcagtttgcgcaatgtcggaaattcaaagaagatagtcgggctgagctcaagctgataagaccgatttaatagatttgtaaattcagtgaagatgatcgaatcaaatccgtattccgtcagttcgctgtcagcctcaatatctttcatgcttacctttaaaagatctgatacatgacgctttagtttctcttgaacccgatctttcagatctcctgcatctgtctctgccggagcttttgcggcggcgctttgttcttcacgcagatcgaaaatatggctgcgaacccgtttttcatctccttctgccaccatgatctggtgttctccggaggcaaaagcggcgt

SEQ ID NO: 106 - DNA, 330041 bp, Bacillus velezensis FL50S
ccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgatccaagtaatccgagtgatccaggcgatcctgatgacccgtggaatccggacgatccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgacccaagtaatccgagtgatccaggcgatcctgatgacccgtggaatccggacgatcccagtgatccggaagatccgtgtgacgacctgttttacggccgcattggctgctgtgagtgcggggattgtgaggactgcgattggaagaaaaaaggcggggagcgttcataaaaaaagagacgggtgaagcatatgccgtatccaagcatctcaaaagcgaaacagacatcttttgaagccttgcattgtctcacgatggcgctgttaaatatattatctgtgaccgtggataaaagaaggggttcaaattacaaagaagaaatcaggctgttctccgcattgtgccgctggcagatggaaacaggcggccggctgtttttaatgatcagcttggaagaagaacagaagcagatgtatgagcggcactttcatgaaatgaagacagtgacggaacgaacgaaaaaattcatttgtgaaagcccgcgcgaattccgggcgcatcccattacgaagcgggctgtcaggcagcttcaggaatgggatgcagaatcaactgccgaacctgccgtcagatgggtgcggcctgtcatcataacgatgaacggcactcctggacggccttggttcaatcaacaactccaaaatcgggaaaggtgagaaaatgagcggaaatgctgaatgtaaactgactctttgcatgattgtgaaaaacgaggagagatatatctcccgttgtttatcaagtgtacaagacatcgctgatgagatcgtcatcgcagacaccggatcacatgataatacaaaagatatatgcaaaagctttcaggcaagagtgtttgatttcgaatgggagaatgatttcgcaaaggccagaaattacgccctgcagcatgccgaaggggattggattttagtgcttgacgcggatgaagagctcgatcaggagacgggccgttttttaacttctctgcttcatgacggattaccgagccggggacttttgaaaatcatcaattatacggggaagcagctcgatgaaaacgaagcgtttgaaagcatgcagccgaggctgttccgcaatcataaaggccttctgtatcaaggcagaattcacgagaatatctcggctcccaatgaggaagaaaacaatgcttttttcacgctcccatgtgtgattcatcactacggctacttggagcaggaagaaaaaatcaaacaaaaacataaacggaatatcagcatattaaatgaagaactttcagaggaaaatcctgatccgtggctagtctatcatctggcaagtgaatgttacagaataaaagactatgaaaaagcattacatcttgtcaacggctcaatatttcaatttttaagtgagaaacgaatgcctccgtctcttctgtattttctaaaatatacaatattgcttgagctcaagcgatatgaagaagccgaacaagggattgaaaaagtgctcaagctttatcctgattacagcaatcttcattattataaaggccttgtattatatcatttggaaaagtacagagcggcaatcaaagcatttgaagccggaacgcaggttgaaggagaaaacgctgatcacttcattttaaaaggtgccgccgatttcagagctttttattatatggcgaaatgccatgctgcattaaaccatgatatgacggccatcgcttacgccaaaaaatccgtgaaattcaatccgcaatttaaacccgcgaaagaacttctgtctcaattaaaaaaggatcagcggacaaacgcctgatcctttttttgcatgttccattaagataatcgaataatgtttaaagctgcgccggcacttcctctaagcaatgtggccgcacccaataatccgaacagctggagctgaatggtgctgcctgctgtcaaagtcacaataaaggagttattgaagcttgccaaagacgcgaccggggcaataatcgaacttgcagccggagtgccgttgattaagatgcgcgaacttactagcaggccggccgttaaattaatatggtaggaaatatagtaccgtcctgccggagcaacggtgaatacagtatttgcggcattagcggtaatatccgctgagaggttttgttcattcggtaaggaaatgtccgtgccgccgacaataactgcgacaacaccgccgcccgtattgctcgcatagccggaagtggctgtcagacttgttccggtgcttcccggaggccctgtaatgccggtagccccggtaactccggtcggtcctgtaacgccagtaattccagttgatccagtgccgccagtagccccggtaattccggtcggtccggttgaaccagtagcgccggtgcttcccgccgcagctaaaagtgtatagtcagctgaggtttcaggggttcccgacgggctgtttacgtttgcgacataagagctgccgttatacaagacaacctgtccggtcgtgtaagtaggggcgatcagcggattaaaagcaacaatcccttgaagacccgcacccgtggcccccgtcggcccggtcggtcctgttggccccgtcgctccggctggtcccgtcggccccgtggcaccagtcggtcccgccagtgtagggatatttgagatactgtccaattttgaaccgggaaggagctcctgtttcattaagctgtcaagcgtatcccggacgctctcattcaggttaagaatatccgcaagacttgacgggggtcctgttaatccggggatcgttccgagcgcgtattggattttttccccttccgcattcagaatatgtgccattcccagctcttccatagcaattgacgaaagaagaaggttaatggtatcgtctctggacagtgtaacgacaggggtgatattgggcaaattaggctgtgacacaatgtccctccttatgagttggctgaaaatcattttattgcgaacaaagttcccccaaatgagcgtaagcagtactgtatcattatattcactgattctgtccaagtttctgaacgaattcccttcattaatttcatcatatatgaaggaaatactttaaatatagagaaaatacatcgcacagcattcacaaaatcggtcaaaatgacagcgggacatgtgatcgtctataaagcgatggctatatatcttgtgcgtttcctgcaaaaacgctctttttcatttcaagttttctgtataaaagggcgagaagcatggacggtatcgtacaaacaatcattccgataaaggcataccggggttcaatttcatataaaaaacctccgaaaatagtaaataccgcagtgctccagctgagagcaagcgctgaatatataccttgggctttcgggatttgcgcgggtgaaatatttttaattaagtatttcataaatgcatagtgtcccatcgcgaatgaacaggcatgcagcgtctgcgcaagacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgcgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttgatgcggaataaggcaaacatgccctcttttcttgcacggtctgtttccggccgttttgaaagaacagctggcgcatgcataaagcttagggatgcgaatatcagggtgcccaaaagcagtgcccataaaatcgcttgatctccgaatatacctgtaaagacggacaggatgacgccggctgaaacaaaacccgcggatccccactgtcggctagtcccataagcctttaattcgttatgctgtacaaggacgccgcaagcgctgtctaaagcaggcattaaagccgggtaaaacacatgcagcactaatgtgacaagaagcaggctttgaaaagaatcagccggaatataacataaaagtgcgagaagcgtcccgattctggcgccgtttaataaggctttgctgctgaattttcctgataaataagggaagaaaaataatgtggaaatccctcttgccgccaggcccagactcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaggacataaagacaatatgagatatctcatatttttggggtggacgatggaaatttataaaggcgagaaaaagcggcatcagttagaaaaacactcaatcgcgcatttattctctttccccgctgaagagtttatggaagtgcgcgaatatgagcgggacgaatggattattcaagagggcaggaggcctgacttcctgttttacgtgattgaaggaaaagcgaaaatatatgtaacccaccaaaacgggaaagtttctttaattaattttatcaacaaaaatgattacatcggagagatggaactattacatgaagtgtattacacaaaaggaattcaagcctcagcgaagactgtttgttttgttctgcctatttaccgctgccgcgtgcaattgctgcaggatgcgaaattcctgcgtgagctggctaagtttttaagtgctaaggcaacgcttatggcttcgaaatattcacaaagtctggcgttcccgcttgaaaaccggcttgctgattttattttgcagacggcttataaaggggtttataaagagaagcacgtaacggtctgtgattatttgggtgtatcttaccgtcatctcttgcatgtgctgacgcaattctgccaaaaagggtatttgcaaaaagaggggcggggctatcaaattaagcagtatgattcattgtatgaactggcagaagcgctgcagaataagtagcatgcccagaaaaaacagccacccgcaatttacggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacctcaagcgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgcgtctcattttgcacagaagacgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatatgtttttcggtcagcgattgggcgtagaccgtatcttttaccgtcatcggttcgataaattcgacatctccgaaaatgacaggcggacgtacgcagcgtgaaccgtaagactggacccatgcatatttcgtaaaggcgaatccggccagcttttcaccgaagtattccaccatgtccgtccgctcaaattctccgtgaacgagcacgtctaagccgatttcttcctgaatgtcaacccagcgcttcgtttccgcattaataaaggcttggtactgttcatccgtccaatcttttttccgccatttttgccgtgcgctccgcacctcggcagattgagggaagcttccgattgtcgtcgtcggcagaaggggaagaccgagtgattcattctgcagcgccaatcgttcttcaaagcttgccggacgggagaaatctttttccgtcagctgattcagctcttctttttgagcggagttcgctccggttgcgaatgcttttaaagccttaagtgccgcttttgattcttcgatctgctcactgacggccgctttgccggacagaagcccttcttttaagacgccgagttccgccagtttttctttagcgtatgacaggccgttcagcaaatccttttcaagatgctcgtcagggtgtttcgccaccggcacgtgcagaaggctgcttgaaggctgaatccataattcctcaacatcagcgtggctgaggatatccaaagccgcatcaaggcgttcttctacatcgattttccaaatgttccggccgtcgaccacaccggctgccagcactttatctttcgggaagccgtgctttttcaattgctcaaggtttctgcctttatcatgcacgaaatcaagtccgattccctgtacgggataagaaacgagttcttcatatgcatcaactgaatcaaagtatgtctgcaggaggacattcagtcctgaaagctcttttgtaatagattcatagaggtcttttgcggcgcggacatcttcagaagaagctgtcacaagggcaggctcatcaatctgaacccatttgacgccttctgcttcaagctctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcatcatattcaggaacgatgtaatgatagttggtattaaaccattttgtcatttcactggaaacggcgtcttttacaccgcgggcaatcgcaaagtatgtatcaacgggatccgtgatgctgcggaatctttccggaatccagttaaagctgacggcggtatcaagcacatgatcataatgagtgaaatcagagaccggcacgatatcgatatgttggtcaagctgtgttttgacagctgataagaataagccgtcaagctctttaagaaacgtttctttatcagtgtttcctttccaataagcctcaagtgcttttttccattctctgttcaagccgattctcggaaaaccgaggttcgaagttttgattgttgtcattaagtctcctcctttaagtgagatgtaacaaaaaagcctctttctcatgagagaaagaggctttaacttcaaaatgcaagcctctcttatctctcagatcacgtctgatggaattagcaccgtgccttatgagacaatcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacaatttaaaaattggtgatgtgacaaactgatcaatcattatacgagaaaaatatcagaaagacagcagctgtgcctgttcggctctttccatcagtacttcaggcgcgtctaaatacagaaatccgttcccggccaatgttttggcgatgtccaaaggaagggtccgccgcacgagctgggcgtagacttcagcctcagaaagcgtccgctgaaacgcgtcctgttcaagcccttttattaaggcaagcgctccgctcacatgcggggcggccattgaagtgcccgtcagcttcccgtatttatggttgggaagggtggagagaatattttctcccggagccaccaggtcaatctctttattagcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgtgaccgcttctttcagttcaggcacatcgcttggcccgccgagtgacatggaaataatgtccgccttttgttcaacggcgtagttgatgccgttaataatccattcgtatttgccgctgccgtttttcccgccgagaactttaacgattaaaaggcttgcttccggcgcgacacccgaaattccgccgtttgaatcattggctgcaatcgttccggaaacgtgtgtcccgtgtccgttgtaatcggaaatcacgtcttctttgcctccgtcatcatcggtgaagtttttcccgccgacaatccggtctttcaaatcaggatgattgatgtcgcagcctgtgtcaagcaccgcgattttaatatccttgcctttaaacccttttgcccacaactctggcgccttaatcactttaatcccctcaggaagctcgttcacatccatgatctgttcatccgtgacataaggaatcaaatgcatttcaccattcataaaaaagccctccttttttatgcttgcgagtggatacaagggtgttgctactattttatggcagagcatgccggccggaaagagtcatttgaagcattttcataaaaaaggcgtaatctatcggactaaaaaatttcaaataaatggatagtttgacagctttcattttcattcatgacccgctgacgctataattggaaatgggaaaggagaagagagatgaagataaatgaagcgttatacagctatttttcagaacaagtggatcaaattgcgaaagagtggatcgaaacgatggaagattcggatccgaattcgatttattctttgacaaatcccgtcatcacagaagaactgacggagcaggataaagaattttaccggcatattaataaaatgtatatcatgccggaaaaagaatttttagaagagttcgagcggtgggtgattgagcttgcgaaagaccagaagcatctggatactcccgtccagtatgtagtccgtgaattcatgagaaaccggagactatacatcagttattatgatgcgtttgccgataaacatgaatcttcatttgccgagggagaaaggaagaaatgggagaatttaattgcacaagtatttgattttacgatttacacgtttgtcgatcatgctgagcataactcaaaaatgcagctgaatgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgcaaaacggctgattgaacatctgttaattgacctgtcgggtgtagtggttgtcgatacgatggtggcgcatcagatttttaaattaattgaggcgctgaaattgatcggcgtcacgtccactttatccggaatcaggccggaaattgctcaaaccgccgtacagctcggcattaatttctcagagattacggtcaagtccaatctcgctcaggctctcaattatcatcaataacatacataacaaaacaggctgccgaatcactccggcggcctgtttttatacaaacaacaatgaaatgagccagcttgcgccgaataacagaagcacgagcaggaaaaagcaccagtcgccgcggcgcacagtaacagttctgtaaaacgtgcggtttcggctcccagtaaagcctttagattccatcgcgatcgccgtgcgttccgcctttctgattgcgcctgccaatagcggaatggtgaagcgcctgaaggcggagagctttcctttcagcccggaatcagacgccgcacccctgattctgtgcgcctgccggatgatcaggatttcatctttcagaagagggagaaaccggaatcccgcgataacgccgtatgcaagcttgggcggcagcttacactgctgaatcagactgagcatgaacagaatcggatcggttgtaaaaagaaacatcatcgacaaagcggaaaaacataaaatacgaaacgcgatagaaatcccgagcgccgcgttatcactgttgacggcaatcggcccgagtttaaacagcagattgctcccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaatgacagcataatgacgcataacaatacagccgccgcctttattgacgggttaacagcctccagccgcaagttcatttctccgcctcctgtcgtgtttcatccattcataccgcaggggcaaagctaaatgcgcccgctccgcgattccgatatgatcagaaaacaatgagtcgggcgttccgcggtacaccagcttcgtgccgcagagcacaaggatcgtgtcggcataatccgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcatcgtcgcgacgctgagcctgcgtttttgtccttggcttaaagaaaacggatgctgtgaggcatggcgtctcaagccgaatcgggttaacagctgaagagctttctcctttgcggctctgttgctttcaaaaccgaacatcagctcttgaatgacggaatctgtgacaaactggtgttcaggattctggaaaacatatccgatctgtcgccgcagctctttttcagaataggaatcaatcggtctgccgtctattttgatgtctccgcccagcggacggatgagcttggccgcggcagaaaggagcgtggattttcctgttccgttaggaccggcaatcgcggtgattgaccctttttttacggaaaagctcacatcctgaaaaatgacttctgctcctcttgagaatgacagttcgtgaacgctcagcgcgtcttctgccgaaagcgcggcgggccggggttcgggcagagatggtacaggttcgtcaaacagattttctttacacaatgtaaaaggaatgctgacgtgctcctgcaatgagatcacacgcggaatcggaatgccgagctgcatcagctcttcaatctttgtttcaaagataacatctgtctctccgtccatcaccttctgacccgtttcgtcaaggacaatcgtcctgtccatccacggcgcccagtgatcaagctgatgttcgataacgagaaggccgaagcctttttttgcttgaagatctttgatcagccgcactaattcacgtgccgaatatggatcaagctgtgccgtcggttcgtccaaaataatgagttccggttccattgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaggccgaaggcgatttcatcttcaaccgtcagcatgcaaaactgctggtccggatcttgaaacacgacgccgatggatctggcggcgggttctgtcagatgtgaaagaggtgttccgtataaagaaacggttcccgattgaaccccatcgcatgcttccgggtacagaccgtttaaacagagagcgagcgagcttttgccgcatccgctcggcccgagcaacaaagcccgctctcctttgcggagctgaaaggacacgttttgaaaaatcggcttttcatcctgatcataagaaaaggtaagacggccggcggatagaaggggttcagatgcctgcatcttggttcacctgtttctttttcttcttgaattgttttccgagcgccatgccgttcagcactcctgtgtaagccagcgcatcactgattgctttgccgagaaggccggcaagaagcgcacctgagaccagacggatgagaagcatgacggctaataaacccggattcaaaacagagtatccggaaacgaacaagtcataaatgaagcttgtcacagaagaccccataccggataaaagaagcacgggcagggtatatacccgccagcgtgtcgctaaaaagattgcttccgcaccgattccctgtgcgatcccgatcagaatcaccatcggtcctgacggatttccgagtaagcactccacaaacgcggcgatgatttcagaaacgagagccgctcccggtttttgaataatgtacgcggcaatcaccgagacgataaaccagataccgtaaatcggttcgtagctcatccggccgaaaaatcctgccgctatattgcttgcatgagttgatactaaataaatgacagcaaatacaacactgatgacggacatgacgacaatttctctcattttccaatttttcattgtgatctcctgctttcttatcgatagtcgtaagtatgaaagagttgattttacgaaagacgattgatcgtaagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcctgccgcatgttttatctcagccgataacagcacccctagtgcgtttcctatacagttttttatgatgacatcatcatagttgatcatgtctgatttgtaaacagcctttctccgaacagagtttggaatcggaccggaagatcattcataaagataagaagagcccttttgatcaaaaggaaacggaggacatctatgtttgttcatacagtgcagtctggcgactcgttattttccatcagcagaaagtacggataccctgttgacagcatcagaagcgtcaacgggcttgaggaaacgaatatcgttccggggcaggcgcttttaatccctcttaatgaatatacggttcagccgaatgatacgtttgccgttatcgcaggtaaggcttatgtgccgcagatgcagctgatgcaggcaaacccggatattccgccgaaccggctgcggacgggtatgaaagtgaagatccctgatatctctaactatcttgcgggaaccctgcaattttatgtcattcggacgcctgaagcggatagagagctgattaatgattttgcgccgtattcttcggcgatttctttgtttgaatatcatttcggcccgaatggagatatcatgaacgatttaaacgacagaaccgcaatagaaaccacatggcagaacagagtgcgcccgcttgccgtcattacgaatctgacagaagggggattcagtccggaattagcccatcaagtgctgcaaaatccggcggcaagaacgaatctcgtcaacaatatcgtctccttaacggtaagaaagggatacggcggtgtaaatatcgattttgaacgggtcagagaagctgacagggatctcttcacaggatttctccggcagttaaaaacccggctttcagagcatcagctcgcgttaacgatatcggttccggcgaaaacaagtgatgcagtgccgtggctgaggggatatgattacggcggaatcggagccgtcgtcgattatatgttcattatggcgtacgactggcaccacgccggcagtgagccgggacccgtggcgcctttgacagaggtcaggcaaacgatcaattttgccatcagcagggtgccgagaagaaaagtgattctcggtgttccgctgtacgggtatgattgggtgattccgtaccgtcccggaacgatcggatctgccatctccaatcagcgcgccatggaaacggcgatgaagcatcaatcaatgatccgttattcccagcaggagcgttccccttacttccggtatactgatgaaaatggaagaacgcatgaagtgtggtttgaggatgtacggagcatgagtgaaaaaatggttctcgttcgggagttcggactgcaggcgatcggcgcgtggcaattaacgctcggtttcaaaccgggcccgtggctgcttaggaacttttttacgatccgaaaaatatagctgcatgtccctctccgtaagtgattttttctttcctatgataacggagcttcttttggacaatctaaaattgagaaggaggtctgtcatatgaagaaaagggaagagcagtatatcaacgaggctgagtatgtaccgcacccgacaaaagaaggggaatacgcgctcatgctgcatgaatcctatcatttcctttcagaagaggatgaaagcgatttgccggaataagggctttatgcctttattccgtttattttataggcatgtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacaaaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttatttaaagaaatgccggaaaagcaccgggcccgctatctgtcatatatgacggttgatgacatcaccgacatgatcggagagctggagcgggaatttcagcttgccgttttgcataaggtcggtaaaacgaaagccactctcgcaatgaataaaatggataacgacgatctcgccgcattgcttgaagagatggatgaagaactgaaagaacagcttttatccagtatggaggctgaggaatcaaaggccgtacagcttttgatgaactatccgcaagaatcggcgggcaggatgatgacgaaccgcttcgtctggattccgcagcattatacagtaaaagatgcggtcgtgaagctgaaaagttttgcagaaatcgcagaatcaataaattatttgtacgtgattaatgacagcaagcagcttgtcggagtgctctcttacagagatttaattctcggcgagcctgacgataaagtgcaggatctcatgtttacgcgtgtcatctcggccggggtgctccaagaccaggaagaagtcgcccggctgatccagcggtatgactttttagccattcccatcgtggaagaaaataatgtgcttgtcggtattgtcactgtcgatgatattattgacgtcgtgattaaagaagccgatgaagattacgaaaaattcgcagcctccggtaaggcgattacatttgatacgaaagcatacgtggcggcgtaccgccgtttgccgtggctcattctgcttttgtttatcggattgatttccggaagcattctgaattattttgaagatacattgcaaaaagtagtcgccctcgcgtttttcatgccgatgatcgcaggaacgacgggtaatacaggcacacagtcactcgccgtcgtcatcagaggactggctaaagaagaaatgaataaaaaaaccatttttaaactgattttccgtgaattaagaaccggtatctacatcggcatcgtctgtgcgatcgcgattacgatcgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcgtcaggaccgctgattacgacgctgaacgatattttgtccttattaatttatttcggcattgcaactgcatttcttcatgctttataaaaaaagtccgtctcacaggaggcggacttttttgatcagcggtttttatacttaaaatgagcattaagctgtccttccagcatttttttgcggagctgcgggtcgtttttgagagcctgttcttttttccgcatgtcttttaaaatctcagccgtctgcacgccgtcttcccgcttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgtcgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggttctgtgcccccgttttatgcttattgtacagatacaatgaggaggaaggataggaatggagaaagaaaaagcggtttcgctggcaaaagaaatcattgaattagatatgaaacgcgatgaaatgctggaggcgttcatgcagcttgccggggaacacgcttttccgctgctcagagccgtccagaacggtctttaccgaaaaacatcataatctacagaagttttacaatggctttatacatctttgatataaaagcgttattctgatcatagaataacggaaaacaaaggaggccgtcatgagtcgtttgcttcaaaatgcattggataaagagagaaaccattattccaaaaagcttctgcagatcggagtctatacgaaagaaatacttaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgatagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcaggaattcacagccagcatttgcttttccgttaaaagaaagcggatacagacactcttcttcatgaagagtgtttttttctgtttcggacagtagagcctgaagcggtttttgcataagctgatacagggctgcatcattatttaccaatcataatgtgtcatgcctcatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgactagatataaaggaaaagatgtcatcctgagcgacggaaccaggattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccagcataaacggaaagacgagattaagggagtcgtcggcattacaatgcttcataaaggagcggcgagactcggttttgatgtgataaaaccgtccagcggctgctacaggctgtttaagaaagcggcccatcttccgattttatactttactgcaaaacagctcaccctcaaaaacattccttactcctgctatttatttatttccaaagaaaaattgatgtgcacgtatcagactgaaaagagctgaccaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaaataatctaggtagagcctgccgtttcggtttttgataaaccgctctgtcgtaaaaagatccgggcgtgtcctgacgcaataatcggcgatgagcattgtgaaagcacgggtttcttcataggtgaatgcttccggtgaaagcgggatgtaaagctgaatgcctttatttccggagagcttcgggaatgacgtcatgctgaatgagtcaaacagctgtttcagcacatgcgcagcctccactgccataggaaaatcattccttgacggaggatcaagatcaatgacgatttctgcgggcctttcagaatgcactgtctgaaacggaacgtgaaattcaagcgccagctgattagccagccatagaagtgacggtatgctgctgcatacgatgtgctcgtggctcccgtcaaacacgcttgagacaaagtccggcgtgtagtccggtttgtttttttgaaagaaagattcgccaggcgcgccgtgcggataacggatcaccgtgacggcccgatctttaagaaagggcataagaaaatcgctcattttcaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaggacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggacacggaagcgatcgggacgacgatgccgtcttttaaaacagaggccgtcacatacccgttcttcggattgaatccggttaatagcacgtgagccgttttcatatgtttatacttctgccagtcgggagagcgtttattttccgcccatccgctggaagcccttttggctacgataccttctccgtcatagcggacgaccttgtcccaaagcgcatcaaagtcagtgtgctccggaatgtattgaatcgcttcttccgctaagtgatgagggcagacgggaagatttgcttctttaagcagattggaaagggcgcgcttccgtttcacatacggtaatgagacggtgccggcgccttccagaacgaggagatcaaatgccagaaagcggcacggccgtctctcagcggtgcttttaattgcttcggttcgttttaaacgtccgcggatttgaagatgctcaaagtccgccctgtacggattgattaaatagacaagctctccgtcaagcgtaatggggaacctgtctttcatgtgctgaaaacaccgggccgcaaaagccgtgatttccggaaattgattcgtcagcgtctgtccgtttctgctggttaatgtaacaccgttttcgtctatgcggagaagacagcggaatccgtcatactttacctcatagcgccactcactgccttcaggcggtacagaggtcaaaatcggctgcatcgtcagcaccatgattaagacgttccggctttttgtctggtcgtcttctgctttttgcctccgccgcctgctgacgctgtgtcttttgtccgtgccggtgcagcctgttcgcgattcggccgcttcgtccggtcaatgcttgcctgaagcgcgctgacaagatcaatgacatcttctcgcgggccggcaggagcaggtgtcacgcccgcttcttcatgttcgagcttatcgttaattttggcgagaagggctttccggtatgtgtcttcgtattgttccgggtcaaactcggttgtcagctcattaattaacgtgatcgccgtctgcagctctttttcattaacggctgtctgctcaggaacgcccggcacatgtccggcatttctgacctcatccggataatgaatggattccatcacgatgcagttgtcatacacgcgaagaatcgcaagctgctgtttagagcggatcgtaatggaggcaatcccgattttacccgtcgtcctcagcgcttcccgcagaagtgtataggcttttgtgccgttgtctcccggcccgacataatatgaccggttaaaataaatcggatcgatttcctgcagctggacaaagtcaacaatctcaaccgctttttcttcatgttcctgttttacgtctttcaagtcttcgtctgtcataatgacgtatttcccttttacatactcatagcctttcacgatttcatcaggctccagactcttttcacatccggtgcagattttttcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtggatgcggcgcttcatggagcggctgttttatttcctcatgctttaatggccggctgaaaaggagatcgcatgtgaatcggtaagttctttaaatcgctgaagtccccgaaaatcatcaatagtatcaaaaagattatacagaatcattccccgggaaatgcccacgcatttccatgtagtgactgaaagaattttccattcccgtaaaaacagatccggtgatggcaaagatcccggcaaaacgcacggcccatctgaactgaattcccggtcagcgccgcttaccgcaaatggtaactttccggagatcttaagtgatgtaaccgccgccagacgagcaatcaggagacaggcgggccgatctgaaacgactcatatttataacgggcatgtctaaaagatatttcagcctcaaggttttgtgttaaaatcattcttaagtttcagaatatcgacgtaagccgggagtgatagatcatcgaagatttcatcatatcaataattgaagcgtttaaaagcttatcttacgccggaatttttttggcgctcagtatagaattcatcccggcggaaattgttcttccgcttgcgggctattgggtctcaaaaggggatatgacgcttgccggagccgtgtttgccggttcgctcggcggtgtttcaggtccgcttgtcttatatgggatcggcaggctgggcggtcggccgtttttgctgaaatatggaaagtacatatggataaaacccgaatccctgcagaaatcagatgaattctttcagaagcacggaggtttggtagcgttcagcggccgttttataccgggggtcaggacgctgatttctttgccgtgcggcattgcgaagatgaatatctgggtgttctctctctatacatatgcagcgatgctgccgattacatttgcttacgtatacctcggtatgaaactcggggaaaattggaaaagcgtcggttccattctcgatcaatatatgctgccgctcggtatattcattgtgttgcttctcgttctttggatgtttttgaagagaagaaaacagcgggtcaaaacagaaaaaatttctcaatttgttaaaaaagttaagcgttgacaaatgatgaaacaggctttatcatgagcgtataaacaaatatttcttgaaatcccaaaggggagtagcgtccggatattccggaaacaaagtcgtcaattcatggatcatatccatcggctttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggttcttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgccatttcatttctggtgaatgtttggcaggtccaggccgtcggcgctttatacctgttttacattgcggtcagccatttgctgaagcggtatgtattcaaagataacgctgggcagaaaacgcagaaagaaagcgggttttggcagactgtcttgaaagtggagctcgcggacatcgcttttgccgttgactccattttagcggcggttgcgcttgccgtaacgctcccgggaacacggcttcctgccatcggcggcttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtgaagctcgctctttatacgttggcccatgaggaactcggtataattccggcagatgtcatccattcggcggcctggaaaatcattttctgggcggttctggctgccattgcggtttgcggatggtttatgtcaggagcaaaacaaacagagtccggcgcggcatcggaaaaaagagaacacgcgtaaaatgatcaagaagggagtctggctttttagaaagcaggttcccttttttgtttgaaacgcttacatttaagacatatgataacaattttataacagcattgttacaaaaaacacagagaaaacccccttaattctgcctggaggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagccattgaaaagtattcggctgaaaaaggtaattcgctgcttgcatttgcagagctgattataaaaagaaaagtgatagactatatcagaaaagaagcaagaaccgctcagcatatcaatatggatgtgcaggagggcgacgatcaggaatcttcgcagagccttatcgaagcggagctttccattgatgaataccgcaaacagatagaacaggaacagcgccgggaagaaattcttttttttcagaagcagctgaaagaatacggcctgtcttttaaagagctgctggaacaatcgccgaagcatacagatgcgaggcagaatgcgattaaggtagcctacacgcttgttgaaaatgaagagctggcgtccattttgcaccagaaaaaacagcttcctgtcaaacagctggagcagctcgtatcggtcagcagaaaaacgatcgaacggaaccgaaaatatatcatcgccatgagtattattattaccggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttgctcccggttttttctgataacaaagcttacgcgtatatgacgcttgacattaatcccagcattgaaatggctttaaacagcaaatatgaagtcattgaactgacaccgctgaaccatgacgccaaacaggtcatcagtgacatcggagattggaaaagcagcgattttaaggaagtcatcagtaatattattaccgattgcagcaagcatggatatgtaaaggaatcaaaagagattttaatttccacggtttatgaaaatacagatgacaatacatataaaaaaggcgttaaaaaacagctggctgacatgactgaaaaatataagggcacctaccaggtccaatctcttgaatctgatatggaaacaagagaaaaagcaaaacaggaagggatgtcaacaggcagctacataagaagaaacgaaaagaaaacagaagaaaaacagtctgaaaagcaaaccgacggcaatgaaacagatcaaaaagatactgaaacagacgctgatcaaagcaaacagccggacacagaaaagccggcggctgatgaaaagacagctcctgatgaagaaaaggcagcagagaagccggaaaacaatgaaacaacgcccggcacggaagaagcgaagccggacagtcaggacggcagtcagcaaaccgacaaaaatgcagcttccggatcagaagaaaacacacagaaggaacaagatggggaaacagagcagcccccaacacaaaatcctcaggaaaacggaaatgacaaagagcctaagcaaaagtattacaatcattactggaatcagcggaatcatgatcgcaatgaacattgggactcctatcggcatcatgaagattcgtcagaccgcaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgtttacgcattttagtttcaaacggaacggtattgattatgctggcaattgttgtacagcaaaaaaccccggcgcagacaccggggcgaagaagcgttatgaattataataaatggctggtcattttgtaggctgaggcttgaatatggaaagtcaaaacggagagcaccgtgacggcgatgatggatctgatattgttccattgtccgcttccgagttctttaaagcagcctttgagcttgtccgtctgctcttcaacgagctcctgcaggctcgtttccttcatcggcgggtttgctttatgatgaagataatcaatcacttgggcgcagctttcatagtagctgatcgggctgatgacgtcgtctgatctgtctgtgatcgtgttaaaagcgatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaatgtcatttccgctgattgcaataagatttggagaggagttgcgtctccttggccttttaacgcgtaaagaagccggaccatatcagttcgggtcagtttaaacgtgttcatggttcacctctgattgattacgtgttcactttctgatatcactgagaattacatttacatcatacgtcgaaattgttgcattttcaaacagatcatttataatttaattaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcactcagctatgaagaacagcaattggttgaccgtgtgcacagattgtcccgtgccgcagggatgacgaaaatgcctgaagtcggcatttatcagtccccggaggtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcggtgcagacgttaaaaattaacggcaaaaagcattcgtcactgttctccacacaccctgatctcgatgagcgcatccgcaggctggaagcaaaataataaacaaaacctctgacaatcgtttcagaggttttttgtttaaagatcggcaaattacataaggtaatgaaaaatctttcaaaaaaggcctttaaaaattctcccaatatcattagaataattacgtactacatttgagaggcagaaggaactatcttatgaaattaaaactgaagaaattcatacagatcttgtcgcctgcacagctgattgcattatattattttcttgctgtgacggtggcatttattttgctaagtctgccggccgcccacaaacaaggggccagctggtcgtttatagacgcgctgtttacggctgtcagctcagtcagtgtcaccggtttaacagtcgtcaacacggctgatacattcagcacggccgggattgtcattttggctttcgtgcttcaattcggcggaatcggcattatgacgctcggaacattcgtctggctcattatgggcaaacggatcggtctgcgggaacggaagctcattatggtggatcagaatcaatcgcagttttccggtatcgtcaacctgatgaagcaagtgctgtttttgattttattaatcgagtttttaggcggcatcatcttaggaacatattttttaacgtactatgattcgtttgaacaggcgtacttgcacggattctttgcgagcgtcagcgccacgacaaacggcggctttgatattacgggaaattcactcgtcccgttcagacatgactatttcgtgcagtttattacgatgcttctgattattttcggcgcgatcggttttccggtgctcgtagaagtaaaagattttttgttttcaaaacagcgcagatactcattcacgctgtttacgaaaattacgaccgttacgttcggaatgctcgttttgttcggagccgtgggcatttacgcgcttgaagcaagccatgttatgaaggggaaaagctggcatgatgttttatttttatgtctctttcaatcaactgctacgcgaagcggcgggcttgcgacaattgatatcagccagctgtcggcgccgacattatttttcatctgcgccctcatgtttatcggcgcatcaccgagctcggtcggcggcggaatccgtacgacgacgtttgcacttaaccttcttgctctgtttcattttgccagagggaataaagcggtcaaggtctttaaacgcgagcttcatcaggctgatgtcatgaagtcgctggtcgttacgatgatggcgattctgctcgtgttcgggtcgacgctgattctttccgtgacggagacaaatcagacgctcctcggactgctttttgaagtgtgttctgctttcggaacgaccggcctgtcgctcgggattactccgcatttaagcgacatcggaaaatgtgtgatcatgattgtgatgtttatcgggcggatcggcattttgactttcctttatttgatcggccgaaaagaaatcgaagcaaattatcattatccgaaggaaaggatgattatcggctgacaccgcttttcagaaagcggtgtttttttattgccgtaaaatggatgagtggaaacagtttctttggagattctacttgtaaagaggtgacgtcattgtttgccgtattttggaagtcggtagttatgatagcggtcggtacctttttattgcggattgccggacggaaatccatcagccagctgtcggtgacccagacagtcatcatgatttcgatcggctcgattattattcagccgtttattgaacataatttatgggaaaccattttcgcggcggcgatttttattgcggtactgattctgatggaatatttagaaatcaaatcaagcttttttgagtttttattttcaggaaaaaccgtcgccgttgtcagaaacggaaaaatcatcccggaaaacttaaaaaaaatgcgttttaccgaagaccagctgtcaatgaggatcaggcaggaaggcctcggagacattcaagattttaaatatgtgctgcttgagccgaacggacagatcggctatgaactcattgatgaggccaaaaacgtgacagtgcgcgacttgaaaaaaatgcttaatgaattcaaaacagatttgctgacagaaggaggaaatcaaatgaaacgcaaagcagcaaagaatgaagctttaaccaacaacaatacaccgactgagagcatggacaaagatgcatacaaaacacaatatgacggtgatcccggactgagaggcgcaaaccgcaaatcaaaacacggcaaacaaggaggcgagtaatatgacgaaaaaaaaccgccacagcaaagacatgcaaaaccataaaaagccgatggaccctaaattgcttgaagaagagttttcaagcgagctcggtgattataacgccggaaaatggattgaaacgcttgaacagacgaagccgaagaaaaaagaagacggcaaaaaataaaaaatacctcttaagcggcaacgcttaagaggtattttgcattatttcgaataagcaccgtttcttgttcctttcaccgcttgaagcaagccggttatccgcagctcaataaacggctgtgcggccgttttcaccgcattgctggagagaatggacgtaagagcggccgttaacattaagagcatgactaaattctgataatcagacaagtgatcttcaagcccgatctgccgcagcgtttttataatgaatccatgcagcagatacacgtaaaacgttctcgtaccccatttcgtaaagaaataacgcttttgcggaacgagcgccaaaaagctgaaagtggcggcaaaggccaaaacataccagccgatgcgtgacagaccgctcaacagtgatactgtgccgaatgtagaataaggctctgatccgaacagccacgagtaatcaaaatcaatgcaccagcataagaggaaaacaatccccagtacgcccgcggcaatctgcctgcctcttttagcccgaagcaaatcaaagtgccgtttctttaaataaaacccgacgagaaacatcggaagaaagacaaacgtccgtgaaagactcagcgtgctgctgatgaaatcgagatacccgatcatgacggcaagcccgcagctcgccccaagcgcccacattttcggcagcttcgtaaagggataaagcagcagattccaaaagaataagctgactaaaaaccagagagaccactgcggatcaatcggattgacgcttgccatgctttcatcctgaatcaaatagtaaaaaaccgagtaaatgccctgaaaaatcaggtacggaataatcagcttcacagccagcttcttcacataacctttccgcttaaagttttttgcgaaatagccggaaaccaggataaaggccggcatatgaaaagtataaatgaatttgtagagatggagcataaactcatttccgttaataaatgaccggaggatatggccgaacaccaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggacaaaagggattgttaggatgatgtaacggggaggtaaggatcgtagaaaaagactttaacttgtcatatcattgaaattttctgaaatgtatagggcgaatgaaggaagatgatgtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgatttaaaccggtatcatgtgattatgaataacacgcttgatgccatttttatatgccgtaaggaaatgaaaatcgtccaggcgaacgaggctgcggcccggatgatgcagattgaggcagagagccttattaaccgctccgtcctggactttttatattccgtgcctcaggaagaactgaataaggccgtgaaaaagtttttaaaaaaaggccatctgtggaaagaggtgccgattaagcttgacagcggcgcgacgaaatacattgaattcctcgccagagacggaattggggaggattatttttttgtggtgatgagggacatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcgcatctgtcgctccgccattttaccgacggcgaaaacaaaaagcatctgaaagaaatctgggaaaccctccgcagaaaaggaaatgccaaaggagaactgcccgtcaagcttcggtccggcgaagagaagctgtttgaatttacgattacgtccaacttaatcagcgggttctacatgtccattatgagagatataacagagaaacggttgatggaattgaaactctttaaaagcgaagagcgattccgcgaaatttttgaaaacgcgatggacgcgattgtcatttggtctgatgacggaaagattgctaaagcaaacgaatcggcgtgccgcattttcgaactgccgatggataagctgctggagacgaatttatgtacgtttatcgttgatccgcagaaaaaatacaagcagattaagaagaaatatgaaaaatacggggaaattcgtgaagaaatgctgtttcagatggcaaacggccaatacaaagagcttgagttcacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgcattattgacgcgaatcctctcgcaagccgtatactgggcatgccggatgaggagctgagagcgtacaccgttccggatattctttctttatttgatattgaaaacgcgggtgttcccgccagaaagattgatttagaaggaatggataatgaaatccccttcctgttaagcagcagtgacagccgcaaactggaattctccttcaaaagaaatatcattcaaaatatgaatctggccatctttaaagatgtcacagaggccaaagagcttgaagagaggctgcggaaatccgacactcttcatgttgtaggggagctggcggcgggcatcgcccacgaaatcagaaacccgatgacggcgctgaaagggttcattcagcttcttcaaggaagcattgaaggcgaatattccctgtactttaacgtcattacctcagaattaaaacgcatcgagtctatcatcactgaatttttaattttagcgaaacctcaggcgatattatatgaagaaaaagatgtgacgcagattatgaaagacacggctgatcttttgaatgcccaggccaatcttgtcaatgtgcagattcatctgaacctgaccggaaacatcccgccgatttactgtgaaccgaatcaattaaaacaggtgtttatcaatattttaaaaaacgccattgaagtcatgccgggcggcggcaatatctacgtgaccatccagccttctgatcaagaccacattttgatttcttttcaagatgaaggaacaggcatttccgaagacaaactaaaacgtctgggcgagccattttacacgacaaaagacaggggaacgggcctcggtctgatggtcagctataaaatcatcgaagaacatcagggacgcattcatgtggaaagtgaagaagggaagggcacggtttttcatttgacgcttccgatccggcagaataccgaagaaagaaggagcggggaatgatctgttttacaagtgtaaaagcgccgtttggaaccgttatcgtaacagaggaagagggctttattaccggcctgtttctcaccggggaagattttgaggaatggcggaaagacgcgcccggcgtaaagccgtgcgaaaccgctttgctgtcggaggcgaaacagcagctggcatcctatttttcaggagaaagaaagcaattctctctgcctctgagacaaaaaggcacaccctttcaggaaagggtgtggaacgcgctgacgatgattccttacggagaatcccgaagctacggcgatatggctgaagcgatcggaaaaccgaaagcgggcgcgccatcggacaagccaataaacgaaaccggctgccgatttttgtcccgtgccatcgggtaatcggcaaaaacagcgccttaacgggatacgcgggcacgaagacggatgtaaaagcggtgctgctgaacatcgaacaaatatcctataaagaaaaataaaacatatggcacgttccgttttttcgcgtccgacatatcattttattaagtgaaaaaagttggtctggtgaaaaaggaggacgaagcctgatgaaaatgagccgtccgcaaaagatagccggttatgcagagctgttttttaaaatgcatctcattacagccgcccaaaaagatgaagtgattacattgtgcagacaaaaaaaccgctgacattgcccgaggcaacatcatcagcggtttttcagctcagctgacagtcggcgaataattgttcaatttcttccgtgtaagaaccggtcacaattcctttctcggtgataatgcctgaaatcaggctgcccggtgtgatgtcaaaggccggattgaagaccggcacatcttcgggagcggtgcgtatgcctgagatctgtctgacttcatccggatctctttcttcaatcggaatctgatcgccgttttcaatctgcaagtcaaaggtcgaaagcggtgcggccacaaaaaacgggatctgaaaggcgtttgccaaaatagcgaggccgtaagttccgattttgttggccgtatctccgtttttagcaattctgtcagcgccgacaatgactgctgatatatgtttttccttcattgtatgggcggccatgctgtccgtaatgagtgtgacatcaattccgccctgcatcagctcccacgccgtcagccgggatccttggagaacgggtcttgtttcacatgcgtagatatgaaggccgaggtctttttgtttcgctaagtaaaagggagcaagcgccgtaccgtaccggcttgtagcaatcgagcccgcattgcagatggtcatgatctggtcgccttttttaaaaaggtgcagcgcattttggccgatcattcggcaggtttcttcatcctcaatctgaatttgaatagcttcatgaacgagcgttgtcttcgcttcattgattgagattgcatccctgatggaatccgtcagtctgtcaagcgcccacgcgaggttgacggcagtgggcctcgaactgtttaaatacgctttgacatccgcgaactgacgtcggaaatctgaaagatcgcgggcttcaaatgacttggcggagagcgcgagtccgaatgccgcggttataccgatggccggggcgccccttactttcagcgtgacaatcgcgtcgaatacatcttcctttgtttcaagttccacatactcagtgacgtcgggaagtttttgctgatttaaaatgcggatgtaggtttctttccattccacagaacgggggatggcaaattcattggtcatgctgcatcattcctttacacggagcttaaattggtccagaacctcggtgatatgcttcagttcttttctgttttcgatataataggcgccgatctcaagcgccagcttcttccgttcgattcgtttgtcaaacggagtgatttcatctaagtcagccacatgggcgagtccgatcgtgcgccggatcaattcgcatcccgcaaaaccgaccgcttcttcaaacgcgtttttcagtgtgtcttccagcaggtgtttgcgggaaggcaggcagtctttctcccatgcttcactgaatgttttcacaaatgtatcccatacggcggcagtatggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatcggcgaagatgcttcccgtgtgcagatcgccgtgaaccaatgtttccgcggaattcagaaagatggctttcaattcgtcagcgccttctttcagccgggaattgttccaaactttttctgcgtatggacgaagctcctcttcaaaatcgtttgtttcatggtcgagaaacggttctgtaaacacaagcctttctgtaatattgcaaagctcaggatttgtaaactgctttgcgagctgctgctttactttcgcatcaagcgcataatcggatgagtaaaaaagcgttttccctaaaaattcaccgatatgaaccgataagttcggataatgctgcccttccagcagcccttttcttgaaatctgcaaatgtgagaggtcttccattaccgtgacggccatttcagtatcggaatagtaaacggccggaacgaggtgcggcacgtgttcgccctggcggatgagggcgctgctttcgattctcgcccgatcaattgtaagcggccagctttcaccgacgactttcgcgtaaggaatcgcctgtttgataatcagtcctttttggttttctttatcgtaaacatgaaagacgtaatttaaattgccgtcgccgatttcacggcatgtcagagtgcttttgctttggaataagccgagcttgacggctaacgcggcggcggagctttctgttaattgttcataaagacttgttttggttgctgacatggatttaccctccaattatgtagtggcagtaagagatcgtgacggagaatacgcccgaaaaaaagcctccttctctgaaagagaaggaggctgaaacagtgcagtccgcctcttatctctcagataacatctgatggaattagcaccgtgccttatgagacaatcgtctcggcgcaaaaatcacgcgccccatttcacaatggaattacggtcggttgctgttggggtcaaaaggccaatccctcgcccaactctcgataagagaaaatatattgatttgtatcacaattcggattaatcagttgatgaaaatattagcaggtgccggatattcttgtcaacatttttttgaaaattaatataaatcacgccgcaagtcttggaaaaccggaatggttccgcggacggccgcgctttctgacacatcgatttccgcccggactgcgccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattccgcagagataaacaggacattcgcgccctgggacgtatgctttctgatccattcggggaaacggatatcatagcagatcagcccggcgcacttgacaccgtcgagctcaaaggaaccgtcgctgtttcccgctgacaagtaaaggtgttcatccatcagctgaaacagatgggctttctgataccgcttcacgatctgtccgctgttatcggcgatgtacatggtgttatagacattttcgccttctttgaccgcaaaagatccggcaacgaggtgtacgttgtatgtttttgccgtttctttaagccattgttccgaaactttgccgttttcatccgccagctggtctagccgtgtgagatcatagccggttgtccacaactcaggaagcacgattacatccgcatggcggctttcttgctcaatcaaagattccgcttttttaaaattttctgaaggatttccgtatgaaatatcaaattgcaaacaagaaacggtccatttcattttttaacacctcaagtttctctttactttttttatttaaccatatatgatgatggactatcatttcaagacatttttagaaggtgaaaaatatgaactttgaaatctcagatgtactcaaacagctgccggaacaatttttcgcatcattggtgcaaaaagtgaatcaaaagctgaaagaaggcagagacgtcatcaatttagggcagggaaaccctgatcagccgacgcctcagcatatcgttgaagaaatgaagcgcgccgtcgaaaggccggaaaatcataaatactcatcattccggggcgcttacagcttcaaaaaagcagccgctgcattttataaaagggagtacggggtcacgcttgatccggaaacggaagtcgccgtgctgttcggaggcaaggcgggacttgttgagcttccgcaatgtcttttaaacccgggagataccattctggtgcctgatcccggatatcctgattactggtcgggcgtcgcccttgcgaaagcgaaaatgaaaatgatgccgctgacggaagaaagagggtttctccctgattacagcgtaattcctgaaaaggtgcggagcgaggcgaagctgctttatctcaattatccgaataatccgaccggcgctgtggcgacagaggcgttttttgaggagacggtcggttttgcggaacaaaacggtatttgtgtcgttcacgatttcgcgtacggagccgtcggctttgacgggcataaaccgctgagctttttgcagacggaaggcgcaaaggagacgggaatcgaaatctataccttgtccaaaacgtataatatggcgggctggcgggtcggatttgccgtcggcaacgcttctgtcatcgaagcgatcaatctttatcaggatcatatgtttgtcagcctgtttcccgcggcgcagcaggcgtcggcagccgctcttttagaggatcaggcatgcgtcgcagcgcaaaatgacagatatgaatcgaggcgcaatgcatggattgaagcctgccgcggtatcggctgggatgtgacggctccggctggctccttttttgcatggctccctgtgcccgacggttatacgtcacagtcgttttcagatctgctgctcgagaaagcggatgtcgccgtcgctgccggaaacgggttcggaaaatggggggaaggctatataagagtcggtcttctgacaagtgaagaaagacttaaagaagctgcggaacggatcgggaaactgaatcttttcacccgaaaaagcattgacatatctggataacaatgcgataattcaaaatactttataaaatcatttttcttatcaagagcaggcagagggacgagcccgatgaagcccggcaaccgactgataaagcacggtgctaattcttgcagcaggagctgagagataagattcggacataacacgaagcctctttctgctcatagggaagaggtttttttatgttttgtgaaagaaagagaggcgttcacgcatgagcgaagtattggcaacatatcttctgacagacacaacggacagtgaaaagcgggcggaacagattgcggcggggctgacggtaggctcctggactgacctgcccctggtgaagcaggaacagctcagaaaacataaaggccgggtcgtaaaagttgaggagaaagaaggaacctcagaaaacgaaacacaatccgtcatcactatcgcctatcccgaggcgaacttttcaagagatattccggccgtcctgacgacggtattcggaaagctgtcactggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacggaatctcgccgacattaaagaacagctcagacagcaggcgctcggaggcgtggatctgattaaagatgacgaaattttctttgaaaatgaactggctccgtttgaaacccgcattatcgaaggaaaacaagtcctgaaggaaacccgggaggagatggggcataaaacgctgtatgccgtaaaccttacgggaaggaccgctgaactgcgggataaagcgaggcgcgcggcagaactcggggcggacgcgcttttattgaatgtgttcgcttacggtttagatgtgatgcagagccttgcagaagacagggaaatcccgcttccgatcatggcgcatccggcagtcagcggcgcgttcacttcatctcccgtttacggcttgtcgcatgcgcttttgctcggcaagctgaaccgctattgcggcgctgatttcagtttatttccgtcaccttacggatccgttgctcttccgaaggagtccgcgcttgcaatccatgatgaatgtgtaaaagacgatgtctttcatccgtcgtttgctgtcccgtcggcaggcattcatcccggtatggtgccattgttgatgcgcgatttcggcatcgatcacattatcaatgccggcggaggcattcacggccatccgaaaggagccgagggcggcggaagagcgttccgcgccatcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggaacggtcacgatgaacgacaacattgtcagcatgatgaaagaattcgcgccccctgagtggcttgaattaaaagacggtgttctgtctaaaagcctatcaatccaagaaggagtcggccggatgttcggattgctgccgagcagcttaaaagaagaactgaccggctttattctgaaggatgcgaaaatacgggacggctttttggattttgtctcgtttgtccggtcaaacggcctcccgttttatatcgtaagcggaggaatggacttttttgtgcatccgcttttggaagggatcgtagaaaaggagcggattttctgcaatcatgcatcctttgacaatgaatatattcatatagactggccgcacgcctgtgacggaggctgcaccaatcaatgcggctgctgcaaaccgtcagtcatccggaagctgtccgatcagcagaaatttctcattatgatcggtgattcggtcacggatgtcgaggctgcaaagttatccgatatgtgttttgcgagagattatcttttgactgaatgcaaagaactcggcctccggcatctgccttttcaagattttcatgaggtgaaaacaggcattgaaaacatcggggaggtgcaggcatggctgcaaaagaagaacgctggcgcgaacttgccgaggtaaagcgcgagctggccgaaagagactggttcccggcaacgagcgggaatctttccatcaaagtatccgacgcgccgctgactttcctcgttacggcgagcggaaaagacaaacgaaaagaaacagacgaagattttctcttaatcgatgagaacgggaagcccgctgagaccggccattctttaaaaccttcagcggaaacgcttctccatacttacttataccaaaagacagacgccggctgctgtctgcatgtccataccgtcaataataatgtcatctcagagctttacggggatgaaaaacaaatcacgtttcaggggcaggagatgattaaggcgctcggattatgggaggaaaacgcgtccgtgaccgttccgatcattgacaacccggcgcacatcccggcattggccgaaaacttcgcgcaccatgcggacgccggctcaggcgcggtgttaatccgtaatcacggcattacggcatgggggcggaccgcatttgaagcgaaaagggtgctggaagcctatgaatttttattcagctgccacctcaagcttctgtcactgcggccgcagcttgtaaaataaaaggaggaacggaaaatggcgaccatcagaattcatgacgaaaagaatacgctcattgaaaatcaggaagaagtagcgcgctttttagacgaacaagaggtgatctatgagcagtggaacattgaaaaacttccgtctgagctttcggagaaatacaatctgacagaagatgaaaaagaacggattctcgcggcgtttgacacggagattcaggacatttcagcccggcgcggatatcagtctcaggatgtcatttctttatcagataccacgccgaatcttgatgaattattaaaaaatttccaaagagaacatcaccacacggatgatgaagtccgctttatcgtcagcggacacggcatcttcgtcattcaaggcaaagacggcacatttttcgacgtccgtttaaatccgggagatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgcccccgccggcatgagaggttttttattgtaatataaagtcagctgtggctgttttttaaatcttgaatatgccgcattctgtttatatcattacctgaatgggtattattctcgtattcatgctaaagattccaatatgaaatgaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacagacaagggtttaccggatatgacacgatcaggcacagccaggaactggactgtctgatgaacgcgtatcagcagctggtaaaccgtgatcgcacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgacccagggtgtttttttcatcgtgaagcggcagggagggtaatggtgacctctgtgcccttatcgacttcgctttgaatgtcaatcgaaccgccgtacatcagcatgattcgtttacatacgacaaggccgaggccggtgcctttttcctttgacgttacaaacggaagaaaaatgtgttcaagcatatcttcagaaatgcccattccgttgtcggccaccttaatgactgctttatggtcgcgggcttctaaatagatggacagccggccgccttcctgcatggattccagcgcgttttttgcgacatttaaaatcacctgtttaatatggtctttcgtgcagttgaccttgagcggccgattgacgagaatctccacattcacttccacattatacagattcccttcagaataaataatcggcataatctcatcaagaatatcctgcagcgaattcacttccaaccgttcagcagtgggtttaccgagcactaaaaactcactgacaatctgattgatccgtttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattggacgaggatgaacagaatattcagcagcacggcaatactggacatcggcagcagcacgcttttggtcagctcgttcagctcaaccggtttcggataaacattgatattccaattaatatcatccagatagccgctgaccggtttcaccccttctgattgatcagcccgtccgctggcaaatatcactttattctgattggttgccttgacataaacgtcagggctcagcatattgatcatatttctcaaataatcgacttggatggcggctactaaataatccgtgacttcctgttttgcgtctaacaccggcacgcagatcgtgaagatgcgctggcctgtaattctgctggagtagtcatttgtgatgaccgtttttttcgtctttttcgccttcgtaaaatacggtcggtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcataaatgaaaaagctgataataagtgccgggatgatcaccaatatgagataaagtttgatctttccccgggcacctttaaatgtattcactctgcatcgctccaacattacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggtctgaacccgacggaatttgcggtgcttgagctgctgtaccacaaaggcaaccagccgcttcagcagatcggcgacaaaattttattagcgagcggaagtattacatacgttgttgacaaattagagaaaaaagaacttctcatcagaaaagcctcgccgactgacagaagagtgactttcgcacaaatttccgaaaagggaatccgtcttttggacgatattttccctgatcatgctgaagaaattaaagaaatgatcagtgtgctgagtgatgaagagatagaaatgtgtacggaaatgctgaaaagagtggggttaaacgctaaacattttcatcagaaataaaaaaggaagccgtttgaaaggcttccttttttatattactgattttggtcagtcgcggcgtttctaggttgtatcaatacctcgacgcgcctgtttttgctgcgcccttcagcggttttgttcgacacggccggtttatactctccgaaacctttggcgctgaatacttttgcgtcaagtttcgggttttccgtgagaatagccatgaagttgacggcccgcatgacgcttaaatgccagttagattgatattgtgagtttttaatcggcacattgtccgtatgtccgctgatgataatattcctcggcggattcagcacaaggagattcgagatttccttggcaagcggaatatcttcctgacggatgtccgcccgtccggaatcaaaaaagatactgtctttaatggtaattaagagtccttctttagtcagctttgtttccagctgagtttcaagctttttgttttttataaattgattgacttgcttttgcacgccttcaagttcttcgcggtcggctgcttctctttctttctttttctgttctttatctttttccttgtctttttttaactgatcaacgccgtctttttcgttttcaggaggggtgacgcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggggcctgtccttcaagcactgacagaacgccttcgatcatgatttcacgcagtttgacttcctgctttgatttgcgtttcagtttgttggcgaagggatgccaaagtacataccctgtgaaaatcccgagaagggtggcgacaaacgccgcactgatggcatgtccgagcgcctcggtattgttcatgttggaaagagcggcgataaggccgatgaccgcacccaaaacgccgagtgtcggcgcatatgtgccggcttgtgtaaagatcgctgcgccggcctggtgtctgtcttccatcgcttcaacttcttcagtcataatatctctgataaattctgcgctctgtccgtcaaccgccatgctcaggccgttttttaaaaatgcgtcatccacgtcttcaatgcttgcttccaatgcgagcagaccttcacgtctggcgatttgcgcccattgagagaacataggaattaattgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcactgcgaggatgataccgataatcgatgttttatccatagttttcaccaaatcctttatactagctttctatggttaatatcggtggcagtgcatggaactttagggtgattgaaaaattgttcccgaattcttcacagtttctcccttccggcatggagaaagaaacaaaaaagcggctccccgcgaggagggagccgcttttttcttattgtgcccggactttgatgccgtcctcttccattacgacatggaaggctttgatttcgttgtcatccaataagagatctgtcatttcgtcctcgatcaattcttggatggttcttctgagcgggcgtgctccgaaagcggggtggtagccgatttcagcgactttttctttcgcatcatcggtgacgctcaggctgatgccgcgctcttttaatgtatcttcaagttctgtgagaagcaggctgacgattttcacgagatgttcttttttcagggattggaattcaataatgctgtcaaaccggtttaaaaactccggtttgaagaacgcgctcagtgaatcaatcagcgtttgttcttccatgacgctctcttcagattggaatccgactttcacctgtttttcgccggttccagcgttgcttgtcataatcaaaacggtatctttaaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgataatttttgatacggcgtgtttttccatgtattcactcatatcgagacggataatggaatcttttgtaccgaacagttcatctgcgagtgtctttgataactcggtttttccgactccggtcggtccgacaaagaggaaggagccgacaggtctgtttttggattttaagccggcgcggcttcgtctgaccgctttcgccacttttttcacggctttttcctgaccgatgacacgctgatgaagatgctcttcaagttccttcattttgacttgttcatcagcctggagttttccgaccggaatgcctgttttctgttcaatgatggcttgaatatgctccgcgccgatttcaggtgaagaggccggtgtttcatgcgccagctgcttttccaaagccgcttcttcatcacgcagtttcgcggcaagctcataattttcttcccgaagcgcttttgttttctccgcgtcaattgctttgagtctctcagccgcatcttcttcatttacggtatcaagttccaggttcgccttagagccggcttcatctaataagtcgatcgctttatccggcaggtggcggtcctgaatgtaacgggatgaaagcgtaacacaggcgtttatcgcttcattgctgaatgtgacgccgtggtatttctcgtatttatctttaatgccttcaagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcgcctacaagaaggtgaatctcatcaatgaacaagatgacatttttccgttcttttaattcgttcattaattgtttcattctttcttcaaactggcctctgatccctgtattggcgacgagagaagcgacgtcaagcaggtaaagctctttgtttttcaatttgttcggcacatcgccttcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcaagcaggcctttttcagggccggcctgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctcctcgaaaaatatttgatcatctttgaccaaatgggttagaaaataaggccgaaaatttgaccttctttgattattagtatactctgaccttctttgactttcaagtattttgtttcaaaccccgaaaaataaatgtttacagcataataagtgatattcgtgaggtttgattatttttgaccaatatagtcggaaaggaaatgaaatgctttgacctttcttgatgaagagtatacgccggccctttttttctttcaatatttttgcttagaggagagagctgaatctgttttttccggggaaggacgatttgttcgtcttttcgggagacttgtctcataagcatatataaaggcctggacaaatctgcgtttagccggagggtgaaatgggacaaacaaaaggttctgcaagtcagcttgcatttgtatacgtaggcacggttgtaggagccggttttgccacgggacgggaaatcgttgagttttttctgaagtttggctggatcggtctgttcggtatcgtggtaagcggtctgatgtttacatatttaggcgccaaaatcatgattatttccaaacggattcatgcagcatcttatcaggaattgaacacatatttattcggccagtccatcggccgcgccgtgaacatgtttatgatgtttatattgctgggagtgacctctgtcatgctgtccggagccggagcgctgtttcatgaacagcttggctggcccgcacaagcggggatccttctgacgatcgtactgagctttgccgtcatgacaagcggtgttaaaggtgtgttcggcgtcaatatattggttgtgccgcttttaatttctttctcttttatcgtgacagctgattcatttgtatttacaagcacgagaaacgcggacgaatgggtatggcctgacaagtggaactggcttttgtccgccgtctcttacggcgcgttaaatttatcgctcgcccaagccgtccttgtgccgcttgcgaacgaaatgtcttcagagaaggtgatcagaagaggagcttatataggcggcgttctgttgacactggtgcttgccgcgagctttttatcattatcggtgctgccggatgtgctggagtttgacattccgatggctcaagttgtctattcgtattcgcgttcgcttcatatcatttatttgtttattattttcggggaagtgtttacgtcggttatcggcaatttatacggattggaaaaacaattaaacagttttcttcatataaaaagtacatatatttacggcggcattttggcgtttgctttcattatcagccaaatcggttacggacagctgatttccaccgtttatccggtgtttgggtatgtgagcctcgctttcatcggcgcattgatttgcaaaaaaatcccgaaagataaataaggatataaggaaaatgtctgtatattttgggaattctccttcttttttcctgccatttctgtataatgaattgggaaatgatggggaggagtaagagatgaaggatcgacgtgtattattgggatttatttttatttgtatcggcattgcgttttttttacagaaggcgggagttatacatatatccgcaggttcggcgtggccgtttcttttcattataatgtccgcagggtttcacgccggatttatttttgcgaaaaaaacgcctgaacaggcgggactgctcgttcccggcggtatgtttcttgtgctgggctgcctgttttgttttgagaccgcaacgggatggacgtattcaggcgtgacgtggcctgtttatatatgggcgcctgctctcggtctgtttgagctgtggtatttcggcgggagaaagatcggcgtattgattcctgcttttatcctgacagccgcgggagcactatgctttgccggtatgctgatgacggggctgtggccgcttttgatcatcgcagccgcgcttttgtttcacgccgctgcctttatgcagccgaaaaaaagatcgggccttcttattccgggcggcattttgcttgtgacgggcggcttgttatggtttgaaacgctgacggattggacatacgcaaatgtgacatctcctgtttacctctttgccgttgcattcgggctgtttgaagcctggctgttcggcagaaggcaaagagggcttttgactgctgcggcggttctgtgcgccgcgggcattttcggcatattcaccaatgcaaatgaagtcatcagcgaacgcggctggcccgctctcattctgttgctgggcgccgcttttcacattccgattttcggcccgaaacctgtcaaaaacgcggggcttctcgtaccgggcggcatcttattgattacggggatcttgtttgtctttgaaacggcaactaattggtcttactccgatgtgacatggcctgtttacctgttggcaacggcattcggtttatttgagctgtggctgttcggcgggaaacagaaggcgctgctcatcccggttgcggtgctgaccttgacagcactttgctttatgatgacgtatcagccgatcattccggtttctgttttctggcctgctttatttgttctgatcgggattgcgctgatggcatttccggggaagaaacgcggggcttaaacccgcttttgcagcctgacacagggttcaggctgtttttttattgtcacgggaaacaacattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaacgatagataagggagagaaagacatgaaaaaagaaaaagcggttgtggtgttcagcggaggccaagacagcacgacttgtttattatgggctttgcaaaactttgaagaagtggaaaccgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtaccgggacgcaaccttgtatttttatcctttgcatcgattcttgcatatcaaatcggcgcgcgccacattattaccggtgtttgcgagactgatttcagcggctacccggactgccgtgacgagtttgtcaaatcctgcaacgtcaccgtcaacttggcgatggaaaagccgttcgtcattcatacgccccttatgtggctgaacaaagcagaaacgtggaaacttgcggatgagctcggcgcgcttgattttgtaaagaataacacactgacttgctataacggcatcattgcggacggatgcggcgaatgcccggcatgcctgctccgtaataaaggatatgatgaatatatgaaaatgaaaggagagcggaactaattgctttctcaaatttacccgcaggttcagcatccttattcgtttgagttgaataaggacatgcacatttcagccgcgcactttattccccgcgaaagcgccggagcgtgcagcagagtccacgggcacacgtatacggtaaatattacagttgcgggggatgaactggacgattcaggctttctcgtgaatttcagcgtgctgaagaaattggtgcacggcgcttatgaccatacattgctgaatgaccatgaggaattttctgatgatgacagatattcactgccgacgaccgaggtcgtggccaaaacgatttacgataaggtgcagtcctacctcgaaacactggagaatcagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgtgactactcctgcagctggtgcgactccgcttttacatgggacggatcagccaaaaaagatatccgctggatgacggcggaagacatttaccgcgagctgagagaaatcggcggagacgccttttctcatgtcaccatctcaggaggaaacccggcgctgttaaagcagcttgacgcgctgattctgctgctgaaagagcacggggtgcgcgccgctttagaaacgcagggaacagtctatcaggattggttcacaatgattaacgacctgacgatttcaccgaagccgccaagttcggggatgacaaccgattttgcaaagctcgatcacattatgtcttcgcttgatgcggcagaaaggcttaacgcggtcagcttaaaggtcgtcatttttaatgatgaagatctgcaattcgcgaaaaccgtgcacaagcggtatccgaatatcccgttttatcttcaggtcggaaacgataacgtccatacgacggacgaccgggcattgatcgcacatctgctcggaaaatacgaaacactcgttgataaggtttcagccgattcggatctgaatctcgtcagagtcctgcctcagctgcatacattgctttggggcaataaacggggagtttaatagaaagggagatttatatgacaagaaaagaatcagaattagaaggagttacgctcctggggaatcaagggacaaactatttatttgaatatgcgccggaggttttggaatcatttccgaataaacacgtgaaccgtgattatttcgttaaattcaactgcccggaatttacgtcgctttgcccgaaaacgggacagccggattttgcaaccatctacatcagctatattccggacgaaaaaatggtggaaagcaaatcgctgaagctgtatcttttcagcttccgcaaccacggagatttccacgaggactgcatgaacatcatcatgaatgacttgatcgaattaatggacccccgctacattgaagtatggggcaaattcacgccaagaggcggaatctccattgacccgtatacaaactatggcagaccgggaacaaaatacgaaaaaatggccgaacatcggatgatgaatcatgatatgtatccggagacgattgataatcgttaatttcagacggagtacggactcggactataacctaaatacccccgccttttaagcgggggtatttttcgtctctgccacgcagccaaaaaggtgcatgatatttgcacagaacttctataaggaaaagagagatcatttggagaaaagaaaaagacgagtaaacccggggggagtgtactcgccgcttcaatacgtgacgggtgctggatggcagctcgtctgttttattataaaatagggaacgtatgtttgtaaagggctgcgctgttttttcttattcggagcggatcaattgtaaaggaatggccagcatggtagcatgtcctgtaaaaagaaggagtgttcgttatggagccgttagagttaaacggtgtaaggctgaaaatgtatgattgtaaagaaagtgcgggtaaaaacggccgtatgatttcattcgtattgaaggtgacctctgaaacgtatcatgatattgccgtccttttgtatgaaaaaacatttgacatcaaggcgcccgagcgtgggcttgaattccgcggtaaaataaccaactactatacatccgtcacaaatctttacaataaagatgagaccggtgatttttttgtggaaatgaccgagatctgaattcatttgaaaaagctgccgggcggcagcttttgtgcgggatatgtaaatggttcggattgttcggggagtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcatcggtgaaatcaaagaattcagggtgcagaaagaacattttcttgcatttcgagcggttttgtcgaagcaggaagattttaagcatttccgcggtattgcccagcagggcggagatgttatcttccagtatttagaacagccaagaagctgacggctcctcgcacttgaggagtctttttttgttttcgctgcttatttcatctggctgtaacagatgtaaacaaaatgtaaaatccctccgatggatacttttactgctatttggttaatgttgtgaaaatgacggctgttttcctgccaataacaaggctgttaacaaacttcttccatcataaaagctgattgggagcattggaaaatctttaaccgtgaatttgcgtacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcacactggttgctgatttaaataaaaaaagcccggttccgaagctctcagaaacggatcataagcactctatccaaccgataaagctgtcatctcaccaagagaagaaagcaaaaccggacgagacggcttatcagccgccgaaaaaaacgtattcccgcgctgacagacggctcctgtcacgtctcgttcacgcagaagcgaaaggtgaatcttataaagggaaggttgcggtagccagcgtagtgctgaaccgtactgaaaaaaacggtttcccggataccattcggggcgtgatctatcaaaggaatgcatttgaaccggtagcaaacggaagcattaatcaaaagccggataaggattccatcgccgccgcaaatgaggcgctagaccatccgggcagagaaacgaacgcgttgtttttctacaatccgaaaacggcatctgaccactggatccgttcccgaaaaattatcgaacggatcggcagacacgtatttgcgatgtaagaagcatagcgggataaaaaatatccccgctatgcttttttcaattttgagaaatcgaaaatattttcagaacttgtctcatatgatgatggaagaacgtgagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatttttttaattatcgtgatcgccagtctggagcttccgatctctatttcaaaattcatcgcggaatccaatcagaagctgcatgaaagcatgcttcggcatgccttcagaatgaccgccgtttttaccgcgttttcaaccgcggccgcaagcatcgcgctgccgttcattcctgtattcgatacgtatcacccgtttattaaagggattgtcatcgggctgattccagtcgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgcttatttcgttatttgtgctggtcgcaagcgatgttgtggtgttcgtttatctgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgcaattgaacccttcttggttaaaggagcgctgctggcgtccggggcagccgggaccgccgcgattgatcaatacggtatgcttgccggtgtagcgatgacaatcggttcgtttcccgcatttatcgcccattcgctgatggtcgtcatgattcccagcatttcagaagcgtatgcgctgtcccaatatgatattgtgctgaaacggctgagacaagcgatttttattacattcggctacggcattccggcggtctgggtcatgtttcagttcgcgggcccgctgacccatttgttttttcagtctccggaagcgcagtattatttgcagcttttgtggccgttttttctttttcatctgtttgtgatgccgcttcaggcctgtctgatcggcatcggccacgtgaaaacggcgttttatcataacgtatggagcagcattgtagggctttcgatgatgtatgtgctcggttctatgccggaattgcaaatgctcggcattatactcggtatgaataccggcatgattcttctgacaagtttacattacgcgacgatctgcaaagacctcggtgtctccgtgtttttgacgggcggcggaagaacagcgccccggatcgaaagctgaaaaggctgatacatctcaataaggaagggcaagctatccgaaacgcgtgaaaggaagatcatatgcataaaaaccgcctaattgtatgtgcagtccttttgatagctgccgccgtctggatgcctgaagcaaaagcctcatcagaaaaacaggcagttcccgccgtgtttctgatgaagacgattgaaggagacgaaatatcgattccgaataaagggcagaaaacgattttacatttttggacatcgtggtgtccgccgtgcaaaaaagaactgccgcaattccaaacctattttgaacagcatcagtccgatgatgtaagccttgtaacggtaaatttgatgaatgccgagcgaaataaaaataccgttcaaaactttgtcactcagcaccatctcacattcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaaataaaaaggtgcgggaggaattcctcccgcaccttttttgcatataatgaacagctgaagaaacgctaatgataattattatcaaaaagaaattaaaacaattataattgaaatcttccgccggcatgctataataaagaaaacactgcgataacactgtgaaaatgctgcctgtcaggcggctgttttacttttatcggggaattgaagatgatttgcgttctcaattagagaggagaattcataatgaatgaacaagtgatgacacaaacccattcacaacagcagatacaagaagagcgggccggaaaaaggtggctccagcatgcagaactcattgcggcgctcgtatccggcgtccttattcttgcggcctggttttttaccgaaacaaaaggcctgtccgtcactttgtatatccttgccttcctgatcgggggatttgcaaaagcaaaagagggaattgaggataccattgagacgaaggcgttaaatgtggaactgctgatgatatttgcggctgtcggctccgccctgatcggttattgggcggaaggcgcagttcttatctttattttttcgttaagcggcgcgctcgaaacatatacgatgaataaaagcagccgtgatttaacatccttgatgaaactggaaccggaggaagcgaccctgcttgcggacggacgggaaaagcgggtgccggctgctgaacttaagatcggtgacatgatcgtcattaagccgggcgaacgcgtagcagcagacgggattattgagtctggcgtgacgagcctcgatgaatcggcgctgacgggtgaagcgatgccggcggaaaaaacagcaggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcgattcgaaagtgtctatgtcaaaggcgtgctgttagccgtggctgtgcttttattcgttcctcatttcgctttaggctggagctggagtgaaaccttttaccgggcgatggtgtttatggtggtcgcctccccgtgcgcgcttgtcgcttctattatgcccgctgcgctttctcttatctcaaatggggcccgcaacggattattggttaaaggaagtgtgtttttagagcagctgggaagcgtacggatgatcgcatttgacaaaaccggcacggtcacaaagggacagccggcagtcgcggcatttcaagcagcggaaaatgtgagtgaagatgagatcatgcaggcggtatatgcgatagaaaagcaatcaagccacccgcttgcaaaagcgatagctgaatttgccgaaagccggggcgccgcgcccgcaggccatctatcgattgacgagacgtccggattcggtgttcaggctgaaatagaaggcgtcaaatggatggtcggaaaagcgggatttgcaggtgaacatgcggcagatgcttttttgcagacatcgggaaaagaattaaaggataaaggctttacactggtttttgttaagaaagaagaccggattgcgggctgcttcgccttaaaggatcaaatccggcctgaagccaaagccgtgatggctgagcttgaatcactgggcattcaaacagccatgctcaccggcgatcagtctgaaactgcggctgccatcgcgaaagaggcgggcatgacgacggttgttgccgattgtctgccggaccaaaaggcaaaagaagtgaagaagctgaaagaaacgtacggcacaatcgccatggtcggagacggcattaatgacgcgcctgctctgaaaaccgctgacgtcggtattgcgatgggcggaggcacggacgtggctctagaaacggctgacttagtccttatgaaaaatgatcttcacaagcttgtgaaaatgtgcagactctcaaggaaaatgaaccggattattaagcagaacattgttttctcgctctcagtcatctgccttttgatctgcgctaactttctgcaggtgatggaactgccgtttggcgtaatcgggcatgaggggagcacgattctggttatactgaacggactgagattattaaaataaacatgacagccgcacatcgggcggctgtttttttaatgttcgttcacagcataaacgccggaaaactgatagaatgaataaagagtcactttggtaaggaggaaaagcaaaaaatgaacagattagaacgtgtttcatcttggctgaaaaaagaaggacatgatgcggcgtttatacatacaaaggaaaacgtattttatttaactgatttttacacggatccgcatgagcggttaatgggattgttcctgtttcaggaacaggagccgtttttcgtttgtccgggaatggaagccggacaagcccgcagcgccggatgggagcatggtattatcggctacggcgatcacgaagatccgtgggagctgatcaaagccgagctcacaaaacgaaatgtgccgcttgattccatcgcggttgaaaaggattcgatctctctttcccgctcagaacagctcaaacaagcttcagggggcgcggcatttgtttcggcagaagaaacgctcaaccaattccgtctcgtgaaagatgagaaggaaatcagcattctcagggaagcggcaaaactcgcggattacggagttgaagtcggtgtcgcggcgcttaaagagggtgtgagtgaaaccgaagtactcgcgcagattgagtttgagctgaagaaaaaaggtgtgcagggcatgtcattttcaacgatggtgctgttcggggaaaaatcaggccagccccatgggaatccgggtgcagaccggttgaaaaaaggggattttgttctgtttgatctgggcgttattcttgacggctactgttcagacattacgagaacattcgcataccaatcaatcagcccgaaacaggaagagatttacgaaacggtgcttaaagctgaacagacggcgcttcaattaagtaaacccggcgtcagaatcggcgatcttgatttaaaagcccgcggcattattgaaaaagccggatacggagactatttcccgcaccgcctcggccacggactcgggatttcggttcacgaatatccatcaatgagcagcgcgaacgacacactcctcaaagaaggcatggtgtacacgatagaaccgggaatttacgtgccggatgtcggcggcgtgcgcatagaagacgatgtgtttgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatgtcatgcttttcattcaggggccgcagggcaaggtaactgccgccgagtatggccagacacaaaccgattaagcaaagaatccccatcgctgttcttctcctttcaaacggataggatgtatctgtttctagcttactgtatgaaacgcattccagatcaagggaaaaaaagaaaggggggacgccatggctacgatcagagacattgccggcgctgccggggtttccgttacaacggtatcaagagttttaaacgatcatccttatgtaagtaaggacaaaagagaaagagtgaaaaaagcgatgcaatcgctcggatacacgcgcaacattcatgctgtgcatttatccaaaggtttttccgatatgatcggcgttgtgcttccgtcggtgaaccttccgtattttgcagaccttgttgcgggtattgccgaggctgccgaagcgtcaggcgtgcatctttgtttataccagacagattatgagcagcaaaaagaacgttttgccttatcacaattacaggagcgccaagtggacggcctgattatctgctccaaagcaattcctgatgagcatctgcttgccgtgaaagaaccgctcatcctctgccagtacactgatgcggcagggctttcctccatcagtaatccgcatcgggaagcatttcggcacggtctggattatctgatagaaaagggacaccggaaaatagcgatcagcctggccagaaaaaagggaaaaaacagtcaagtccgcatcgccgcatacaaagaggcgctcaagaagatcgggcagccttacagggaagagctggttgtggaaaaggtgctgacgctgcttgacgggaaagccctttttcatagatggaagagctggggtgacaaaccgactgcgctgtttgcggcgaatgatcaagtatccgcaggtctttaccttgaagccaaggcaaacgggacgcgcatcccggaagagcttgcgattttgagcatcgacaatcatgatatcagcaagatgttaggtatttccacaatagatatactaacgaaagaaatgggaaagcaggcttttcacatgcttgagaaccggatcagcggcgggcctccgggaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcaggggtttgacattaaaaacccgtttctcatggaaaccgaaacgctttatccggaagaattccaaattgcccgtgaagtcgtcggcatgattaatgaaaagacgggaatctgccttcctgaaggagagatcggctttatcgctctgcatatccattccgccctgacgaatcggcccctttcagaggtcaatcagcattcgcagctgatgtcccgcctcgttcaggtgattgaggactctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcggggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaatcgcggccattatcggatacctggtcatgaacgtatccatgagcgccgtgcttatggcgaacggcagtattccgtctgacaaaattgaacgggcaaagttttttgcggaaaaccatccggcctatattaacatgctggggatacccactttggcgactggcgtgttcggcggtattatcgtcggggtcctggccgcgttattgttcaacaagttttataaaattgaacttccgcagtacctcggattctttgcgggtaagcggttcgtcccgattatcacatcaatttccgcattaattctcggacttattatgttagtgatctggcctccgatccagcacggtctgaattccttctccacgggtcttgtggaagcgaatccaaccttggcggcctttattttcgggatgattgagcggtcattgattccgttcggtcttcatcacattttctactcgccgttctggtatgaatttttcagctataaagatgcggccggagacatcatccgcggagatcagcggattttcatggctcagatcaaagacggcgtacagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagtttcttaacgggaattaccgagccgcttgaattctcattcttatttgtggctcctatcctgtttgcgattcactgcgtattcgcgggactttcctttatggttatgcagctgctgcatgtaaaaatcggtatgacgttctcaggcggtctgattgactacttcctgttcggaattctgcctaaccggacggcttggtggcttgtcattccggtcggcctaggattagccgttatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgaccaggaaaacattaagcaccttgacgcttgtatcacgagactccgcgttacggtcaacgaccagaagaaagtggataagactcgtttgaaacagcttggcgcctcaggcgttcttgaagtcggaaacaacattcaggccattttcggcccgcgttctgacggtttaaaaacacagatgcaggatattatcgccggacgcacgccgcgccctgaaccgaaagtatccgcacaagaagaagtcagccagcaggttgaggaggttatcgcagatccgctccgaaacgagcagggtgaagaagtgttcgcttctccgatcaccggcgaaatccatccgattaccgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggtcttcagtctgacggcggaagagagatcctgattcatttcggaatcgacacagtcagcctgaaaggcgaaggattcacttcttttgtttctgagggtgaccgggttgaaccggggcaaaagctgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgctgaacccggtaaaggagaaaatcagcacagattcagtcaatgctgaattcgctttgaaagaaacagcttccatgttcgttactatgtttgaatcaatggataacgaatacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtaatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttcaaaagacggccatcatgtagagcttgccgcaaacatcggcacacctgacgatgtaaaaggcgttcttgaaaacggaggagaagctgtagggctttaccgtacggaattcctttacatgggacgcgaccagcttccgacggaagacgagcagtttgacgcttataaaacggttcttgagcgtatggaaggaaaatcagttgtcgtgcggacattggatatcggcggcgacaaagagcttccttacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgtcgaagccggcgtagcggtttctgacgatattgaagtcggtatgatggtagagattccgtctacagccgttatcgcagatcagtttgctacagaagttgacttcttcagtatcggaacaaatgacttgatccaatacacgatggctgctgaccgcatgaacgagcgcgtagcttatctgtatcagccatacaacccggcgattctccgtctgatcacccttgttattgaagccgctcacaaagagggcaaatgggtcggaatgtgcggagaaatggcgggagacgaaattgcgattccgattcttctcggcttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaacagccagacggtataagccgtctggtttttttcatattcggaaaaaaggggggaacaataacgttcaacaggagggattattatgacaaaatcatttgcagcgggggatacggtctatgtgatttaccgcaatccgcatgccgccaatgttgcccatattaaagaggcggagatcgtccatcacccatatcatgagggagaactgtctctgtttttatacgaaacctatcatccgctggccgaagatgacgcggtcttttcaacatatgaggaagcggaagcgctttacagcgagctttttgaagaagaccgatatcattgatcaaaggaaatgtttacaacgcatattcactctcttttaaacggaaagtaacaacatgagaatatgaaaaaagggagtgtcagttcatgctgaagccgtttgtgccccagcttgtttatatagaaccgagagcgctcgaatacccgttaggacaagagctgaagaataagtttgaaaacatggggcttgagatcagagaaacaacatcgcataatcaagtccggaatattccggggaaaaatcacttgcagcaataccggaacgcgaaatcaacattggtaatcggcgtccggaaaacactgaaattcgattcttcaaagccgtccgccgaatatgccattccatttgcgacaggctgtatggggcattgccactattgctacctgcagacgacgatggggtcaaagccttacatccggacatatgtcaatgtagaagagattctggatcaggctgatgagtatatgaaagaacgagcgccggaatttacaagatttgaagcctcttgtacgtctgatatcgtcggaatcgatcatctgacacatacattaaaaagagccattgaacatttcggacaaagcgaattggggcagctcagattcgtgactaaatttcaccacgtcgatcatttgcttgatgcaaaacataacggaaagactaggttcagattcagcatcaatgcggattatgtcattaaaaactttgaaccgggaacttctccgctcgacaaacggatcgaagccgccgtcaaagtcgctaaagcgggctatccgctcggtttcatcgtggcgcctatttatattcacgatggctgggaggaaggctataaggagctgtttgagaaactggatgcggcgcttgataaagacgttcggcatgacatcacatttgaactgatccagcatcgttttacaaaaccggccaaacgggtgattgagaagaactatccgaaaacaaagcttgagcttgatgaagaaaagcgcaggtacaaatggggacgctacggaatcggcaaatatatataccaaaaagacgaagaacatgccttaagggaaacactcgaatcttatatcgaaacctattttccgaaagcgaaaatcgaatattttacgtaaggcggagctgtcggcatgacggctcttttttttgctgcgccaaatgacggaaatgtttgatatttatttcaagatttattcattttcttggccgaaagaccgatataactctcaggaggggatggttatgtttaaaaaaatgcatatcaaaattgctgtgtttgtatcggcaatgcttattgtaacggttgtttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcagacggtgaattgtcccggtcttttctatcagatgggaagaaagaaaccgcgcggctttttaacgatgagttaaaacagatcggacagaatgacaaatatgtcgcgcttgcgtacgtcggaaccgcaaacaaacaaatgtttacatatccaaaggccgattttgccaaagactatgatccgacaaatcgaacgtggtataagatggcggctgaaaaacccgataaggttgtctggactgacccttataaagatgcagtgacgggagacatgatcgtgacggcgtcaaaagccattcaaaacagcggaaccgtcgtcggagtggcgagcttagatttgaagctgtcctccattcagagcatggtcaacgagcaaaaggttccgtataaaggatttgcgtttttggcggatgaaaacggctctcttctggcccatccggcaaaacagggaaaaaatatttcggaagatcagacgttaaaagacatcactgcggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctcgcaaaaacgataaccgggccgattcagcagctgatcgcaaagacaaattcagtctcagcgggagatttaaccgtccgcgcccagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatttcacaagaaacaaatgaaacgagcggacaaatcgcaaaagcgatagaggaagtcgccgccggagcgacagagcaagcgtcagaggttgagacgatcaacgaaaaatcagaaaatctctcagtcaaaataaaaggaatcgcagatcgcgcaggcagcataaaactactctcaaaatcttcagaggatgccagctacaaaggattggacgcgctcgggcagctgctgatgaaatcaaacgaagccaattcagaaacgaaaaaagtagaggcaatgctgactgacctggaagaacaaacgaaaaacatagaagaagtcgtgacggcaatatccgctatttcagaccagacgaatctcttggcgctgaatgcgagcatagaagccgcaagagcgggagaaagcggacggggctttgccgtcgtcgcggaagaagtccgcaagcttgctgaacaatcagctctttcttccggccatatcagtgagacggtccgtctgattcaatctgagacaaaagaagcgtcacacgcgatgattgaggcaagcagaatgaatgatgaacaaaacagcgccattcatgaaacgggtgaggttctcaatctgattacgacggaaatgcagtctctcgttcaaggtatagatcatatttacaatgacattcaaaaaatgagtgaagaacaagccgcgattcaagaagcgattcaaagcatctccgccatttctcaagaatctgcggcagcggcggaagaagtgaatgcttctactgatgaacagctcgttacgcttgaaaaagtgaagcaatcgactgatatgttaaagagcgcaagcgaagatctgatcagcgccatttctaaattcaccttgtgacgcggtctctatcagcctataatatggtaatatagacatgaaagagtgatatatgaatcgcatcaggggaggaaagcgcagtgaacaaaacggtcggatttatcggtttgggcgtcatgggaaacagtatggcatcgcacattttagaagcgggctatcctgttttagtctacacgcggacgaaacaaaaagcagaagagattctgaataagggagcggtctggcaggagacggtcaaagacctttcagagaaagctgacattattattaccatggtcggctatccgagtgatgtcgaggaaatctatctcggcgaaaacggcattctccggcacgcaaaagaaggggcgtttgtcattgatatgacgacatcaaaaccgtctctggcgaagaaaatagcggaaaaagccaaagaaaagtccattcacgccttggatgcacccgtttccggcggagacatcggcgcgaggaacggaacgcttgccattatggccggaggagaaaaagaagcgtttgaagcatgcctgccgcttttctccgttatgggggaaaacattcagtatcaagggccggctggcagcggccagcatacgaaaatgtgcaatcagatcgcgattgcagcgggaatggtcggagtggctgaagcgatggcttacgcggaaaaatccggtctgaacccggaacaagtgctgaaaagcattacaaccggagcggctggcagctggtcattgtccaacctcgctccccgtatgctgaaaggcgattttgcgcccggattttacgtgaaacactttattaaagacatgggaattgctcttgaagaagcagagctcatgggagaagaaatgcccggattggcgctggccaaatcattgtacgacaagctttccgcgcaaggtgaagaaaacagcggaactcaaagcatttataagctttgggtgaaataaaaaaaagattgcccgccgggcaatctttttttatttattttccgatgaattgctgtgtccagatgtttcctgattctacataacccacaccgatttgagtgaactcaggattcatgatgttctttctgtggccttcactgttcatccaagctttaacgacggcttcaggagtcgtctgccctttggcgatattttcaccggcagttttataagtgattccgaaagacttcatcatatcgaaaggtgagccgtaagtcggactttggtgatcgaaatagtttttgtctttcatatcttgtgattttgcgtgagctgatttgcttaatttttcatcaatctgcagaggttttaagccttgcttttgtctctctgcatttgtcaattcaacgactttcttttcgtacgcactgacagatgaaggagtcttctcgctgctgttgtttgtgttatctgtctgctttgcattgtcagccgtcttgttttgatcggctttcggtttttcggcagctgccggagccgtttttgccggtgttcctttttgaacgtctttaactgtcatatcagaatgctttgcgtgtttttgcagctgctgtttcagttctttctcatttttaacgttcagctttttcacgctcgttttcatatgtagtttttcaacagcctcttgaagagtcagatgctgtacggtgtttccttttttcacggtaacgacgtgctggcatgacagctctttggcagatgtctgctgaatgcctccgaatgtaatcaaactgactgccgcggcggcagataagagaaatgcttttttcataagtttatagcctcccagagaagttgtttttttctacatgaaaaatcttatcacagcttttttgtcataatgcaggcagccatttcctttgacaacaaactcttgtcataattgtaattgagcgcagaaaaatggctctataccgggaaaaacgatctgtattttttaaaaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagtcgcgcgcgaaccaaagaaaaaaacgaaacgttacagagcgctgagaatgaatctctattttttgattgtgtttcttctctttacggcactgatttttaaactcggcatcgtccagattgtcgaaggggataaacaccgccaggatgcggagaaggcaaatgcaaaaaccgcctattatccgacaccgcggggaaagatgtatgacaagcggaacagagtggcggttgataaccaggctgtgcctgaaattgtatacgtttctacctcaaaaacctcggcaaaggacaaattgaaaacggcaaaaaatctcgccgcactgattcatattgatactgaatttatgaaggatcgaaatatcattgattactggcttgccgcacatccgaagaaggcggaaaagcttatgaaggattcagaaaacagcctgaaatcccaagaagtgtacaaacgccagattgaacgcgtcccgaagcaggagattgatgcgatcaaacaaaataaaaaagagctggaaatcgcggcgatttatacgcgtttttcaagcggcaacgcctatcagccgcaagtcgttaaatcaatggacccgaataagctgaacggaaacggaaacagcggttcactgcttgacgagcatgaaaacaacaagcaaaaaccaaaaagcgacctgacatatgaagaagtttccgtcgtatccgagcacctgaaagagctccccggcattgacgtaatcaatgactggacgcggaaatatccgtacgataaaacgctgtactctctgttcggcggtgtgacgaccccggaacagggattgttgggcgaacggaaagattattatgtcacaagaggctactcactgaatgaccgggtgggaaaaagctacattgaatatcagtatgaagactatttaaacgcacataaagaaaaagtagagtatgtggaaaacagcaaaggtgaagtcgtcagccaaaagcccgtcgatgaaggcagcagaggctacgatctgcagctctcgctcgatatggaattacagtcgaaagtcgaaaaagtcattgaaaaagagctgagaagaagccgcgctgcaggcaactatatggttgacagaggatttgccgtcatgatggacccgaacaacggggatattctctcaatggcggggaaacgcatcgatctcgaaacaaataaaacacaggattttgcgatcggagcatttacgacccaatatgagatgggctcttctgttaaaggagcgactgttctcgcgggttaccaaagcggcctcccgcattataaaacgtttgtcgatgcaccgcttgtatttaaaggcgacacgaaaaaacaatcgtggacacaaatgggagccattactgagctgactgcgctgcaaagaagttcaaacgtgtatatgtttcatgtggccatgcatatcgccggcattacttacgtcccgcacggtacgctgcctgccggattagacgatattaaaaaaatgcgcaactactacgcccaattcggtttgggtgtgaagaccgggattgatcttccgcaggaatcagcgggcatgcagtcaaatccgcaattggtcgggggattgctgctggattttgcgatcggacagtttgatacgtatacgccgcttcaaatggctcaatatatttcagccatcgcaaacggcgggtatcgcgtccagccgcggatcgtcacaagcattcatgaaccggacagcaaaaataagattggaaaagcgattgaacagcgggatattaaaattttgaacaaagtaaataacagtccgagcgattttgaccaagttcataaaggaatgaaattggtcacaagctcacctcaaggaacggcttattcaacattccaaggttccggcgctgatgtttccggtaaaacgggaaccgcgcagacgcactattacggcacgaacaagaactggtgggggaaagatacgtataacctgacctttgtcggctattatccgtcagaacatccacgagtggcattcagcgtcgtcgttccgtctgttcaagatgatcacgatcccgtcagcaaaaacattgccaaaggagcaattgacgcttacaaagaacttgaaaagaaatacaataaaaaataacaaatgaaagggcggccgaacatctcgtgcgccctttctttcattcaggaaaattgacgttcacaataagaatagaaggagaatgctcattttttagcgaatcaatctagtggaatttctttttatatcagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttctgcaaactgtaaatcgtacttcagttattctcaggaagagatgatcgggtcatttctcaaaacgttcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacgccccgccggccttatatgtatgaacaaaagaagcaaaaggcagaacaacagtctgaagatgcggctggaaacggcgaatttgagcgtcttgtcgaaatgctgccgaatcctttatatgtcagcatcaacggcacaatcgcctacgccaacaacgcgatgcttgccatgctgggagccgaaagcaaagacgaggtaatcggcaggcgctcctatgagtttattgaagaagagtatcacgacattgtgaaaaaccgaattgtgcggatgcaaaaaggaatggaagtcggaatgatcgaacagacgtggagaaggctcgacggcacgcccgttcatttagaagtaaaggcggcaccgacgacatataaaaatcagcgggcggaattgctgcttctgattgatatttcttcacggaaaaaattccaaacgattctgcaaaaaagcagagagcgttatcagctcctcattcagaattcaattgacacgatcgccgtgattcacaatgataaatgggtattcatgaatgaatcgggcatttcgctgtttgaggctgaaacatatgaagatttaatcgggaaaaacgtctatgatcagcttcatccctgtgatcacgacggcgtgaaacagcggatccaaaatattatcaaccgaaagaccgagtcagaaattattaagcaatcgtggtttacctttaaaaaccggctgatctacacagaaatggtctgcattccgacgacgtttttcggagaaacagccgtgcaggtcattctgcgtgacatttctgagcggaagcagacggaggaattaatgctgaagtcggaaaagctgtctatcgcagggcagctggcggcggggatcgctcacgaaatccgcaatccgctgacggcgatcaaaggatttttacagctcatgaagccgacgatggaggaaaacgaacattactttgaaatcgtgttttctgaactgagcagaatcgaattaattttaagtgagcttttaatgcttgccaaacctcagcaaaacgccgtgaaagagcgtgtaaacttaaagaaaattataagtgaagtgaccgctcttttagagacgcaggcgaatcttaaaggaatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggcgacgggataccggaaaacgtgctgaaacgaataggcgaaccgtttttgacaacgaaagaaaaaggaaccggcctggggctgatggtcacattcaaccttattaaaaaccaccagggagccatccaagtagacagcaaaccggacagaggcacggcctttcacattacattcccgaaacaataaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaactttgaaaatgagctgccgggcacaagagccacacctgcatcctctaaaagagccatactaaaatcaaacgatgacattccgaatgacttaatggaagggaagatataaaatgcgcctgacggctttacgacgtcaagccccattgaaacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcacaccggtcggatttgacggataaggaagaatgacgcattttgtttttggtgtcagcgattcttcaataagccgcgccgtcagcttaaatccgtgtgtcgtcgtatccacatgaaccggaacggcgcccgacatgcggatgatcggttcgtagcccggatatatcggtccggggagaataacttcatcgcctggagataaaatcgtccgcaaagacgcgtcaatcgcttggcttgccccggttgtgacgatgatttcagtttcagcctcataattcaaatcagcttttttcttcatataaagctgaacggcctgtctcagctcaaggccgcccgcgttcggagtatatgccgttgcgttctcgtcgattgcctttttggcagccgctttgacatggtgcggcgtgaagaaatccggctggccgatcgtaagcgaaatgacattggcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttctttcagaaaaaaataagacaaccagctgaaatgattgtcttcattgtatcatgatctatctattgtgatatgtggcgaatgtcattaatacccgtattcaaagctgacgtcttcccgccataagatgtatggagcgggcttgtcgggacgctctttcgcctcttttttcatttgcaggtaagccgttttgctgatatcttctaacaccgtcatttgatcttggtcgaatatgactactgtacccatttattacacccttcttcctgaaaaatccttgactattttaccactcgatgtcaaaaagtcaatgggatatcagaaaaaagcatctttttataaagagttcatggccagttggcccgaatacattcactttttccgtttacagccgatatatacagtacaatactgaatgcggatagcgagggattgaattgtctttacaacaatacgatattttattggattcaggcacaaacgaattagaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtattcctttttcggcgttgatgccgaaggagcaaaagacgataaatatatcgtaacggaattcaacaagcggaaaatcgtctttcacgtcggttccgtttcacaaatccacagggtgtcctgggaggcgattgaaaagccgacttccctgaaccagggcatggagcggcatttaacgggaatcatcaaactggaagacacgatgatctttctgcctgattatgaaaagatcatttacgatattgaatcggcatccggagttgagacttatcatgtccatcaggaaggatttgatgaaagacgggcgggtaaaaaactgatcatcgttgaagattcgccgcttctgatgcgtcttttgacggatgagctgactgaggcggggtacagtgaaatcgttacatttgaaaacggaaaagaagcgtatgattacgtcgtggaactgacggataacggagcaaacctgtcagatcatattgacatgattatcagtgacattgagatgccgaaaatggacgggcatcgtttgacgaagctccttaaggataacccgcaaagctctgatgtgccgattatgattttctcgtccctgattacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatttttttcctttattagacaggtttcgcatgtttttcggaatcagcctttaatgattgctgcacatcgacctctgctgcctcggcgctgtatttcggaagagcgataaaatagaacacaaataccgctaaaatcacgattcccatgccgtaataaaggtaatcaatattggaaacgaatttcggaaataacagggcaaccagtccgagtgtaatcgattgggcaaacatcataaaaggatcctgccagccgctgacccggcccattattttcggatgaacgattttcggcatccagccgccgatggcgatattgacagggccgatgcacatgccgaggatgaaagccgccgcataataaatccacagcttatccgtatagccgaggacaaaaatgagcagtccggctgccaaaataggaatcgacatcaaatgatgcggtttgactttttttgcgatcattgttccgatcacacttcctgcaagcaggccgaagccgagtgcgacggtgaagatggaagtatgtgattcgtaatgatcaggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgaataccgatcgttttatacataaacgcgcccataccgacgccgaataccataaagatgctgaacaggatctggttaagtcccgccgctttcgcataatgctccttaggcagaatagcttgtacaaggctggcttccgccgggaaaaagaacttggtcacggcgcttctgatgaacaaaatacagaacacgagagggatgctcccggtgtataatgcggcaaacaatacgatcgtcagtccggctctgatccaatcacaattctctgcgacctttttcctgtcaagccggtcagctgcgacaccgacaatcagaaatacgaaaactgtcggcagtgaatacatcagctcagccaaagttgtgtatgccggctggtttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatcgtcacccttgttccattaggcacggtagcggcaagttcagtgacgtcctgattatacatccggatgcatccttttgataccgctttgccgatggaggaagggttatttgttccgtgaatgccgtaatgaattttagagaggctgagccaataagcgccgaacgggccgccgggcttgggctggcggttcacaatgtaaaattctccggtcggcgtggtcgtcaatatttttccgacggcgatggggtacgtacggatgagcctgccgaggcggtataactccagtttcttcgctccgatatacacgacaatggaatagggaatggtggatgggtcgggaagattcggtatgataatgtgctgtcccgcgtatatgaccgattggattgagggatttgcctgaaggagagcagcagtgcttattctgaagtcttgcgcaatgcttgagatggtttctccttgtttcacttgatatgtcagcagtttcatcaccctcctttttgctcttttccatatacatattacggagggggtgtctgtgcatcgggataaaagtcttatttttgtacggttttcaatgtgaacagcgtaatttccggtctggctaaaaatcgatacggcagtcttgtcgtaccgagcccgcgattgacgtaaacggctgtgtcatgcagcgtatacatgccgtcggtatacgtttttccgtatggaggcgtaatgagagggccgaaaaacgggagctggacctggccgccgtgagtgtgtcccgagagctggaggtttacgggatatccgccgatcttgagagcggcatcaggctcgtggacgattaaaatggaaaacgcatcttcggaaaggcgggaaagggtgccttcataatcgggttttccgagcattacatcatccaaaaacgcgaattcaatccggcttccgtctgtcagctgcacctgacggcagccatttcgaagcacttgaaaatcagccgcttccatcagagccttgtacgtgttcgtaccgtagcctccgtggtcatggtttccgtaaacacaaagtttgccgaagggagcttccagattttgcagcacggccagtgcttgctggtgatcattaaataaatgcggcttatcaattaaatctcccgtaaagatgagcagatcgggtttcagctgattgatcttttccgctgctttattcaagtcaccggatgtaaacacatcactgagatgcgtatcgctgaattgaacgattttaaaattgtcaaagccgcgggggatcaggcggctggtgattgtatgacgggtgatctcaatcatgcgcggttcaatataccgggcatagccgtaacctccgcaagccgttgcgagagttgcacccaaaatgccgaatcctctttttaaaaatgttcttctcgtcattttctccatatgtaaaaccaacctttgtcagagttgttctattatatcatcagcctggctgaaaaatcccttctcagcatgtaatgacgcggaaagatatctatgataaaattatgaatgattattcattcaataaaaggggtgggtttgttatggataagaaagcggtaatcattacaggcggttcgagcggcatgggaaaagcaatggcgaaaaaacaggctgaattaggatggcacgtcatggtgacagggaggaaccatgaagcacttgaggaaacaaaaaaagaaattgagacctttgaggggcaggtcgcctgttttcaaatggatgtccgttctgattccgcggcttcagacatgattacagaagcgaaaaaagtctttggccggctcgatgcgctgattaacaatgcggccggcaattttatttgcccggcagagaagctgacgcccaatggatggaaagctgttattgagattgttttaaacggcacttttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcccccggcccgattgaacggacaggcggtgcggagaagctgtttgaatcggaaaaagcggtgtcccgcactatgaacagtgtgccgctcggccgtctggggacaccggaggaaatcgccgctttggcagcgtttttgctatccgatgaagcatcctatataaacggggattgtatcacaatggacggggggcaatggctgaatccttacccgttttaatttacatgacatattttgcaaaacaagcgaacgttaaaggtgaccgttcgcttgttttatttttctattcaaaattatgatataatttttaaagattaagaggtgaataagtgaagaaattattaaaatggttcgttgtactatttgtaagcagtttcgttatcatctttaatatttggtactttatcatttgcgcttttactccggagtattatcaaaataccaatcttacatctgatgaaataatcagatttgaaaagctatatcatatagattttcctgatgaaacgaaatttattaaagccggggagtatttgagtgggctcggaggcgatacatcggctgtatgatatgtgtctctgccaaccaagctggcggaaattttatctgattatacgtatatgccaataaatcatactgatcatgccggttcaatgtatgaagttgacgtttccaagagtgctggcgggttaacaactcttacatttggcactttagataaaaaaggaactttctttcagttgaaacatgatgatgattggatatttaacagtactgattggagccattatttttggacagccgccggttatcatgctcttatatttatccttttatttgtgatggtgacaaatgaataacgtccttaattaaccggtctgaagagtgatcttaaaaagtttaccccttttattttaaactgctgccatactgcctcctttttcccctaatctaaacatttgtggtgctgatataattgtgtataatcagacaaagatagagaagcaggtgataacatgttggacccacttgatatactgacgaatattgatgatgttattccgtattaccaagcgatttttaacgctgaggaacaaagagtcgtaggctacgaagtgcttggccgtattttggcagatgcggagattgagagcctcgggccgtttttcttagattccggtattccggaagaatataagcttgaggtcgatgacagagtcatcaggcaggcgctgaagcggtttaaagaagctgatcgcgatctgttgatttttatcaatcaggatgcgaatgtattgatgcttgaccacggcgagagctttcttgagcttttgaaagaatacgaagagcagggcattgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcacccgaccttctgaaaatagatttgcaggcgctgaaagtatctcagccgtcaccttcgtatgagcatgtgctgtacagcatttcattgctggcgagaaaaatcggcgccgcgctgctgtatgaagatatagaagctgattttcagctccagtacgcatggagaaacggaggccgattttttcaaggttattatctgcaggcgccgagcggcgattttatagaccggagcctgttaaaagcacgcttgaaaacggagtttcagcaatttatcacgagagaaaaaaagaagctggagacagtatacgaacactctgagaatttttataagcgggtcaatcaggcagtttctgagctgaagaaaacccatcaggcggacgatgagtttattaaaaaactggcggaaaacctgaccgactgctgtttcagaatttatatgtgtgatgaagaaggctatcagctgacgggaaatgtgttcaagcagtccggcgaatggctttatcagcctgaatacgtggagaaaaactggagctggcgtccgtactttttagaaaacattatgaagatgcggaattcaagaaaaggctttttcagtgacctgtacagtgatattgagacgggtgagatgatcagaaccttttcatatccgatggatgacaatatgtatttatttatcgatctgccttactcttatttatatgaacaggacgggttactttaaagcggctgctgtaagccgctttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctgcgcataaaagggcttctccttacatacatctgacaatggcggctcaaaaagcgaaaaattatttttgaaaggtgtatgacattccgaaaaaagcttcaaactattcgaaaacacggttttcccgtttatttctttttgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacatatccgtttgataacattgacatgatttctattgaaatttttgagctccttcagtaatgtgatttgatttttcaggctgaccaagcttccggtcttccgcaagcggagctttattaaattatgcaaaggaacgtgcttgttcgtttggttgtagactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggactgattcacaagtttaccgcgacttcacaaagtttattacggctatacacttgcaccgtacaggcaagggagcttggggctgtttgaaaaatcacgaccttgcaagaccgatacatagccttcgcgaaaaaatctcgctggaaaccgcgttcagccaggagatggctgcgcatatcctcgacggctgtcttatggaactgacagatttgctcttgccttttgcggatgaaggggcggatctttcatttgaagtgcatctggatatcggtcaaaaagggctgacaaaagaattgatacaagaaatgaccggccgcattacctcgatgggcattgaagcgaaaatcaagcccgattcctgcacagcgttcagttatgccaatcgttacacaaaataatatttcatacagaatccgcaaaatgtcgaattatgcggttgacgatttttttctgtttacttattctagcggtagagctgaaagcaaatcttcacattgctttcagaggtattcagttaaaaatagggggcctgattacgtatgagtcttatcagtgaacgatttacggaagaagaacagaaacttctgctgaatatcctgatcaatcaagaatatgccattgagcttttgaccagcgaaatcaacgatatagaagcagggtcaaaaagcgttgatggaaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctctattagtgctgacgaaaaccggctataccgccattcccgtccttgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaagggttcagcatggtcattaacaacggctttgtctgcgttgaaaatgatgaaggcgtctttgaaggcattttcacgagaagggtcgtattaaagcagttgagcagtcatatcagatcattgaataagtaggctcgaacgatcagcctatttgttctttcgcatgccagaaaaagaaaacgcatacatatgagtggcgcttgcctcggcagcctttatttgattagaatggtagataagaaatacgaaaaggcattgaaaaggaggacgacatgcagcttcaagagcttcatatgctcgtagttttagctgaggaattaaacatgaggaaggctgccgaacggttattcgtgtcacagccggctctgtcccagcgattgcagaccattgaaaaaacctggggaacaaagatctttcttaggtctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctcgattatcgggcagcactggcttccgaaagtgttaaaaacatatgtggaacgatatccgaatgcaaaggtctctctcattacaggctggagcagcgaaatgctgaaaagtctgtatgaagatcaggtacatatcggcattatccggggaaatccggaatggaaaggccggaaagattatttaatgaccgatcatttatatttggtcgatacggaaatttcctgtattgatgatattgcccataccgaccggccgtttattcaattcaaaagtgacagtacatattttcaggaaattcagcattggtggcatcaaaaattcaaaacctcgccgaaacagaccatccttgtcgatcagattgaaacgtgcaagcagatggcgctgcacgggatcggttatgccattctgccgtcagtcaccttagaagaggaagataaagtaaataaaatgcccctgcttgatacaaaggaccatccgatcggccgtgacacatggctgctcggttatgagccggcatttgaattaaaacaggtgcaggcttttgtttctgtcattaaagatatgctgaaacaggaacgcccattttagaaagacagcaatcatgctgtctttttttattttttattgacaatgaaaatcattatcatttaaagtgttatatatgttattgaaaatcattatcaattacgaggtgatcatatgcagaaagcattaatgatatacgcaagcatgtcggggaatacagaggatattgccggcattataaaagaaacactgagcgggcatcagatagcggttgactgtcttgatatggacgaagcagatgcggattctctcaaagcatatgattatgtttttgtcggcacatacacatggggggatggtgatcttccttacgaagcggaagatttttacgaagatattctgcacagccagctcaacggactgaaaacggcctgtttcggttcaggcgatcatgcctacccgaagttttgcgaagcggtcacgctgttttgcgatgcgtttgaacaggccggagccaatttatatccggaaacgctgaaaattgagctggcgcccgagacggctgaagatcaagaatgctgcaaagaatttgtccgcggttttcttgcatgggccgctcaccacggagaccggtgccatgtttcataaaggcgcgacggctgtcatggcatcagtatcttcaggattttttgtcgctgtgaaaggcgaaggtatttttcatttttcggcggaagaaggctggaaaagactattccgagtgaagagcaggattcatgtgctgacttatatagggccctacatattcgcggctggagaaaaaggcgccgtcctcagatcggccgatcaaggaaagacttggacggcctcccgatttccgaccagcgcctccgtatgggccgttgccgggcagaatgacggatttgtctgtgctcacggcacatactgcatctacttatctgatgatttcggcgtcacttggcatgtggctaagcctttttcacaattaaaggagccgcctgtcatccgttcgctttgtttacacggtcagacggtttatatcggcacccggattcatatgaatcatggcggcatttgggcgtatgatctgacggaaggccgcatccggcgtataagccgcgaaaggcagcgcatgacggcttcaatgatgatgtatcagaatgactggctcattgcagcaaagggcgcggcaaagggagaacggggggagcttgctgtccgaaacgtgcggacgcatgaggagtttgccattacagccggggacaatgtacgggaaaaatcatttcttgacgtgtctgaggataacgggattatttatgtcacttcgtcacaggacgaaagcggattttcgcgtatttatcaagctgacctcgctgccggtgaattaaagtggtttgatacgatccgcggtcacggatggcgggtggccaaccgggaagaagactttttttgcgcgggcctttacgaaagtaagtttgtcagaccgtatgaggcggttcggctcgcacattagtttttatgcataaaggagagacgaagatggggaatgtattgcttgtttacgctacaatgtcaggaaacaccgaggcgatggcggatttaattgaaaaagggctgatcgaagcacaagcatccgtagacagatatgaagcgatggatattcatgccggactttttaatgattacgagtatattttattaggcacatatacgtggggagacggggatcttcctgatgaaatgctcgatattgctgaagatatggaaaaactggagtttacgggaaaaacatttgctttgttcggttccggagatacgtcctatgagtttttttgcggagcggttgacgaattggaaaaagtaattacggcccgcggcggacgggtggtgctgccgccggtcaaaattgaaaacaaccctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatctcgaaggaatcagctttggcgattccgctaaaacattcctgaacggccaatccggcgtcgtttttggcgagtgggctgaaattaaaagcgcaatcgaagaaaacaaagacaaaattgaggattacgtcattgagaatgaccgccgcaactctgcgatcccgatgcttgatttaaaagatgtgaaagcgagaatcgagcccggcgctattatccgcgaccaagtcgaaatcggcgacaatgccgttatcatgatgggtgcatctattaatatcggttcagtcatcggcgaaggtacgatgatcgatatgaacgttgttctcggaggacgcgcgactgtcggcaaaaactgccacatcggagcgggttctgtattagcgggcgttattgagccgcctagcgctaagcctgttgtcgtagaagacgacgttgtgatcggcgcaaatgcggttgtgcttgaaggcgtaacaatcggtaaaggcgcggttgtcgccgccggagccattgttgtaaatgacgtcgagccatataccgttgtagcgggaacaccagcgaaaaaaatcaaagatatcgatgaaaaaacaaaaggcaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatcttttaaaccaatatccggaagaaagaattgaaatcgaaacttggagaaccggcatctttgtcaaaatcaacggcacggctccggaaaaaatgctcgcctacagagcggatatagacgctctgtcgattgaagagcagacggggcttccgtttgcatctgagcaccccggttttatgcacgcatgcggacacgatatgcacatgaccatcgcgctcggcattattgatcattttgtccatcaccccgtcaaacatgatctgctctttttattccagccggctgaagaaggaccgggcggggcggcaccgatgcttgaaagcgatgtgctgaaaaaatggacgccggatttaatcaccgccctacatatagcaccagagctgccggtcggcaccatttccaccaaaagcggattgctgtttgccaatacgagcgagctcgtcatcgatcttgaggggaaaggcggacatgcggcatatccgcatacagcagacgacatggtcgttgccgcaagcacgcttgtcacgcagctgcaaacggtcatatccagaaatacggatccgcttgacagcgctgtgataactgtcggaacgattaccgggggcacggcgcaaaatatcatcgcagagcatgctcatctggagggaaccatccggacgctttccgaggaatcaatgcgtatggtgaaaaagcggattgaagagcttgtcaaaggaattgaaatcggcttccgatgcaaagggaaagtcacgtatccgtccgtttatcatcaagtttataatacaagcggcctgaccgaagaatttatgcaatttgtcagcgatcatcagcttgctgacgtgaaaacggcgaaagaagcgatgaccggagaagatttcggatatatgctgaaaaaatatcccggctttatgttctggctgggggccgattcatcccacgggcttcatcacgccaagctgaacccggatgaagatgcgatggaaaccgcggtaaatgtcttggtcggatatttttcgaagtatgccaattaaatccgaaaagaagaataatctaacaaaaattgagcattctacattacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgtccaaggcattgccgatacgtcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcgagcgcgattttcatttctctccgcagtacgcgttcaacccgccattgctccatattttctgttttggcaatgattctgatcaccatttctgacgtgcttaaatcctgaaccccgatgacgtccggcccttccttaatctgcgggagctcagcggctgctttgtcacatgcggtttgcaggatttgaatggtttcatcaagatttttttcaagcggcactttaatatcgacaagcgcctgcatcgttccgcgggaatggttgctcacattcgtgatgccccggttgggaagatagtgaagcgtgccgtcaaagctccggatttgcgtcgtacggagaccgacctgctcgacaatgccgctgtagccggcaaccgtaatataatcaccgacgtcgatctgtttttccaaaaggataaaaaatccggtgacgatgtcactgacaagcccctgagccccgaagccgacggcgagaccgaccacgccggcgccggcaatgagagcgctcggattgtagtgaaataaatccaaaatcattacgataaaaacgaaaatcaggatgtatccgtacacattaagcgcgaggcttcgcaaagtataagcgcggcctgtggagaggttgttttgttgctcgaatttctgaaacagatgcttgatcagcttttttcctgccgtccggaaaataaaatacgctaaaataatgagagccagctttatgatgaaaatcccggcagatgtgagaagcccggcccaatcaaagtgttttaaatcaatcatagtgatgtcttcctttcaagtctattgaggaaaaagctaaaagagatatacccgttttttaaataagataaaccttttcatagaaaccagttattacatttatgatttgttcatattgcccggtttcaatatcttcatttttgtgaagatatgaactaaggaatcgccacactcattttaacatggtgattcagccaaatcatttcctttggagggaaaacaggagaacgttgcccggcggactgaaagccccggcaaaaaacttttttcataaggagggaaataagatgaaattacatcagcaaatgcctgaattaacaggcgctaaagcatggattaacagagaagtcacgaaggaacagctggtcggcggaaagccggcactgattcacttctggtccgccagctgccgcatgtgtaaagaagcgatgcctgaggtgaacgggtttcgtgataaatataaagatcagctgaatgtggtggccatccacatgccccgttccgaagacgatcttgatcttgagaaaatcaagaaaacagcagctgaacacgatatctctcagccgatttacgtcgacagcgatcatacgctgactgacgcatttgaaaatgaatatgtgccggcttattacgtttttgataaaagcggacagctccgccattttcaagcgggagagagcgggatgaaaatgcttgaaaaacgcatcagccgggtactttcagaaacggagcaggcttctgagtaatcgggacaatctccgccggactattgtctcggttctgcaaaccctttgccgttaggtaacagggtttttttgtgactattggataaaaaattccaatatggcatgtatggcttaaaaaataagagaaacagccgtaaacacgctgtaccgcttgttttatccatatcattatcttttacatattatagtcgaaaattgtagatatcacgctaattttcattaaacaagtaatttcaagttatattttgaaatggttcaataaattggaactttgtccagaatcccctatatgacaagggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacgggcagcctgtccgatacaaaaaaagagtttcgtccggagaaaaaaagtgattctctcccggtgcttgcagagcttgcagcacaggaaatgagaagctatcaaaagccgcagacacagccgcaatcctcccagccgcagatgcagtctattacgtctcttcccgccggcattccagacggttctacaagaagaagaagagggacggcgagaccgggatcaaaagcggcaaaactgcgcgaagcagcgattaaaacattgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccataccgcggccaatatattcttgagggagaaatttctcaggaaacagcagaaacggcaaatgatacggctgctgaataaaacagtaaaaactgcttgcgttactcaagcagtttttttgcgttttcccgtttattctgcggaagtgacgcatcttttccaggctttttttcaagcttgacaacatatttttggaaaggcttttcgccgtcagctcgttctttcaacgcatccagtttttcatcaaacgactgatcgcgggactctgattctacaaattgtttttgaagggagatgacttgttcggtaacggctgtaagcaagtcttctgcctgaacagtctctttggaaacggaagggatttccagagtttgttccgccggttccgccgtgcggctgtcaatatcagcaaaatggccggcaatccaagcatcactttcgtcaagctgccgtttatatgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcggtttgaatggcggtctcaagtgagcggatgcgggtatgtaagtttttattttcttcttcaaattttacatttgtaagatgcagacgatgtttttcttccatctcatttttccgccgaaacgtttcctgctgaagcagttcttgcagaatgacgattttatcgagcagcccggccctgatttcatgcaaagaacgttccgtgtcacttgtctgtttgtgtttttgagccatggctttcaattcgtcagaaagcttgtgaagccgctctttaatattggcgttttcctcctgaagcttattgtttttttgatggaagtagcttgcttcaaattccgaaattatttttctgcatctggaaagttcggatttcaagtaaaggttctcttgagaagtgtcgtggaaaaacggacctgatattttcataagaaccatctccctcatgatgttaacactacaatatgggaaaggaacaacggctattcctcttaattaaacagacaagcaacgtaatattgtatttcgactgaggcgtttgctatgcttttatatagaatgggagagcgatgacatgaaacgggtgaatgtaatattagcggggggagcttcccgaagattcggagaaccgaaagcttttgcaaagtggaagggcggcatgttttatgaacaggcgaaaaaagccttcggcggcggagaaacggtaattatcagccgccctgagcatataaaaaagttcttatcaaacagggagcggcatgtttttgccgatgagccgcggtttcggggaatgggcccgcttgccggcatatatacggcaatgaaacaaacggaaggcgaaacatatacggtcatatcctgtgacacgccgctcgtgacaagaaaaacgatggctgcgcttgaaatgaagctgacgggaaatctggacgctgtcataccggtttgtgaaaacagagagcagcccctcttggcggtttaccataaacgggtgcaggatgtgctttttgatcagctgacacaaaacaaactgaaaatgacagacacgctgaaacggctgtctgtctgttatgtgcaggctgaagacatcggcgccgggccggaggagttcgctaatatcaacacacgggacgattacaccagacttttggcgcatgtcgagtcttcaaatcaggactgatcggtaagaaacatggtatgatggaaataaaaatgcaaggggacaacacagatggaagagcgctattcacggcagacaagatttaagccgataggggaaaaagggcagcaggcgctggctgacagcagtgtcctgattgtcggagccggagccctcggaacagccgcggcagagggccttgcaagagccggagcgggccgtatggcgattattgaccgggattatgtggaatggagcaatttacaaagacagcagctgtatacagaagaagacgcgagacagcgcctgccgaaagcaatggcggccaaggcgcgtcttttagcggtaaacagtaatatacatatcgatgcttacgcggcggaaggtacggcggaaacgctcgaaccgctgatcgaacaagcggattgcattgtggatgcgacagataattttgaaacgagaatggtcatcaatgatctggcgctgaaaacgaaaacaccttggatttacggtgcctgtgtcagcagtcagggaatgtgcatgacgattattccgggggttacgccgtgtttatcctgcctgtttgagcaaatgcccgtgggcggagcgacatgtgatacagcaggcatcatacctccggcggttcatatcgtctccgcttatcagcaggctgaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggagcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgattttttgctgcacatggcgtacgagcgcttcagaatcgttatttttcaggacggacgggctctgattcacggtacaaacgatataaaagaagcgaattcagttctggccagagtgatcggactgtaggaaggggatgtattgctatgcttgaaaaaagaacgccgattcaggtggacgaagcagtccgccgggtgagccggtataaaaaaaagggggataccgaatgggtggcgcttgaggacagtctccaccgctatttggcggaggatgttaaggcggatcatgatgtgccggcctttaaccgttctccgtatgacgggtttgccatcagggcaagcgattcaaaaacggcttcccgtgacaatgccgtcacctttgaagtcattgaccatatcggagccggcgccgtgtcagaaaaagaactcgggccttatgaagcggtccgcattatgacgggggcgcagattcccaaaggcgcggatgccgtagtgatgcttgagctgacaaaaacgttttctgaaaacggcacggattacatgtcagtgaaacgcccttttcatgcgggggataatatttcatatcaaggagaagatgcgaaaaaaggcagctcgctattaaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgaaccggggaaaatccgcaacagcaacgctgccatggtgtatgcccaggtcattgaagcgggtgcggtaccgctgaacttagggaaaatttccgatgattttgatgacagctatgctgcggtgaaggaagctatgaaaaaagttgattttctgatcacgaccggcggcgtgtcagtcggcgattttgattttcttccggacatttataataagctcggagcggaagttctttttaacaaagtggcaatgcgcccggggagcgtgacaactgtcgcccgggccgatgacatgctgctgttcggcctttcaggcaacccgtccgcatgttatgtcggattcaccttgtttgtcaaaccgatgattcagacatggcttctgaatgaaaaacctcattccggatgggcggaagccgtgttaacaaacgactttccgaagccgaatccgtttacgagatttgtgagggcatttgtttatcataaggacggaaaaatgatggcgtcaccggtcggtctcgacaaatcaagctcagtcatatctcttgccgaagcaaacgcgtttatccttctgccgggaggaacgagggggtatgaagcgggccggacggttcacgcgctcctcatccgtgatgagaatggaagtgaatggccgtggtcaattctttcccgatcgtccagatcgtaggttttcaaaacagcggtaaaacaacgtttattgaacgtgtgctgaaagcggcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagagggatttaaacatgcgccgcatccgaaaatcattatgatcaaaaacagcgaagattggcaaaagctgaagcatttggagcgcgtgatcgcggttgtcagcagaaatacggagcatatgccggcagatgcaggcaagcccgtattccattcggacgatcctgctgccattatgtttgtgctttcgcagctgaaaggggaaactgcttaaatggaacgttttcaaattacaagggaacctatcattgcggaaaatatcgtaaaaaaagttgaaaagcgtgaagccggggccatcacaacgtttatcggcacggtcagagagtggactgcaggacggcggacggtgcgtctcgaatatgaagcgtatgaaccgatggctgttcaaatgctttctcaaatcggcagtgaaatcagcgcgaaatgggaaggagccgaagctgcaatcactcaccgtgtcggcgtccttgatatcggtgaagcagcggtcgtaatcgctgtgtcttctccgcacagaaaggcggcatatgaggcgaatgaatatgcaattgaacggataaaacagattgtgccgatatggaaaaaagaaatctgggaagacggggaagaatggataggcgatcagctggaaacaacgccctatccgaacggaaaaccggatttggataaaggggaatcgcgatgattaaagtattattatttgccgggcttgcggagcaggcgggaacatcggtcattgaacttgacgaaaaagagacggcggcgtctgctgtaaaaacgctgttaaaggaacgatacggccttcagacgattgacaatgccatgatcgcaatcaatgaaacatatgtaaaagacaacagcatcgtaacagaaggtgataccattgcctttatccctcctgtaagcggagggtgaaaaaagagccgggtgtgcatcattgccatccggctctttttgtatataggcgctgaatttcagagaatatttaaatgggatttaaagggttttgcaattgaggcggttttcactgcatgaataggctgataacagtgcctttacaaggttttgagccacccgtcataccggtctgacgatgcttttttttacataattatggaacgtaaagctgagaatttgtgttacaatttagcataaatacgcaaacggcaaaaaaattgaaacttctctcagcctaaagcgtacgtataaacagaataatacataggaggcatcagcaatatggaaccaaacctggaaaaaagcaatgcggcagtcacggaaaagccgtcaattttcggcgtcattacaagtcctgttgtgcagtttaaaagattaaaagaaaagccggtcatcggcattcctctcctgattgtcatcattctcatcgcggccggcagtattttgcgcggactggggatgaattatgaagaagtgctgaacagctcatctcttgacggtttgacggatgatcagattgaaatgaccaaaaccttcgctaaattcggcacgatgttcggaggaatcttcgggggcattatcgctctgtttatcgttccgctcatttactggctgtgcgtaaaaatttcaggcggcgtgacaacttacaaaaaaatgctttcactcagcctgtttacggcgtttattaccaatatcggcttagttattaacggtcttgtcacttattttaccggtgcgggctcattgtacgccgttacatctttggcgagtgtcataccggccggagacggcgtcgcggtctttttaagcgcgttcgacattttcagcatctggagctatattctgctggctttgggacttcgctatacaggcggcatttcgaaaaaagcggcctggacttccgcggttgtcctgtttgttattatgcttttggtttcggcagtcggaggactgttaagttcagtgacagcaggtgtataacatgaaaaaaatttggatcggaatcggcatcgccgtaattgttgcagtatttatcggtatcaatatttataagtctgccgctcccgcgggcggcagcgccggaaaaaaaatcgaaaccggaaccatggaaaacagagaaatctcatctacggttatggttccgggaacacttaaattctctaaagaacagtatgttttttatgaagcagataaaggaactcttgataaagtgaaagtaaaagaaggcgacaaagtaaaaaaagggtcgtcgttagtcacgtatacaaatgagcagctcaaccttgataaagaacaaaatgagttgacggaacaatcaaaacggatgcaaatcgaacaagttgaagaaaaactcagagcattaaacagcaaggaacaagatctggcaaaacaagtgggagaagcggaagccaaaaaacaaattgaatccgaacggactgatctgcagcttcagcaaaaaacggcggaaatcgaattaaagcaatctgatttgcaaaagcagtctcttgaaaatcaagtgtcgaatctcaatgttaagagtgagatggacgggacggttatctcggtaaatcaagaagcggcttctaaaaaatcggatattcaagaaccggttatacatataggagacccggaacacctggtcgttgccggcaatttgtccgaatacgacacgctgaaagtgaaaaagggccaaagcgttacaatcacctcagacgccatccccggtaaaacgtggaaagggagagtggcggctgtcggcctcgttccggatcaaaagtcaagcgctgcttcgggggaaagcacggaacaagccgtccagtatccgtttcaggttaagctgatcggaaaccttccggaaggcaagccgggatttaaattaattatgaacattgaaaccgacaaacggaaagccgacacgctgccgtcctccgcagtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacggtttgactgacggaacggatgtgaaagcatagatgattcagctttcaaaggtgaaaaaaagctatcagatcggcaaggagacgtttgatgttctccgttcaatcgacctgacgattgaagaaggagaatatgtgtcaattatgggaccctcgggatcgggaaaatctacgatcatgaatatcatcggctgtctggacagaccgacgtccggcaattacagtcttgcgggcgaagatgtttcttcatgcaccgaaaaagagcttgcggcggtccggaacaaatcaatcggttttgtctttcagcagtttcagctgctgccgcgattgaatgcaagaaaaaatgtcgaactccccatgatctacgccggtatcggcaaaaaagagcgtgaggaacgggctgagcacgcgctggaaaaagtcggtttggcggatcggatgcgtcacatgccgaatgagctgtccggcggccagaagcagcgtgtcgcgattgcaagagccatcgtgaacgaaccgaagctcattttagctgatgaaccgaccggcgcgctggatacgaaaacaagcatttccattatggagcagttcacagagcttaatgcagagggcgtgaccgtggtgcttgtcactcatgagcctgaagtggcggactgtacaaacagagtgattttcgtccgtgacggcatgatcgtttcccgcgattctgagcagaggagagtgggggaatgagcctgtcagaaaatctccggatggccctcagttccgtaagagctcacaagctgagatcgattctgacaatgctcggaatcattatcggcgtcggttcagtaatcgttgttgtggctgtcggccagggcggagagcaaatgctgaagcaatccatcagcgggccgggcaatacgattgaattgttttacatgcccagtgatgaagaattaacagccaatccgaacgccttacagcaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacttggacgtaaaaaagctggacgttcaagatggacggacgtttacggacaatgattttctttccgggaaaagagcgggaatcatctcgaaaaaaatggctgaaaagctgttcgggaaaacgtctccgctcgggaaaatcgtctgggccggcggacagcccgtagaagtaatcggcgtactgaaagaagagagcggctttttatcgttaggactcagtgaaatgtatgtgccgttcaacatgctgaaaacgtctttcggtactaacgactacagcaacgtttccgttcagacggagtccgctgatcaaatcaaaacaacaggaaaagaagcggcccgtctcttaaatgacaatcacggtacaaaagaggcctatcaagtcatgaatatggaagaaatcgcggcgggaatcggtcaggtcacgaccgttatgacgacgatcatcggttcgatcgccggtatttctctcgttgtcggcgggatcggggtcatgaatattatgctcgtatcagtgacggaacggacaagagaaatcggcatccgcaaatcgctcggtgccacgagaggacagattctgacacaattcttaattgaatctgttgtgcttactttaatcggcggcttaatcggaatcggtctcggctacgggggagcaacactcgtttcccttatcgcaggctggccgtcgctcgtttcctggcaggtggtttgtatcggcgtgctgttcagtatgctgattggcgtcatcttcggcatgctgcccgccaacaaagcatcacgcttagatccgattgaagcgttacggtatgaataaccggcgccccatgcagtctgcatggggttttttgtgttttaatgattgaatgaatataatagacttttttcatttatgataaaaagaaaatgtcatacaattgtccccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgcttactcctgaaaggtatcagctgattatggatcagattgaaaagcgagatgtggtgaagattcaagagctgataagcatgacaaacgcttctgaatcaacgatcagaagagatttatcaacacttgaagagcgcggatttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgacgctttaataaggaaggggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgtttgccgccttgggcgatgcagctatcattaccactgaagctgaagaacttgcattcgatgattaccaagaaaaaactgtcgtaaaggtagtgaaaccatgatttacactgtaactctcaatccgtctgttgactatatcgttcacgttgaagattttgccgtaggcggtttaaaccgttccagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtggatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcatcccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgttcaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattcggtaggcgcaggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggtattgccattcctcacgcgaagacggcgagcgtcattaacccggccatcgcattcggccgttcaaaagatggtgtggattatgaatcattagacggtcagccggcacacttggtctttatgattgcggcaaccgaaggagcgaacaatacgcatcttgaggcattatcaagactttcaacgcttcttatgcgtgaggaaatccgcaaacagcttcttgaagctgaatcagaagatgcgatcattgacatcatcaatcagcatgacaaagatgacgatgaggaagaagaagagcaggaagaacaggcagcgccgtcaggaaaagggaaaatccttgcggttacggcatgcccgacaggtatcgctcatacgttcatggcagctgacgcattgaaagaaaaagcgaaagagctcggtgttgacattaaagtcgagacaaacggctcaagcggtattaaacataagctgacggctcaagaaattgaagacgcgcctgcgattatcgtggcggctgataaacaggttgaaatggagcgctttaaaggcaaacatgttcttcaagtgcctgtgacggccggtatcaggcgtccacaggaactgattgaaaaagccgttaaccaagatgcgccgatttacgagggcagcggcggaggatcttccgcttcaaatgaagacggcccgaaacagaaatcaggcacaagcatcgggagtactttctataaacacttaatgagcggtgtcagcaacatgctgccatttgtcgtcggcggcggaattctcgttgcgatttcattcttctggggaattcattcagctgatccgaaagacccgacatacaacacgtttgctgcagcgctgaactttatcggtgacggtaatgcgttaaagctgattgttgcagtacttgccggattcatcgcaatgagtattgcggatcgtccggggtttgcgccgggtatggtcggcggatttatggctacgcaggcgaatgccggattcttgggcggactgattgcgggattcttagccggttatgtcgtagtccttttgaaaaagctgtttgtctttattcctcagactcttgacggattaaaacctgtattgatttatccgctgctcggtatttttatcaccggtgtcctgatgcagtttgtcattaacacacctgtagcagcgtttatgaatttcttaacaaattggcttgaaagccttggaactggaaaccttgtcttaatgggtattattttaggcggtatgatggctatcgacatgggcggcccgctcaataaagcggccttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcggactgacagagtttttccgggtaacgcttcctgcaccgcacggaggaatattcgttgcattcattacgaaccatccgctgctttacttaatgagcatcgtgatcggagcgattgtaacggcggttatcttgggaatcgtcaaaaaaccggtagtagagaaataagcgaaaagcgtcctttacgggcgcttttttcaatcatatacgcatagaagcgttatgtattttgtgatgagttgtgataaagtaaagatggtacatgaaccgaaacagtgatcgtctaggaggaaccacgttgactgaagaacaaaaacctacttctgaaaaatcggtaaaaagaaaatccaacacgtattgggaatggggaaaggccatcattatagcggttgcacttgcgctgttaatccgccatttcctgtttgaaccgtacttagtggaaggatcatcaatgtacccgacattacatgacggtgaaagactgtttgtcaacaaaagcgtcaattatatcggagatatcgagcggggggacatcgtcattattaacggcgatacatcgaaagtccattatgtaaagcggctcatcggaaaaccgggagaaacggtggaaatgaaaaatgacacgctttacataaacggcaaaaaaatcgcagaaccgtacctcgcgagcaataaaaaagaagcgaaaaaactgggagtcaacctgacgggagatttcggccccgtaaaggttccgaaaggcaaatacttcgtcatgggcgacaatcggctgaactcaatggacagccggaacggcctcggcttaattgccgaaaaccggatcgtcggcacctcgaagtttgtgttcttcccgtttcatgatatgcgtcagacaaaataaaaacgccgcgctgcccgattcggacagcaggcgttttttatttggcaaacgaggccgcgacggcgatgaacaataccgtggccagcactgatccgacaatggccagaacgctgaaaaaaagattcacctgcttcttctctttgccgcgtctttcaagcatccgtttggaaaagagatgcgaaaacgtataaatgagggcgattccgacgtacaagccgatgtcacgtgccgtaaagcctgtgacggccagaaaaaccccggtgaagaaaatcataagacagtattctgtgagtgttaaaagcttcaacttgttcctccgtgatgaatatgtatatatatctattgtatcacagcgtccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgtcaatattaaatttacgccgggcaactgctacggattaataggcgcaaacggtgccggaaaatcaacatttttgaaaattttatccggtgagctggagcctcagaccggcgatgtccatatgagtccgggcgaacgtcttgccattctgaagcagaaccactttgaatatgaagactgcgaagtgctgaaagtcgtcattatgggacataaacgtttatacgaagtcatgcaggaaaaagacgcgatttatatgaagcctgatttttcagatgaagacggcatccgcgccgctgaacttgaaggagagtttgcggaattaaacggatgggaagctgaaagtgaagccgctattttgttaaaggggctgggcatctctgaagacctgcatacgaagaaaatggccgacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagtcatcgtcgtatcccatgaccgtcactttttaaataaagtgtgcacgcacatcgccgatcttgattttaataaaattcaagtgtacgtcggcaactatgatttctggtatgaatcaagccagcttgctttaaagctttctcaggaagccaacaagaaaaaagaagagcagattaaacagcttcaggagttcgtggccagattcagcgccaacgcctctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggtttaacaaaaacgattgacggggttaaggtgcttgataacgtcagttttattatgaacagagaagataaaatcgcatttacgggccgcaacgaacttgccgttacgacattgtttaaaatcatttccggggaaatggaagcagacagcggcacatttaaatggggcgtgaccacttctcaggcgtacttccctaaagacaacagcgaatattttgacggcagcgatgcgaaccttgtcgactggctccgccaatactcgccgcatgaccaaagcgaaagctttctgcgcggtttcttaggacgcatgctgttctcaggagaagaagtcaacaaaaaatcaaacgtcctttccggaggagaaaaagtacgctgcatgctttcaaaagcgatgctttccggcgcgaatatcttaattctggatgaaccgacaaaccacttagatttggaatccattacggcgcttaacaacggcttaatcagctttaaaggcgctatgctgttttcatctcatgaccatcagtttgtacagacaattgccaaccgcatcattgaattaacgcctaaaggcattgttgacaaacaaatgtcttatgacgaatttcttgaaaacgcggatgtgcagaaaaagcttgaagagctatacgcgtaataaagaagcaggggagactctgcttttttatttatgaaaaaagttttcaatcttctgacttcccattacaataaaggaatacataaattgaaaagagacggaggaatgcatcatgaagtttttagttgtcggagctgggggagtgggcggatatatcggtgcgcgtcttgcagaaaagggaaatgacgttacatttctcgtccgcaagaaacgggcggaacaattacaagaaacgggtttgaccgtcaaaagtgcaaaaggtgatgtttcaatcaagccgaaattaatgttggcgggcgaagaaggagcatttgacgccgttatcatcgcttcaaaagcgtattctttgcaggacgtcattcgggatgccaaactgtttgtcaaaccttcgtcggtcattattccttttttaaacggatacaggcactataaccagctgtttgaagctttttcaaaacggcaggtgctgggcggcctctgctttattgagagcgcccttaacgacaaaggggacattcttcatacgagcgctgcccaccgctttgttttcggtgaatggaacggggagcgcacagaacgtatgaatgagctggaaaacgcatttgcaggcgtgaaagcggatgtcatcatcagcggggatattgaaaaggacatttggaaaaaatatatgtttattgccgcgcaggcgggagtgaccactctgtttcaacagccggtcggaccgattttagaaacagaaggcggccgcagcacggcaaagcgcctctttgctgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggctttttgcttgagaaagcgaaaggcttgtcaattgatacacctgttttggaaaccgtctgcgccaacttgcaaatgtatgaagcgaaataaaaaggaggcctgatcgcctcctttttttattaaaatgcccagtttccgtttctgaagatcggttctcttttgccgtccgcggtaatgccgtcgatattcatttctttggaaccgaccataaaatctacgtgtgtaatgctttcatttaagccctctttgacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtacggcactaaggccacttcaccgagatagtgtgagccttcatcggtttcgacgatgccttttaaaatctcctcgcctttttcagctttcacatcgacaatgcggccgttttcaaaggtaagagtgaagttatcaataatgttgccgccgtagctcagcggtttcgtgctggaaaccgtgccgttcaccccgtcacgctgcggaagggtgaaaacctcttctgtcggcatgttggccatgaattcgtgcccgctttcattcacgcttcccgcgcctgcccatacatgttttttcggcagttcaatggttaagtctgttccttcagcctgataatgcagggcgctgtaatgttttttgttcaggtgttccactttttcatgaagattttgatcgtgttttttccatgcttccacagggttttcttcatttacgcgggttgttttgaaaatttcttcccataaaagctcaacggctgtttcttccggctgatccgggaacacttttttcgcccagcctgttgaagccgctccgatcaccgtccagctgaccttatctgattgaatatattgtctgtatgtatgcaatgcttttccggcggctttttggaacgctgcaatccgtttgccgtcagcgccttttaacaggtcggggtcggatgagacgacagaaataaacgcagccccttttttcgcgagctcttctttgccttttgcttcccattcaggatactcttcaaacgcttcaaaaggtgccatctcgtattttaatctggacagttcatcgtcctgccaatttacggtgacgttttttgcgcctttttcataagaatgtttggcaagcagtctgacaagttcccggacatcagttgaggcattgattacgacatgctgtcctttttggacattgacgccgacttctaccgccagctgagcatatgtatttaacttttcagtaaacgaactcatcgttcattcctcctcatcggtttttctcatcatatcaaatatcgcctcataaaggaaaggaaggagcacaaacgaaaaagacacagcttttgctgcgtctttacgggtgattcagttttacggcgccgccggccggggaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgcccagtgccgatagccactgattcaagcggatttgccgccaaatgaacgggaacgacgatttcatctgtcagccattctttcatcccgtttaaaagggagcctccgccggttaacacgacgccgcggtcaacgatatcaccgctgagctccggcggacaatcttcaagcgtcgctctgatcgcttcaagaatatgcaggagcgactcacgcatcgcgtgctgaatttcattagactgcagtctgattgtcttcggcagaccggttacgaggtcacgcccgcggatttccatcgtttccggcacatgttcgatcaatgcaaatccgatttccattttcacttgttctgccgtgcgttccccgatcagcaggttgtatttttttctgacgaacgaggcgatatcttcatcaagctggtcgccgccgattctgatcgagtggcaggatacgacgccaccgaatgagatgatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggctgttgagcctgaaggcgtgcagacgacgacattcggtttgcggaaggtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggctcatttaaaataattcctttatttttactgtaaacaagtatattagcggttcctaagtcgattccgatctcagttgattgaaacatgttttcacccaatccctatcctgatttaattgattctacatttaaagtttctgagaaaaaccacgatttttgggggtttccgccgggaatgaaatgtttttgtaaaaaaggagggaaagtctgtatcccgtatttcaaaaggctttcttttgtaaaaaacattcatttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgcgaagagcattggatatcgctattaaagatagtattgaatttttcgttgacggagacaaaattgtcttaaaaaaatacaagccgcacggcatttgcttgatgaccggggaaattacctccgaaaatcaggagtacggcaacggcaaaattattttaagtcctgaaggagcgaaaatgctgcttgaggaaatcgaagaagcgttaaaagatagatcataatcagcaaaaagggcggggcatcattccgtccttttattatgaacttgtgcaaaaactcacgggaaaagtaagcgaacctgctcaattaattgggaatagttatcattttttagtcaataatgcagtcaacaatgttacaatatatgtagaaatgttagcggcaggtgggactatgggaaaatatcaagcgcgtatcatttccttaatcttggcaatgatttttattatgttttgggattatttattttatatgattgaacggaatccgattaactggcccgttgacatcacctttaccgccgtcacattaatcagcgtctggctgctggcttattatgtggacaataaaaagcagctgctggcggagctgaaggacagcgagcagaaagcaaaggcgctttcagatgagaaaaaccggatcatggacaatctgcaggaaatcgtttttcagacggattcacaagggaatattacatatttgaatcaggcctggacgacgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggcacgatcttttggggagaagtccattataagctgtattatgaccgcagacagaaatttgtcggaagcctggggacgatgtctgatatcagtgaacggaaaaaagcggtcgacgagcttctggaaacgaacgaacgccttgccatgcaatctcaaaagctggccattgccggggagcttgcggcaggaatcgcccatgaagtaagaaatcctttaacgtcagtcagcggctttctccagctgatgaaagcccagtatccggaaagaacggattatttcgatattattttttcggagattaaaaggattgatctcgtgctgggggagctgcttctgctcgccaagccgcagaccgtgatgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacagaacgggatgaagaatacgcggtgatcagcatacaggatgaaggaaacggcatgtcgaaagaaaagcttgaaaatatcgggaaaccgtttttctcaacaaaagatcagggaacgggtctcgggcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgctgaaaggcgctccgtgtgtgtgcgagcaggccgcgataaacggtgtgctgtacgaaacggataaaggtcagcctgcggcgtctttagcagaaacagcttttgtgtacggggaattgtatgaaacagatcatcagatgatccgtaagctggatatgtattatgctgattttgaccggaaagaggttgccgtgacgacggatgccgggaataaaaccgccttcgcatatgtcgtaaagcacggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttctttgccgagccggtcggaggggcggttgttgaagggtattcgacgagattcacgttaaggcgtcctgacggttccagagccgatcttgttgaagacgggggacgaactgaaggcgtgctgtacaagctcccgtttgaagcggcaacctatctgtacaaaagagaaggtgttgataatcacacataccgtcccgcgttcatagaagtgtgtgccggcggccgtgtatacagaggcgtcctgacgtttctggttcttgataaagctgaggaaattgcgcctccgggtcactatcaggaagaaatcgaacgcggagcggacctgtatttatcacccgccttttcagaaaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtaaatgaatacgccaaaatcgcatcacacgcggtcatcggcgattcaaccgatgaatcggtgctgaaaaacttggggctgcgcaactttgaccacgtcattgtggcaatcggcgaaaacatacaggcgagcattttaacgacactgatcttaaaggaactcggcgtgaacacgatcacggttaaagcgcagaacgattatcatgagaaagtgcttgcgaaaatcggggccgatcacatcgtccaccctgaacgtgacatggcaaaacgcatcgcccacaacatcgtatcaaataatgtgcttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgatccaaaaagaagatattctcatcgttatcggctctcttacggacatttcccgatttgaaaaaagagtgcttcatacaaagtgaaaagccgtccgtaaaaggacggtcttttattatgtcagaatagaaagacatttatcatgtaagcggtatattctgcaatttttattgactatgatcagtcgatccgatagcatattgtaccatataaagaaaaagaggaggccgcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagtcattgatgcagaaggccaaatgatcgttccgggctttattgacggacatgttcatatcgagtcctctatggttactccgattgaatttgctaaagccgtcctcccgcacggagtgactactgtcattactgatcctcacgaaattgcgaatgtttccggagcaaaaggcatttcatttatgatagagcaggcgaaaaaggcgccgctgaacatccgtttcatgcttccttcctgtgttcccgccgctagctttgaacgctcaggagctgtattaaaagccgaggatttaaagcctttttatcaggagaaagaggtgctcgggcttgcggaagtaatggattatgtgtctgttgcggaaggtgaagaggatatgcttcagaaactgcttgatgccaagcgtcacggaaagcggatcgacgggcatttagccggactgtcttcagatatcatcaatatatacagaaccgcaatggtgtcaaatgatcatgaagtgacgacaaaagaagaagcgctggacagaatcagacggggaatgtacgtcatgctgcgcgaaggatcggtggcaaaaaatacgctcaatgtgctgccggcggtgaataaaaaaaacgcgcgccgctttttcttttgtacggatgataagcatgtagatgatctgcttacagaaggaagtgtgaaccaccaagtcaaaatggcgataaaggcgggacttgatccattccttgcgtatcagctcgccagcttaaatgcggctgagtgctacggccttgaaacaaaaggggcggtagcgccgggttttgacgcagatctgctgttcatttcagatgtacgggaggctgccgtcacgaagaccatggtcgccggccggaccgttgccgagaacggacggacggtttatgaacagtctgccggttcctattcgccggaccaggcactgttggatacagtgcggctgaaagcgccgctgactgaatcggattttcatataccgattcaagagggcaggaaaatgaatgtaatcgaaatgataccgaatcatttggagacgagaaaaaaagaagtgcctgcaccgtctgctgacgcgtttcgacctgatacagataatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaagctccgtgacaccgggggcggattaacagccgtgaaaaacggagaattgcttcactccgttccgcttccgatcgccgggcttttgtctgataagtcggcggaatgggttaatgacagcttgggcgtgcttcatgaaaagcttcctctgctcggattcaccggtgatttcaatccgtttctcaccttatcgtttttagcccttccggtgattccggatatcaaaatgacggcggccggtctgtttgatgtcaaagcctttcagcatattccgctgcaataaaaaaactgcactcgtaatgagtgcagttttttttagacctccataatgatcggaaggatcatcgggcggcgttttgttttttcgtataggaacggagcaagcgtatcggtaatttcatttttaatttcggaccactgcgttgttttccgatccattactttctccagatggttcgaaatgagctgctgcgcgtcattgatcaaatcaccggattctctcatatatacaaaacctcttgagattaaatcaggtcccgccgaaaccttaaagtcgtccatattgatgctgacaacaacgataacaaggccttcttctgaaagaatgcggcggtcgcggagcacgatattgccgatatcaccgattccgcttccgtcaatgtaaacggagcctgacggaattttgcctgccacagcggcttcttcgcctttgagggccagcacttcgccattatccatgataaagcagttttcttcaggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggtatcggagaggaagaaaagacgaccgtatctccgggattaatggaaatctgccggtgcgtcccgttagcgatgcgtgataacgccgccatcggttcaccttggctccccgtacataaaatcgttaccttattggcaggcatacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggcacctcactgtttgtactgtcagaaagcaggcacaaaacgccttctttcccaatttcagccatctttgtcaagtttgccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcatgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgcttattctattatattcgaaaacggattataaggaaagtctcgagcaaaaaagggactttcaaaaaccgaaagatcccttctatgcgatgacttttttccggagcattccgccccactgtcttctgagtttcttccgtaatcggcgcagcatcgtatacctcctttaaagccctttatagcagtagtatgcggaaaaaatgaatttgttttcgtgggtaaaactggaatttcatcaaggcggttttccggaagaaaaactttctgtatgatgatattgaaaaagacacgactgataaacgggaaaaaggagaaattgacatgaaaccaaaactgatcttttttgatattgacggcacgatctatgaccatgataaacatattcccgatagcgcaagaaacgccgtgacggcgcttaaagaggctggacatcacgtttttatcgccagcggaaggtccccgtttatggtaaaaccgattctggaagagcttgagattgaatcatttatttcatacaacggccagtatgtcgtatttgaaggtgaggtcatttataaaaatccgcttcctgaagatgcggttgcgcgtttattaaagcaggcggcagaaggggagcaccccgtcgtatttatggcggaagacacgatgaaaacgaccgtccccggacatccgcacgtctcggaaggtatcggcagtctgaaagcgccttatcccgaagttgatgaaacattttataaaggaaaagaaatttatcagctgcttttattctgccgcggacatgaagaaaaagcatatgccgcttttccggagtttgattacgtccgctggcatgaattgtcaacggatgtgcttccgaaaggcggttcaaaagcggaaggcattaaaagagtgcttgagcggcttccgtacggcgtaagtgacacttatgcattcggcgacggactaaatgaccttgagatgatccgttttgccggcaccggggtggcgatgggaaatgcggttccggaattaaaagctgccgccgatttcgtcacaaagccggtggatgaagagggaatcagctgggccgtcaaagaactgggccttttgaaataaagaaaaccggcactttgggaagtgccggtttttttaacggtcaatggcaatggcgttttcaggttctttgaacggattttctttatcgatatggtcgtaaaacatcacgccgttcagatgatcgatttcgtgctgaaacacgatggccggaaaacctttgaggcggatgtcaatctgttctccttcaagcgtcaccgcctttacgcggatgcgggcgtagcgcggcacatagccgggaatgggttcgtctaccgacaggcagccttctccgctcgtcaagtagcttttttccactgagtggctgacgattttagggttaaaaagagcatagctgtataaagtgcctttcgcatcttctgcatggacggcgatcatccgtttttttacgtctgtttgcggagcggcaagaccgacgcccggacgaagcttgtatttctcggctaattcaggattttggctgtttttcacaaactcaatcatatcagcaagatgctgtttttcttcgtcggaagcgggaagctgaacctcttcagcgatctctctgagcgcgggatgtccgtcgcgtacaatattttccatagtaatcaagaaacttcactcctaaagcttaatatgtaaattatagcgaatttctttatcgcggcgcaacgaaacaattggccggccatagcaggccggccgattttcatggtgtataaggtcagcagccgcagcctaaataagcggcaccgacgatgattaataagataaacaatacgacgattaatgcgaatgtgcggccgtatccgccgccgcagccataaccgtaaccgccataaccgtatccgccgcagcaaccgccgccaaatccgccgccaaatccatatccgtacataaaaaaacctcctcttttaattacgctgaccctttgtcagcagggccggcgtctactataaactatgtaaaagccaaaaagatgtatggtcatccgccctgttttctcaattttttacgcaagtattctttgacagcaccgtaagcatctttttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgcgggctgcgggggaaaagatccggttgaatcgcttcatgactcgatggaaaaagccgttcaagcggaaaaaccgtttcaaaaagagcagaaaacattggaaaaattggagaaaaaagagcacaagctttacgacagcgcggttaaactgaatatggatgattacaagaaaatcgtcacactgtctgatcaggctctgagcaatgcaaatcagcgaaaaaaacatctgaaagcagaaaaagacagtattgatgattcaaaaaaagcatttgaatccgcaaaaaaaacttctcaagaaataaaggataagaaagtaaaagaaaaagccgggcatgctgtcgctttaatggaaaaaaggtatgcatcttatgatcttttgtacaaaaagtacgaaaaagccatttcacttgatcaggacctttataaactgattaaagataaaaagctcacattatcgcagctggaagagcaaatcggcaaagtaaactcagtttacgaaaaagtgcataaacaagcagatgagttcaatcaatttactaaagactacaacaaagagaaagaactattattccgcgaatagtatagtgaaggcatatcggcatgggctgatgaactgataacaaccgagttcagccgcctgtaaatggcggctgaagaattggtatatacgtgtgtttcccattgacaacatgtaaatcatggtatagtatttatttagggaaatattcacataaaaccaatcgttgtttcggcacgttgggatgtttttattatattggtatataaaaaacagaatgaaaatgcggttttaattatcagaaaattctatctatttagatttgcggcaatatgatctttgtacatgctttttgcttttaaacctttatccggcataaaggtttttttattttgcttcgtaatgcttattaagtaatggtgccgggtgcttagagtaaatgacaattttaaaaattgaagtgaaaaatgttaaacaaatcacaatcggaacgaaaagaaacggcagaaatacggaacaaggaggaaaacaaatgcttgcttacgtctttcccggacagggagcgcagtttaaaggaatgggcagagacttattcgatgaattcagtgagctaattaaaaaggcagatcatattttaggatactccataaaggatttatgcctttcagatgaaaaagagaggctcactgatacgaagtatacacaacctgcaatttatacagtgagcgcactgcaatatttaaagggtttaaaagaaggtcatactcgcccagatgctgttgcaggacatagtctgggtgaatatactgcgctttttgcggccggcgtttttaattttgaaacaggtctccggctggttgctaaaagaggcgagttaatgagtgaggcttccgagggcggaatggctgccgtgatcgggctggatgagcatcacataaaaaaaatacttcaaaagtatgaattcggccaaatagatatcgccaattacaatacatcttcacaaattgtgatagcgggggctgcagaagagataaagcgtgcagcctctttttttgaaaaagaaggggcgaaagcttatatcgtattgcaagtcggcggagcttttcattctcgtttcatggaaagtgcacagcgtgaatttgcggaatttatcggggagtttcatttttctgaattgaatttcccagtcatctctaactatacggcaagaccttataaacaagaagatatcaaacggaatttaattgaacaaataacaaactcggtgaaatggactgaaagcatcaggtacttaatgggacaaggcgtcactgtgtttgaagagatcggtcccggaaacattctgactaaattaattcaaaccatacaaagagatgaggaaccgcttaatattagtgcgccaaaagacagtctcttgttttctgaagggaacaaggacaattccgaaagcgggaaagagaagggcctcttggccgaaaatatagaaagcgttgcggcttcacccgtgtcccgattgggtgatcaatctttcaaagaagattacggtttgacatacgcgtatttggcaggtgcgatgcatagagggatctcttccgctgaaatgctgatccgcctcgggaagaaagggatgctggggttctttggcacagcgggtttaactataagggaaattgaacaggcccttatttctattaaggagacactcaaaaatggccagccctacggaatgaatctgcgatttgaaccggatcatcaagatagagaaaaggaattgatagatttatatatcaagcatgacgtacgggtaatagaagcgtcttcgtatctttccgtcagcgcgccattaatttattacaaagcgcatcagttgaagatggacaaaagcggcagggtcatacctcataatcggatcattgccaaagtttcacggccggaagttgcggccgcatttctgagtccgcctcctcaaagtatcgtaaagagaatgtgtcagcacggtatgctgacggaagagcaggcggagtggctcagccgtgttccggcagcagacgatatcattattgaagcagattgcggcagtaataccgaacagggctcattgacggcgatgctgccgttttttgttaacctgcgggatgaaatgatggaaacacataaatacgcaaggaagatcagagtcggggccgcgggaggaatcggaactcccgagtctgcggcgtctgcttttttaatgggcgctgattttattatgacgggatccattaatcaatgtacagttgaagccgcaacaagcggttttgttaaagaaatgctgagtgagacagaaatatgcgatactgcttatgcgccttcggagactctgtttgagttcggaacaaaggttcaggtgctgaaaaagggcacgctgtttccggtcagggcaaataaattatttcaaatctaccaacaacatgagtctttgagtgagatagatgaagagacaaagattcagctcgaaaatgtttattttaataagacttttgatgaaatctacgaaagcataatagaaaaacagccgaacctggcccaaaaagcggagcgcaatcaaaaatataagatgctgttactatttaagtggtatttgcagagaggatgtctgcttgctttggaaggggaggaagaacaaaaggtgaatttccaagttcattgcggcccgtctttaggcgcttttaaccattgggtaaagggcacggagttggaatcatggagaaacagacatgtcgatgacattggtgaaaaaatgatgaatgagaccgaaagtctgctaagacgcagattggatacgttatttctacactaaaaaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtgggatcacgatctttattactcagctgatatcagtataccgaacaaaacaatcagcaagtggggaggttttattcataaagctgaccatttcgaccataagttttttaatatctctccccgggaagctaaaaacatggatcctgagcaaagaatccttttagaagaaacttggcggtgcatcgaagattccggggtctctttgcgggatctccagcgtaaaaccacttctgtttttgcgggtattatgaattctgactaccggcagacaggtcatgaatcggaaatcgacagttacgcctgtttaggaagtttcgaagctatgctctccaaccggctttcatacacattcggtttgaccggaaaaagcatgtctgtaaatgccgcttgtgcatcgtcgcttgttgctttacatgaagcggttaagtcattgcggacaaaagaaagcgattatgcaattgcatcgggagtaaacttgaatttccaacccggaaaatatatttctttttctaaagccagaatgctgagtcctgacggcaaatgtaaaacctttgacgcagcggcgaacgggtacgttcccggagaaggggcaggcgttgtattgctgcagcgccttggtgatgcagtaaaagccggtcaccatatatacgggatcataaaagggacggctgttaatcatggcggtaaatcccgttccataaccgctcccagagcagaagcgcagtgccgggtcatctcagaagctttacacaacgctgctgttgatgctgcgacggtttcttatgtagaagcacatggcacaggtacatctctgggcgatccgatagaaatagaagcattgacaaaagcgtatcggcaatatactgaggatactcaatattgcaggatcggaagtgtgaaaacaaatatcggtcatacagaagcagcggcgggaatggccggattgataaaagttctaatgatgatgaaacatcggagggtgccgaaaagcctgaatgtacatacggtaaatccaattatacagtttgaaaaaacaccgtttaggccggcgcttgattcaagtgattggaaggcggcagacgggggggcgctcagggcgggaatcagctccttcggttttggaggtgttaactctcacgtcatcatcgaagaatttatacatacaaatgacgaaactgacagaaagggaagggttcccttccttttttccgctaaaagtgaagaaagcatgaaacaaatgatacataattggagaaccttttctgacgattctgaggaattttgcaaaatatcaaatgaagcgatcagcagcacccttttaacaaggacatcgtttgattacagggcgggtttattggcaggcagcaaggaggaatttaaaaatcagcttaaagagggattaagttttcggaggaaacaagattctgaatgggcgcttgccatcggtgacttcaaatgggaaagttataaacaatttgccgttttgaaacgcgtgttccctgatctagaaaagaacgtaaggtcggtgctgaagggtataccaacattgcacagttcatttaaaagaaaatggacgcctgagaaaatccgcttgtattctttagttatcaatacggaaatcataaaaagtatcctggcatccggttttaagccaagtctcattacaggcgccggagacggatattacgtcgctcttgcagcagcggatatcatcaaaattgaaaaggccatttctgtcatcacaggcgctgaaaaaccttcgcacttatcctgtgagccgccgaccattccatttgtcaatccgtacactgcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaagggtttttagaagagtgggataaagcgggaaagactcaggaaatcgagattttatcttatattgtgaatcgcacggcggataaaagaaacgcattcccggctgatgaggaagcggcgatcatggctatccttgcctctatgagaagactgtataagagatgggatttaacagattatgatggattctttgataatgattatgttctggaaatattaaatttactggatgaaggaatcttgtctaaagaactttttctgagcatgttattgaaaaagcaagacggaattaaacaggctgttgcttgtatgaatgagcatccgtcaggtttttataataaggcccgttttccgctgatgacagaatacaatcagatggatgccgtgtttcaggagatagctgaccatatgccgcttcacacggaagaaaagggaagggagccggatgtgaatatctctgatttttcagtttttcaattcggatcgctccctccatcagcaaaactaaacaaagcggctgcttttgaagcggacaaaccagccgatgaggctctttatcattcatttatgcaaatgtggctttcaggagaagagattgaatgggcgaaactaggtgattatcataaaagaaaagccccgcttccgccttatccgtttgagcgctctcaattttctttaaaccctcagccggtaaaatcagacgcggctttttcagaaaagaagaatcaggcactttatacgccggtatggaaagaaaccgcacttgagaatgaagcgggcagcggacaagcctgtactattttgttgttctccgggaataaagactattttgaagagctgaaaaaaagagagaatacgtccgcatatcttattatgcccggtgaccgtttagagcagataagcgacagtgttttcaccatcaacaggcagtgtcccgaagattatcaaggtgtcattcgtctgttaaaggaaaaaggcgcagcgcccgatgcaattttgcatacttggtctgaaaaacagcctgaactggaagaaacactcgcatcaggaatttattctgtgttttatctgactaaggctttaatcagcgagaaccttataaacaaagtaacgttcatttatacattcagcgcagatcaaaaagaaaaattgccgtattttgaaggtgtgaacggttttttaaaatcggtaaaacaagagtacccgcagctgcattgtaagacggtttgctttgaacatgattctgcatccgtttcatgttcagagaaggctgacattctttataaagaaataaacacagcgcctgatcggcatattcatatcacttacagaggctgcgtaagatatgcacggatgttagagaagcagagagaaacaaacagaaagaccattcaataccctgaaaaagataaagtatatttaattacagggggatttggggggattggcagtaaaatcgctgaatattgcgcgaaaactgaaagatccactattatcctatcggggcgatctgttttaaacggagataagcagaaacatttagaatacctgaacagctttaaagccaaggtttattatatacaggcgaatatatccgataaagaagcggtaaaaaaaatgattgacggtattaccgatcagcatgcaggtcttcatggcgtcattcattgtgcaggagttatcagagactcgctgctttttcgaaaaacaaagcatgaactttcagaggtgattgctccgaaagttcatggcgcattgaatcttgatcatgcaacgaagtcgctcgaattagattttttcgccgttttttcttcagtcgtctctattgcaggcaacgaaggtcagtgtgattatgcatatgcaaacggctttttagatcattttgccgaatatcgggaacagaaacggcaaaattctctgcgcagcggccgcaccctgacaatcaattggcctttatggcaagacatcggaatgggggcgaacctgtcaggtcaagggcggacgtctctttttcatggttcagggctcgaagaacttcctgctgaagacggaacgcaatggttttcgcggattgtaacttcgggtcagctgcataatattgcagtctgcggtgatcatgaacgttttgaacaatttatgcagcagagatttttgacggacgaaacagagacaggcagtgccgttcctttggctcaaggcgatattttggatcagacagttttgtttttaaccaatatcatctcctgtgaggtcggtgcagaacgggaagagatcgatcaagatgtgcatctggctgaatatggaatggattcggttatgattcatcaatgcaacacaaagctggagcagtcactgggagcaatttcgaaaacgcttttatttgaatttcatacaatcagagatttagcagatcatcttgtaaaggaatacccggatcggctgggacgtttattttcacgggaggaaaaaggaaaacagattcagagcattacccccgccaggccggaacaaaacaccactgcacctgcggcggaggaaaaagaacatcttgacgggatagcggtaatcggtatcagcggccgttatcccggggctgaaaatatcgaagaattgtgggatcttctatcaaaagagagaacctcaatcacagaaattccgaaagaacgatggaattatgagacctactatgatccagatcccgctaaagcgcatgaggggaaaatttattgcaaatggggcggatttttaaagaatgctgaatcatttgattctttgtttttccaaatatcgccgagagaagcagaagcgatggatcctcaggaacgaatatttctcgaaaccgtatggaaagcatttgaagattcgggatataccattgaagggttgagaaagcagaccgaaaaacatgtcggtgtatttgcgggagttacaaccaattcttacaagctgctcggcgaaagaataccgacggacaaaaacgatgtacttccaaattcgttcccgtggtctctcgcgaacagagtgtcttacacatttgattttacgggtcccagtatccctgtagatacggcttgctcttcatccttaacggcaattcacatggcttgccaaagtttaaaaaaaggtgagtgctcggttgcggttgcgggaggagtaaatttgtatcttcatccttctgactatttataccggtgtcagatgggaatgctttcaaaatcgggaaaatgcagaagttttggagaaggcggcgacggtttcgtgcccggagaaggtgtcggggccgttattcttaaaccgcttaaagatgccatacgtgataatgatactgtgtacgccgtcataaaaggaacggcaattaaccatggcggaaagacgaatggctatacggtgcctaatcctgccgcacaggcggatttaattcaaggagctcttaaagcggccggttggagcgccagaagtgtcagctttattgaagcacacggcacgggaacgccgctgggtgacccgattgaagtccgaggtctgaccaaggcgttcagagcttataccgaagatgtttcatattgctctctcggatcgattaaatctaacatcggtcatctcgaagcggccgcgggaattgccggcctgacaaagattattttacaaatgaagtataaaaaaatagccgcaacactgcatgctgaacgggtgcatccggatctttatctggaagagacacctttttgtctccagcaggaaaccgccgactggataaaacccgcgaatgaaaaacattctgacagcaaatatccgcggcgtgcgggattaagttctttcggagcgggcggggcaaatgctcatatccttgtggaagagtatgagtctgctgctgactgtcaaacggggcgtgaggaaagtgaagaacttatcgtactctcagccaagcattcactgagtttacgggaatcagcaaaaaagctggaggaatatcttcaaaaggctcgtcataagcagggcgagtgtttacagccggcgggaacaaataagccgcttcacctttctgatattgcatatacccttcttgaagggcgggaagccatgccggaaaggcttgctgtcatttcgaaaaatatcgatgacctgatgttgaaattaaatcacttttataatggaattgacgatcacgaaatattcagagggaaaaaaccgaatcataaacgcggacagcggcaatcggatcttccgctcaattccggcagaaccacattagccgacatggctgaattctgggtatcgggagggagtttaagctgggaagatttccgcaccggcagaaaaccggcaaaaattgcgctgccgacttaccctttcttaaaaaacagactgtgggtgtcaaataaggcgcaaacaacatcagcagccggtacagctcctttatttgatttttctgccggtgagtgccgattttataaaacgctttcagattctgaatattatttaaaagaccatgttgtgcatgggaatatggttctgcccggagcggcaatcatcgaagcggccagagaagcgggagagaggctgtacggaaaatcagtcataaaactgagtcaggttgtatgggcggttccgataaccgttgaaaaagaaaagacgataatgatagatctgctgccgaatcaaaaagacggcagatttgtggtgaaaaccgatatgcaatctgaagcggcagttcattgccaaggaaacattatgacatgcggagataaagacgcctctcatacagagcattttaaattggacagctggttaaccggacagaaaagattaatcagcggcgctgagtgttatagaaacttccggcagagcggtttggactatggagccggctttcaggtaataaaacagctgcttatccatgaaaatgctgttcttgcacgaatatcacttcctgagagcattgataaaaaatccggcgggctgctggaaccgtgtttattggatggcatttttcaatccacaatcgggtttacgtccggtcaggaagacgatcataccgcatatttgccttttgaattaggtgagctggaaattcttcaaccaccttcggcaagcggctatgcttacattacagctgccgatgaaagacaacatgatgatgtcaaaaggtttcatatactatttatggatgaacacggatctgtaagtcttaaaataaaaaacttagcgttgaaggcattaagggctgcaccgcagactcaaaatgagcggcattcagctaagtattactctgatatgtggaagcgggcccctatgcttcatcagcctgaaggcagcggtttaaacagctgccttgtaatttcactccgtcaggatatatcagaaccgctgatccgccaggcatataaagatatcggcctgaacatgatctttgtccgccatggcggaagttttcaagaaaaagaagctgattcctttgaattgaacagcgtcaaacttgaaggctataagaaattgctggcgattcttaaagaaagacaagtgacaattgaccgcgtcattttaatcgggatgagccctgaaacgggaattgagcataacattcatgaaaagctggaagaggctgttttgccggttttcaatgtaacgaaagctctgttagcaacaatcccaagacataaaattctgatatcacatgtatttttcacaaggaacaatcaaatcttaccttatcaaatggcaatcagcggcttttttaggtcgcttcatttagaacatccaatgttgtccggtaaaaatattgaaatacacagcgatgaaattcagttacagctgaacaccggtctgcctgaattaaaaaaccttgtgaaagaaacagtcatcagcgatgatgcttcagagatcagatacagagatggaatcaggcaggtgaaacactctgcagaaattgaaagggcagagccccccaaaaagatggaagtaaaagaagggggagtttaccttattacaggaggaacaggcggcctgggcctgatttttgccagacatcttgtgcgaaaagggagaataaagcttgtgcttatcggcaggtcagagctttctgaggaagccgtaagcaatgtaaaagagctcgaaaaaaacggatcagaagttttttatgtaaaaaccgatatttctgataaggaaaatgtcaacaacctgataaaactcgtcaaaaacaaattaggtcctgttaaaggagttattcacagcgccggtgtgataaaagattcattactcatcaataagcgtgaagaggatctcgattcagtcctggccagcaaggtttacggaacgatatggcttgaccggtatacagacagagaacctctggacttttttgttatgttttcatctatcagcgcaataatcgggaatgccggacaaactgattatgcttatgcaaaccggtttatggattactttgcggaaatgagagcggcggaaaataaacctggaaaaacagtctcgattaattggcctttatggaaagaaggcggtatgcaaattgacattcattcagagaagttcctttatgaccgtttcggaatgctgcctctgggaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcatcaccggcgtattaaaaattgaagaacgggaatttgattttgaactgccgataagtgaatacggatttgattcaattatgtttacaatgctgggcaacgaattaaacgaaacattaggaatatcaatgatgccgtcagattttttcggtcttactgattttaatgaacttcttgagtttttaaagagtgagtattccgaagagcttcatctctgcggatctttttcttcagatgaatctgcggcgaaagacaggagagaaaatctgattgagggcatcgcaaagatgatgtccagtattttaaagattgacagaaaggaaatggaagaagagacttcattcggcgagtacggatttgattctattacgtttaccagactcggaaatgaaatcaatcaacaatatggtacggaattattgccgtccattttctttgaatgcaattcactggctgaactgactgattatgtaatcgagcaatacggagaaatcctttttgctgagacagaacctttttctgcagcagacgaaaaaacattgtacagcacgcctccgccggaatcctatgaacattcccctgagcctgaaaacaaaaccaggcaagaggaaagacatatgaatgagccggttgcaatagtgggaataagcggccgtttcccccaaacagatacgctggaagacttttgggaaggaattgaaaaagggcgggatatgattacagacattcctgaagaccgttgggactggaaagagtttgacggcgatccgatcagggacgtcaatagaacaaaaataaaaaaaggcggatttatcaaaggcgcggacagttttgatccgttgtttttcgggatttctcccgccgaagcagaattaatggatccccagcaaagaatttttatggagactgtatggaaaacaatagaagatgcgggctataagccgtcagatctggcagggacgaaaaccgcggtgtttgcaggggtcgccacaacggactatgcggaacgtctcaatgaaaatggcgtctctgttcaggcgcagaccgcaaccggtttaaatcattgtatattggctaatcgtatttcttaccagctgaacctgacgggtccgagcgaaccgattgacactgcctgttcaagttcattagttgcactccatcgtgcggctgaggggattcaaagaggcgattttgaaatggcgattgcaggcggagtgcatattatgacaagccctactctgtttatagcttttgataaagcaggtatgctttccaaagacggaaagtgcaaaacgtttgataaaagcgctgacggctatgtaaggagtgaaggggcggctgcagtactgcttaagccgctcagcaaagcacaggcagacggtgatcatatttatggtttgattaaagggtcagctgtaaatcacggcggccgcgccaattctttgacagctccgaatccgaacgcacaggcggacttattaaccgaagcttggcggaaggcgggggtcagtcccgccactgcgggatatatagaagcgcatggcacagggacaagtcttggcgatccgattgaagtaaacagcatcataaaggcatttaaaacgttatatcaagaatgggacattccttttgagaaacagaaaagctgcggaatcgggtctgtgaaaacaaacatcggccatctcgaaaccgctgccggaatagccggagtgctgaaagtgttactggcttttaaatatcgcaaacttccgggactcgcccatttttcagaactcaatccatacatcaaaatggaaaatacgccattttatatcacagaaaccgctcaaaagtggaatccgataaaagatgaagagaacaacgatctgccgaggagagcaggtgtcagctcattcggattcggcggtgtgaacgcacatattgttttagaggaatatagggaacctcaaaaagaagtaccggaaaacaacggtaaaacacacatttttgttttatctgcgaaaaccaaagatcaattacttgagtatacccggcttatggttcagtacttggatcgcgtgattgccggtgacatgaccgttaatgccagtgacatggaatttacattgcaaaacggccgggaagcaatgaacgagagaattgccgtatgtgcagtgagtctgactgagctgagagataaatacgtcagctttcttgataaaagcaaggtgcaaaatggcgtatttataagcgaaaacactgaagagcgtgcagctgtttctgaatatatgattcaggaggctcttcaaagcggaaaggaggagctgctcgcacaatggtgggccaatggagccgagtttgaatggaagaccatcggcaatgagaaattgaatagagtgccgctgccgtcttatccgtttgcaaaagagagttattggtttactccgaaaaagaacaaaggcgaggttaatagcaaaagtcttcacccattaatcagcgagaatgtctcaacattaaagaaacaagcatttaaaactgttatttccggaactgaatttttcgtcactgatcaccttgtttcaggagactgtgtgttgccgggagccgcttcgcttgaaatggctctagtttgtgcggaaataagcggagaaagtaaagtatataaaataaaagacgtgatgtggaacagacctatattatataaaggaaaaacgctgcacatttataccggcttggaaatgaaacaagataagttgaacgcaacgatatgtaaagagggcccggatggcgtgcagcaaatctgcacacaatgtgaaacagtattcggagacataaacagcaatcctgagtatgtcgatattgatcagttcatacgcagcagtaaaacggtcataagccggaaagagtgttatcaccgcttcagtcgtatgggcctgacatatcagagcggttttcaaacgttgaaagccgtatatcgcggtgatgtggagttaatggcagaattggagcttccggatcatttagcgaacgggttttcacattttacactccatccttcattaattgacggcggttttcaagcggctgcatttttgttaagagaaaatgagaaagacggcttatttgttccttattcacttagagagcttcacattaagagggcgcttactgcccgatgccatgtttcggtgagagaaaccggtttttatacgtataacattgattttattaacgagagcggcgaagtagccgtgagcatgaaagacttctctgtcagaaaagtgaccgggggagaattaaccgcaggtcataaaaatgaagatcaggaaattctcttcttattggaacaattgaaaaacggtgaactttctgctgaccaagtttatcagctgctggagggaaaatagtgcagatcaaacaaatactttccttaattgaagaacagcaaatgtctcctgatgcaggactggagctaattcgtacttacagaaaacaacaaatggaaaaaaaggcggagccggaatcacaagctccgtccccaaccattttttttaagaccgattgggtcaggacaaatcacattgatatgccgaatcagcaggcaccggggaatatgctgatttttgatcaggataaccgtctttttcagcatgccgagatgatgaatggagaacataaccgtgtcattcttgtaacgcccgattctgattacagaattgaacggaatagatgcacaatcaatccttctgatgaacatcatgtcgaaatgctgctgtctgatttggctgaaaacggatttacacctgatgtcgtgctttatttatggaatagagaaatcagagaattcactgaagaatctgttaatgaaactcttcgcagagggataaactcgctctttttattatcaaaagctttaatgcgaagaaacgaacctgttacgttattgcatatttattggacaagcggtctgaatcagccgtttcatgaagctgtcggagggttcgtgaaaacggtaaacatggaaagctccaagcttaaagcgaaaaccatacagatacgccacgaggattctgacataaatcctccggtttccgagatgtgggatgctgcaatcagtgaaatgcagcgcattcaaacggatgaatgtgagattttaatagactcatatacccgttatgtgaaagggctgcagcctattgatattccggaacacgataacggatctgtaacgtatcaaaaaggcggcatatatatcattaccggaggagccggaaaactcgggctgctgtttgcggaacacatcgctaatgaaaatcaagccgtgattatacttacaggccgttcttttttaacagctgatcaaaaagaacggatcagtatgcttaatgagagcggctctattgttgaatatcagcggacggacataacagatcgaacagaggcagagcgattcattttcggcattaaacagcggtacggcagcataaacgggatcatccatgctgccggcatccttcgtgattcatttcttgtaaataaaagtcccggtgattttacggacgtactgaaaccgaaagtttacgggacaatctggctggatgagctgacaaaagacgaagatcttgatttttttgttctcttttcttctttttccgcttacggaaatgccggccaaagtgactatgcgtacgcaaatcattttatggacagttttgcaatgcttcgatcccagctctctcgaaacggaaaaacactatcaatcaattggccgttattgaaagatggcggaatgagtctcgacagcagtggaatcgttcaaataaaagaaaaatacggaatgactccgatgcgaacttcctctgttctggaagcgtttctgaaaatgctgcggtcttcatttaccagcttaatgcctgcagaaggtgagcgggataaaatgataaaggcgctttcgattcaaagaaatacagctgcagcagatcaagatacactcacggcggaacacgatgaagaagcggaatatgctgcgaaagaaaaagtcaatgactatttaatcaagatcatcagcggtgtcttgaaaatccaagctcataaaataaatgcgaaagactcttttgagaagttcggaatcaactcacttatgatcatgtcacttattgcaaagcttgaagatactttcggggatcttccgaaaacaatcttttttgaatatcagaacattgaagagctttcaaacttcttcctaacatcttttaaagaaaaagtgcttaaggccgcaggggcagctccggtaacaagagtacagaagaaaagagaaaatccgagtaaaaaacagcaccggcagcagaaggatacacctgcaccgagcatggatcagccgggggaggatattgccattatcggtgtgagcggaagatatccgaattccgatactcttgaggagttctgggaaaacattgccggagggaaaaactgtattattgaaatccccgaggaacgttgggatttcagatcgaattacagtcccgacagaatggagaaggggaaaatcaacagtaagtggggcggttttatcagcggtgttgatcaattcgatccgctgtttttccacatttctcataaagaagctgagctgatggaccctcaggagcgaatttttctcgaaacctcctggcatacgtttgaagattcaggatatacaaaagagaagcttaacggtatgaaagccggtgtgtttgtcggagccatgtacggacaatatcaattattcggcgcagaagaaactgcgcggggcaatccgattgcgctcagttccttcttttcatctattgccaacagggtttcgtacttttttaatctctccggcccgagcattgcactggatacgatgtgttcatcatcgctgacggccattcacttggcatgtgagagcattaaaagaggggaaagtgaaattgcgcttgcaggcggcgttaatgtatccatacaccccagcaaatacctttggctgagtcaaggtaattttgtttccaccgaaggattgtgcagaagtttcggagagggcggagacggctatgtcccgggagaaggttcgggagccgttctgttgaaacctctggaaaaagcaattgctgatcaggatcatatatacggagtgattaaaggaacatctgtaaatcatggcggaaaaaccaatggatttacggttccgaatccgaatgcacaagctgagctgattgctgaaaatttcaagaaatcgggcatcagtccgcgatccgtcagctacttggaagcacacggaacgggtacctcgctcggagatccgattgagatcgcaggattgacaaaagcttttgagaaatttacggatgataaacaattttgtgccataggttcagtgaagtctaatatcggacatttggagtctgccgcaggtatagcagcccttacaaaagttcttttacaatttaagcatcagaagttggcgccatccattcactcggaacagctgaaccaaaatattcgatttgaaaagacgcctttttacgttcagcagaaagaagaagagtggcggaaagaatcaggcgcctctaacaggagagcagcaatcagttcgttcggagcgggaggagcaaatgcccatgtcattgtggaggaatatcaaaaccatgcggacacacaaacaataagcggtccgtttgccgcagttctttctgccaaaaatgaagacagactgaaagaatacgcccggcgccttctgcaattcacagagcgggagacaacagcctcggcagctgatatcgcttttacattgcagacatgcagggagcctatggaagacagacttgctgttgtagcttccgatttgccggaacttaaggagaagctgagaactttctgtactgaaggaacaattggagagggcgtatacaaaggcaatgttacgaaagattttgataaagtctttatctttcatgatcaaaagatgaaagataaattcctcgaagtgatgatggagacaaaggacttgaatcttctagcaaaattatggtctttcggggctgatattcaatggagagagttatatgaagagtataccccgcaaaaggtcaagcttcctttatatccatttgctgaggagtcttactgggtgcctcgaaatcaaagctcaatatttccggaaatattgccgcagcagtcttcactgcacccgcttctggattcgaatgaatctactctggaacagcagttttttaaaacgacattaagagaaaaagagatttggttaaaagaccacatcgtaaaaaacaagagcattctcccggcagctgcttttcttgaaatggcatgtgcagcgggaacgcggtcatatcgaaagaaagaggtcactcgtttaaaaaacgtgatatttgcaagaccggccatgcttttgcaagagagtctgaccatttacactcacatttccgtaaaagacggcaaaatattatttaatatgtcatctgacgaggatgctgctgtaaggactggatttgtgacgggggaattagattatgatcatcattacggtgatgatgatatagagaatatcgacagacaagagatgataaacagaagtgcttttgtccgtgaacaagatgaatgttacaagtattttcgggaaaacgggttcctgtatgggcgcgcttttcagccgattcaacgtttatggggcggaaaaacagaagcggttgcacacttattgctgccaaaagaagccgcatatgctcttgaaaattatacattgcatccgtctttaattgatggggctctgcaatctttgttcgggattacggacggaagagaagaggcatctgtttatgttcctttttcaataggagagattacgattcggaaaaaagtttcagcagaatgctgggcttatgcgcgtaaaacaggccaaaaaggtcaatccgagcttatttacgatattcagctgcttaatgaacaaggagaaagacttgcaggtttgaaggatgtaaccattcgtaaaaaagaaacgttttccgcggaggcacagactcgtgcaacagcggattccaatggaaagaacgagagagtaaaagagcttctcagacaattaaaagcgggcgaactgactgccgaagaagcagattatgcgctggagcatatgcaggattagtttatcattttgcggcagtgccatttgtaaaggggatgaagatttttatgaaagaagcccgtcatattagaaaaaaagtactttctgacatagaaagcggcaacatttctttggaagaaggagtaaagcggatacagcagcttggttttcattccgcaggggttaacggacaggcgatatattatcagacggtctggcagcggacagatctcagcattcatgtaaaaggcggccggcgtgagggcagccttttattatttgataaaaatgaagatgtgagtaaagaacttgctgcattgcatgatacaagggttattttggttaagccggggaaagagtttcgaaaaaccggggacggtgtatttgaaatcgacccccgctctgaaaaagattacataaacctgttaggatggcttatagaagaagagaagtcagatatacgggaagcggtgcatttatggtcagacatgccgtttgaaaaaacagagagagcgattcgtgaacaatgcgacagcggagtctattctttgtttttattacaacaggcgctcttcaaaaataactgccgcaaaccgatcaagctgttatatggatatttttcgcacctttccggagaacagcctctttacgcggcggcaagcggatttttgcggacattacagctggaaaatccgttaatctcagcaaaaagcattgaaatggagcagtcaatagcagccgttcacgcagctgatatcatacgcaatgagctgagtgatttccagccttcagatgtagagatccgttataaagacatgcagcgttatgtcaaacagctcaaaacgtatgaacccgaaaaaaattccggaagcggagatgtgccgctgagagaaaatggagtatatattatcgcgggcggcgcgggcggattaggatttacctttgcagaatatttggcttttcaaacaaaatgctgccttgttttaacaggtagatctccgctttcagatcatataagaaaacagctgaggcgattggaggatgccggttcttcagctgtttatgttcaggctgatattaccaataaggaagaagccgaatatgtagtcaaaaaagccaaaacttcttatggaaaagtaaacggggtcattcagggcgcgggaatcatccgggattctttccttcttaacaagtcacgagaggaattcgatcaggtaatcagaccgaaagtatggggtacgatgtggctgaatgatgctgttgagaaagaaaatcctgactttttcatttgcttctcctctacttccgcagtgttgggaaatgtcgggcaatctgattacgcgttcggaaacagttatatggatcatttcatgaatatgcgttctgtccagcattctgatacgatttctctctctctgaactggccgctgtggaaagaagtcggcatgcaagtggatgagcgaacggtagagacaatgaaaaaggcgggtttttatcctttagaaaaagaagaaggtaaaaaagcgtttgccgtcgcattgtcctccggtttttcgcaattcactgtattttacggagatgagcaaattgacaatcatgttcatcaattatatgaacgaaaagacaatattcaggcagatgaaggaacagggagaaatatcgaatcatttgattcagagaaactgacagctgaaacatctgattttatcataaaaataattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacgggagcggcaccccatctcagaagaaaaaagataataaacagacagccgatgttaacgggaaacagaaaatccagatgaaaaatcaggtgcagcaggagaagtatcatgacaatgatatcgctattatcggtatcagcggacgttacccgatggcaaatgatcttgatactctgtgggaaaacttattgaacggtaaagactgtataactgagatacctgaggatcggtgggattcgaggctgcactatcagcctgcggcgggcgacgaagtaaaaaaccaaagcaaatgggggggatttattgacgatgtgtatcattttgatccgttgttctttaatatttctcctgccgaagctgaattaattgatccgcaggaaagactgtttttagagacggtttggcacaccatagaagatgccgggtacgcaaagaaaacgcttgaaagaaaaaacgtcggtgtttttgcaggggttatgtacggccaatatcagctgtacagcgttggtcacgaagcggccgtttcttcctcatatgcatcaatcgcaaaccgggtatcctacttctttaatttcagcgggccaagtattgctttggacacgatgtgttcctcatcattaacggctgttcattttgcctgtgaaagtttaatcaggaatgaatgtgaaattgcaattgcaggaggcgtcaatttatccattcatcctcataaatacgaactcttgactcaaggaggatttttatccagtgatggccggtgcagaagcttcggttcaggaggagacggctatgtgccgggagaagggacaggtgccgtgctgctgaaacccgtaaaaaaggctattgccgacggtgatcagatttattcagttattaaggcaacagcgatcaaccacggtgctaagacgaatggatataccgtgccgaatccaaaagctcaaagtgaggtcattacgagagccttaaaaaaaggatgtattgatcccgaaagcatcagctatatagaagctcacggaacaggcaccgcgttaggagatccgattgaaatcaccggcctgaccaaagctttttcaggtgccgaacgcgataagaagacatgcgcgatcgggtcggttaaatcaaatatcggacatcttgaggctgctgcaggcatagcgggcattacgaaagttattcttcaaatgaaacataaaacgattgttccgtcactgactcattctgctgaattgaatgagaatataccgtttcaaaaaacacctttttatgtaccggacagagccgaaaaatgggagtcacccgttcccaggcgtgccggaatcagttctttcggggcaggaggagctaatgcccatgttattttagaagaatttgcggatgaagctatctctcctctcgcggctgaagaacctgaacagcttttatttgttttttctgcaaaaaatgccgacaggctggcagaatatgcaaaacgcgcaaaagaacaaatagcagccagagattattcattagaaacacttagaaatacagcatttactttacaaaccgggagagaagaaatgccgcacagattggctgttatcgcctccacaagagatgaattgcttaaagggctgacagactatactctcggaaatgcgagggatcatatttttacaagcggcaaagacacaacagaagctcaaaggacgaacaaagctgaaattgaagaagcagccgcaaacagggatcttgtgaagattgctgaatactgggttggcggtaatggagtagattggctgtcactttataaagatgtcactttgagacgggtatcagcaccgggatatccatttgccaaagagctatgcagaatagatgcgcaaaatacgggaagcacccggatgaacgtaaataacgatctgcatccttatatttcatgcaatatatctgattttaaagcccagaagtttcttatcaatgtaagcgataccgatttgtatataaaaacaaagtatcaagacaaggaaatgtttccgtttctcagccagattgaaatggcgagagctgccggagcgatggcttcagggaatccgattattaaattaactgagctctcctttagagaaccgatgttacaaagcggaagcaatgagcagatccggattgtattaaccccggataatcagggtgcatcgtattctatagaaaaacagagcgactcatccatttattcctcagggcggctcgaattagaaggcggggcgtacgagaacggaaatattcatcttgagccgttcctgtctcagggcgcagaccgtataccgtacgaagcgttttatcagcggcttgccgaattcggatacagctgcagtgacagtctgaaagccgcagagcactgcgtcagcaggaacggacaggtgcttttaaagataaaagcaaaggccgggccgaaagggtgcataatcaaaccggaagtgattgagagcgcatatcaagccgtcgtataccttgcgggggaaaatgccggagagaccccggaaaatattaaagaatgtacgatttttgatcatgagattgaacccgtttatgtatatgcagaacaaactgaagaaagcgattcggcttatgatgtgtatgtattagacaatgccggcgggattttgatggaactgagcgggctggtttttggcgaaaagcctaataaaaatgtacgtttttatgagcatgagtgggatcaaaaaaaccctctgattgaaaagaaagatagggagccaaaaacaattctggtttttgcaaaagatgaagcattggctgaagctctgacaaatcaatcagacagccgtgtcattctcgtcacgccggatcagcggcagaccgatcaaaatctgctgacattctgtataaacccggaagtgacgtcagattatattcgtttattcgaagaattggagaaaaaggggttttctcctgatgtcatcttgcacacgggagaaacattttacgcgggtgaccgccttctcagcggcctggaatcaattttttatttattaaaagccctgagcgcccgcagtgacgcctctctttatcttcattctctgcttcttgttcactcttttaaagaaggcatgaatgatccgtatacgggcgctcttgcaggctgtttaaaaacggcaaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcactctcatcagctgaaacagaaagggatttacctcataacgggcggtttgggcggtctgggcctgatttttgcaaaatatttagcctctcagtatcaagcaaaattagtattgacgggaagatcaccgttaacagctgataaacgacataacattgaccggctgcaggcgcttggaggagacgcggtatattatcaagctgatgccgcagatcaaaagacgatgggatgggtcatagaagaaacgaaacggacttggggatccattcaaggcgttattcattcagctggtcatgccgatgatcggttatttacagagatgaatctgactgattttacggaaggcatgactgctaaaattgaaggaacggtatgcttagatgaattaacgaaagatgagccgcttgatttctttatcgtattttcttctatttcttcggtcttcggagattttggacaggttaactatgcgatgggcaattattttcaagatcaatatataaattggagatccgaacagagcagccggcaagagagacaaggcaagagcatttcgattaactggccgttgtggcgtaaaggcggaatgcatttaaacaaagaagctgaagaagcatatctttccgcatccgggtttgattatttggaaacggaagaagggctagcggcttttgaggcgattttggcaagtgactgtccgcaaatttcggttgttaccggggatgccggaacaacaccagcaaaaaaagatctgccgcatcaaaaagtaaatacgcttccggcacgtcaagaggaaagttcttatacaggaccggattctgcagacaatgtccttgaagaactgaagcaaatggtatcggaattattgaaaattaacattgaacagctggatacggcagagaatttcggcaatctcggctttgattctatcagtttgaaaacattagctgtcagactgaataaaaaatacaagcttaagctgacacctgccgttttctttacttacagccatataaagtctctttcagaatttctaagcagtgaactgcgtactgttgcaaaagggaatacagatgcagaaaaaaacatttctgaaaaaaggaaagtgcacgccgggaaaaccgcagggaaaaccgtgaagccgccgcgaagttttccgtttgaaaaaaagacagcaagacaggctgaccatcatccggagaagcagccggttgccattatcgggatgagttgtgtttttccgggagcaaaaaatgcagatgagttttggatcaatttaatcaatgaaaaagattcgattcaggaaattcccccggatcgatgggattggaaaaaatacgccgaaggcaaaggaagcagcgaagtacattcgaaatggggcggatttatcacagatgccgataaatttgatgaggcgtttttcaatattaatccgcgggaagcagaactcatggatcctcagcacagaatttatttgcaggaaacctggaaagcgatagaagatgcgggttacaaagcttcaaagctgtccggcaaacatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgtagcaatccacagagctgtgcgctcgattcaaaatggcgaaagtgagctggcggtagcaggcggggtttcgctgctcttagatccagtcacgcatatgtataccgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggcagaactaataacgtctgtttacaaaaatgccgatattcctgttgatacgatatcttatattgaagcacacggaaccgggacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgtcaaggagctgaacccttacattcaattaagcggaacaccgtttcatattgtcaataaaactatgaagtgggccagattaaaagatcgaaaaggaaatgaaattccgcgccgcgccggagtcagttcctttggattcggcggggcaaatgctcatgtcatcgtggaagaatttgaatacggacaagataaagcagtaactgccgagcgggatcaaatcattgttctatcggccaaaacaaaggaaaggctgatggttaaagccaaagagttaacagcgtttttacatgaagaactatcagttcaattcagtcatcaagaggtgcaggaacgtgatgtgcaagaggcggttcgggaagcggcagcgggtatcctgcgtttagataccgcaaatatagatgcaaagacacctctttcggaattcggatttgatccgttggcttattccgaattaatctcttatataaaccaaatgtacggcacagaaatatcactagatatatttcaggaattaatgaccctgagtgagctgtgccgctatatcagcagcgtccggaatcgatcagctgataaaccgtataacggcaattttagagaaaagtccggaatcggtcttgaagaaatagcatatacgctgcaaaccggaagagaaccatttgaatgccgccttgcgatcacttgctcgaataccggagatcttcttgaaaaattaaacggttacattcaggggagcagactgcaaggtgtttatgaaggaaatgtaacggattttgatagtctgtacgctcctttattcggcggccctgaaggtcatgcatatgttcaatcactgattcagcaaaacaagccggccaaactggctcagttgtggacgatcggttgtgaaatcagctgggaagacttgtatgaggaggaactcaaaccggttaaacggcctcttcctctttatcctttcagcaagaacagacattggattcctttaaataaagatgaagcgcagaaggctgaggctttctcgaacactgagcttcacaactcaaataaagatacagcagatggagaaatcatgtcgcttcttgaaaaagcacaaacaggtgagatgaatacgaaagagacgtcagagctgatagaggagttgcttttccatgaatgaaaaaacaatgcaaattgagcaaatcgtgaaaaaggtgaaagaaggcagcctgacgcgtgaagaagggctggaattaattaagagtttggggaaaacccatctatatgaaatggtatgggatagacatgaatttaaaggcagtgaaaaattcccgaatacgaaagagccaattatatttttttgcaaagacgacagcatgtataccgtaatgaagagacagcttgaaggctatgaggcgcctttcatttacgtgacttccggcgagcgtttcgaagattgccggaacggtcgttttaaaatgaactttgcaaatgatgaggattatgatgcgctatgcggggttctgcgttctcaaaatataagaccccgccatattattcattttttagctgccgggctcttcaaaaatacagaagatgcaataagaaagcagctcaataaaagtctgttttccttgtttcaaatgtttcaggccttcatggcgaacaaactttgtccgaaagcagaagttttgtatctgtatgaaaatgccgagggcgaggttcagcccatttataatgcggttgaaagttttcttaagaccgtacaggccgaaaatccgaatttcacatgtaaggctgcagagctgaaatcaatgtttgacgagccgtttacaaagcagcatattgcagatgtcatctcttttgaatggaacaatcaatgcaagacggaccactttacctgttatgagccgaggcattattataaaaggcagcttaaaagagtaaaaaaagaagatggggagaaacatagtttcagtgtaaaaaagaacggtgtgtatttaattacgggaggagccggaggcctcgggtatctgtttgcggaatatctggcgaaacaggcggaagtcaagctggtattaaccgggcgttctccggcatcccgtgaaacggcgcaaaaattgagcgcgcttgaaaatctcggcgctgaagccttatatgtcccggcagatatttcaaaggaaaaagaggcggacgcgttaattaagcacattaagcagacattcggggaattaaacggaattttgcacagtgccggacttgttaaggatgcatttatcataaaaaaagcgaaagaaagcatagaagaagttatagcgcctaaagtattcggaaccgtttggctggataaagcagctgaggaagagcctcttgatttcttcgttatgttttcatccctttcggccgttctgcctaatgcgggtcagagcgactacgccttcgctaacggatgtatggacggattcacccagtatcgaagcatgaaaggacgtcccgggaaaacactttctattaattggcctttatgggatgcggggaatatgacagttggtccggcagagctgcaggctttaagacacacggggctggaacttttatctgcccaagcagggcttgccgcttttcaggacagtatgagccgttctgcttctcagctggctgttatcagcggagacaaagatagaataagtgaattactctcaactgaccataaaaagatagagactgtgcctgaaaacaacagtctgccgcaattaaatgaaaaagatctgaaaaagcaaacgatccgtctattgacagagatcgtcggtgcggaaacgggaagaccggcggacagcattttacccgaggatacatttgaccgttacggaattgattctctaacaattttaggtcttaactcccgtctcgaaaagtattttggaagagtgtctaagactcttttctttgaatacagcagtgttgaagagctgtcagagtattttcttgaacactatcaacatgagttgaagaaggcgtttttaccggcagccgaacagcgaattgatcattcggcgccggcgaaacgggagaagctttccgtttcccgtataccatccgcaccttccgaggaagatattgcaattatcggtatagccggccgctacccgatggcgaaggatgtggaacagttttgggaaaatatttcttccggaaaagattgtataacggaaataccgaaagagcgctgggattttcggaaatattatcacacaggtgacaatgcccgtcatgacagcaaatggggaggttttataaaagacgctgataaattcgatccgctgttcttctcaatttcgcctcgtgatgccgagttaattgatcctcaggaacggttatttttagagacagcatggcacacgtttgaagatgcgggttacacaaagaaaaagttgaaacggcataagacaggggtatttgtcggcgtcacctacagccactatcagttatttgcagccggtgcttcagatgatgagggacgtcaggcgctcttgtcttcttattcgtctatcgcaaaccgggtgtcatatttctttgacctgcacggacccagccttgcaattgatacaatgtgttcttcttcactttctgctgttcattttgcatgtgaaagtttaaaaaggggagaatccaccctcgccatagccggaggagtgaatttatccttacacccggataaatatactttactttcacaaaatcattttgtttcaagcgatgggcgctgcagaagctttggagcgggaggagacggatatgtgccgggagaaggagtcggggccgttcttttgaaatcgctttctgccgcaaaggctgacggggacaggatttacggtgtgattaagggaacatctgtaaatcacggcggaaaaacaaatggatacactgtgccaaatccaggcgagcaggcaaacgtcatcagtgaaactcttgataaggcggggattgatgcagacagcataagttatattgaagcgcatggcacagggacatctttgggagacccgattgaaatttcaggtttaaccaaagctttgcacagctcgaaaagcgattatcgttgtgcaattggttcggttaagtcaaatatcggacacctagaggccgcggcgggaattgcttctatcacaaaagtgctgatgcaaatgaagtataaacagcttgctccttcccttcattccgataacttaaatcctaatattgattttgaggaaacaccgttttacgtgcagtctgaattgaccgattgggagacgccgcaaaatcaagccagaaggtcgggtatcagttcgttcggcgctggaggatctaatgcccacattatcatcgaagagtacaagaatgaagaaaagatggaaacggtacagagcaacaagacgcaaattattctgctttctgccaaaaatgaagaacggctcagactcttgattgatgcatatataaaagaactggagccaaaaacgtcactagctgatgccgcgtacacttcgcagaccgggagaaacgctatggaagagcggctcgctgttgaggttagcagcattgacgatcttcgcgataagctgacgatgtatttgcggtcagatcataagttaaacggtttatataggggaaacgcccgccgaggcgccggtcaaaagaatgccctgtcagccgctcactttgaaaatgcaagagatatggccattcactgggtgaacggaggagacgttgaatgggaagagatgtacactgcggaattaccgaagcttatttctcttcctgcatacccttttgaacggaacagatattgggtgcctgccgcaaaagcagcacagaaacagaaaacaggtgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagatcctctgattgaacccgctgtcatttgcgcagataactgggatcattcggatggggaagccaaaaaaacggctctagcagtcatagaagaaaatccggaaatcatcggcatgattgacctgtcagatttgcggagtaatcaaaacggggcacgcaccggcacaatcgggaagctgatactgctgcaggaaatcataaagacacgtaaacagcttttcgttttacatgtgacaagagggctccagacatttctgaatgacaagccgtcattagccggagccgaaacagccggactatataaaatgctgagcgcggagtatcaaaagataaaatcaaaaacaatagatgtagacgggcatgtcgggactgcggcggaactgagacaggtaatcacagatgaagcttgcgctgacgggctgtatagtgaaatctgctaccggaacggtgaacgttatattccatacgtcgagaaattacatgcggcggaaataaaccggaaactatccggtctgccggtatgccgtacggatcaaaccttggttattacagggggaacaagagggatcggagcagaacttgccagacattatgccggcaagggagtcaaaaaacttgtgctgatgggagtaaccgaccttccggaatctgataaaatagccggcatgttagaagacaccgatgaaaagtcacctcttttttcgaaattacaactgctgcatgagttggatcaaaagggagttcaggtggaagtgtatgcagggccgctcacggaaaaagaaaaattacatcgcttcttttcagaggtgcgaatgaagttcggcaaaatcggcggggtgattcattgcgctggtgcagccaatcattcgaatccggcttttattcataaatctgatcaagaaataagagaagtatttgagccaaaggtgcaggggatgcaagtacttcatgacgtttttattgatgacgaacttgatttcttcattttgttttcatctgttgcgagcgcttttcctttattaggcgccggaacaagtgactatgccgcggctaacgcttttatggattactttgcggcgtatcagcatgcagccggcaaaacatattatcaatcaattaactggccgagctggaaggacattgggatgggcgaggtgacaagtccatcatatcaggcactcggtttactttcacactcaacagaaacaggtatttccatgctggatgaaatcatgacgataaacggatatccatgccttataccggcaaagacacatccggagaaattcaagctgcagcagctgcttcagacaagaattcaagctgctaaaaataacccggatgctgaggaaaaagtggtctctggtcatggagacaatgaagctatgatcaggaagttaatggagattttttccgcggagctgaaaataccttacgggaatttagatcaggatacgtcttttgcggattacggagttgattcaatcttactggttcagcttgtcaaaaaagcggaagaagcatttcaaataaaaattgaaccttcggcttttctggagtatccgagtttttcacaactgggcgtctatttgaacgagttatttgcaagtgaggggatcagtcctcaaattgattcagaaaacattgaggttcggaataaagagcaacatataaatcaaaatgctcccgaagtacgggacagcggatctcaaatgcaaccaaccagtctgaaccaaatcgcaattatcggaatgggctgtgagtttccggatgctccggacacagaaacgttctggagaaatttgaagaaaggacaaaatagtgtccgtgaagtcccggcgtcgcgatgggatatttcttcatactactctgacacctatgaaaaaggaaaaagtatcagtaagtggggcggatttcttcaagatattgagtctttcgatcccgcgttttttaatatgaacaaaagtgaggcatcagagcttgatccgttaatcaaaaaatgccttgaggtcagcgtccagacattgagagacggcggctatacaaaggaagaagtatcaaacaaagaagtcggcgttttcatcggttcgcgcaccgggacgtttatgtccaaaataggttccccttcaaaaaatacgatcgtgggtataggacaaaatttcataggcgcgcatatctcacacttttttaatctgaaaggaccgaatctggttgtagacacggcttgttcttcttcattggtcagcgtccatctcgcttgtcaaagcctgatgtcaaaagagtcagatatggcaattgcgggcggggttgacattttgctggatcaaaagccttacgtcatgctgagtgaggctcgggcgctttcacctgaaggaaaatgtcatacatttgatgagaaggcagatggatttgtaccgggagaaggatgcggcgcagtccttttaaaaagacttgatgacgcccttgccgaaggtgacagaatttacgcggtaattgactcctccgcggttaataatgacggacagacaatggggatgacaacacctaatccgaaagcgcaaagcgcagtgataaaaaaagccctgaaaaaaggcggaattgatgcagatactctcagttatgtcgaaacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacactacattgtaaaacgccaaatccgcgttttaaatttgatcagtcgcctttctttccgaacacgtctttaaaagaatggcgtcccagaaaaggggttttgagagccggaatcagttcttttggattcgggggcacgaacgcacatatgatattgagcgacagccatctcacgttaggatatggagagacaaaaagacacccgctttctccggttatattcaataaggaacaatgctggatcgacaatggagaagctccagaaaaggaagagtcagaattgctgattcctttacttgatttcaaagaattataaagaaaagaaaaggaatgagacaggtggccagtaatcaaaactatcagttcacattaacaattaaacatacggactatattgtcagggatcaccgggtgcatggcacccggattatacccggtgtcacatttttagatatgatataccgtatggcgctgagtaaaggtttgcctattgaagaactcgagtgtcagaatattttgtatttggaacctgtagcaacatcggatacctttgacagagaaatccgcatccgttttcagggattggaacagggatgggaaatccaggcgaagagcagaaaggtaaaagatgaccggattctggatgaaagctgggatgagaatatgaactgcaggctcatgcagaaattcccggaaagcatgagttcaattcatatcgatgaaatcaaacatgcctccgtccgtgaagccgatatggagatatgttatgactatttaaaaaaggttgatatagagcattttgaatttatgaagagtctggggaaggtttatgcgtctgatcattctgtacttgcagagttgtcgctcagccaaattgccaaacaatataccggctattttcaattgcatcccacttttcttgatgcgtctaccatcatatcgatcctttatcaggcatgtcccgaatattttacacaaggatctccggcaagccggatgaaaacgtatattcccattcatattgaatctttccgtatgacgaagcgcctggaagacaggtgttatgtgtacatagagaagcaagaccaaaatcatgattcaggggatgtcatccaagtcagttacggtttgtacgatgcacacggggagatgatcgcttattttacccggctgtctgtgaaacatattcgctcaaaagatttaattgaaaatctgaagcagactcgtttagaaactgaagcggcttctcagccaaaagacggcctgatgagaaaagattcaatcatagatcgaagcgaaagcattgagacacaccttaaagaattaatatccggggtttcaaatatagatctgcgtgacataaggacagacattggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaaaagcctgacatgaaagaaagtaagaacgaaaatctttccgctcttataacagaaggagacattcagcagctgatcgcagacatcaaagggactgcccctgaaacactctctgtggtaaaaggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaaaagcctgacatgaaagaaagtaagaacgaaaatctttccgctcttataacagaaggagacattcagcagctgatcgcagacatcaaagggactgcccctgaaacactctctgtggtaaaaggtttttatgaacaaggcctggattccgtcacacttatgcaagccgtaaaggcattggaggagaaaacaggcagggaactgtaccctactttattgtttgagtatccgacgattcaaaaacttgcaaattattttgcggagagcggcgaaaagacttccgttgacaaagacctccctctacatcatggagagaatcatacggctctgacctatttaacgccgtattggagacaaaaggctgccgcgtgggacccgcattgcggaaataaaaagaaaagaacatgtctgctgtttcaatatgacagagagctttttcattttatgcgggaaaatgctgaaaatggattcgaaaatacacagatcattctcgttttatcagggaatcgtttctcctatcacggagacggaatttatgagatagatcacagggaggaagcccactttgacaggcttgcagctgatctgaaaaaaagggggcaaatgcccgacaccgtggtgtacgggtggccggaaggatcatttgccggcccggaaaaaataagtgaacagctttctaaaggggcttacccgctattctttttcagccgggcattgatgcgcagcaaggcggaaaaaaaggttgtatcgcttttcctttatccggcggaccataaaaatgatcagccgctttacgcttcagtccatggcgcagggcagtctattttgcttgagaacccgaaactggcccttaagacaatcgggatatcagtttcagacaagacatcgttgccggctcttacagctgaaatcatcagatgcgaatcaactgaagcgcatccgggagaaaccgatctttattatgaaggaaatgtgcgctgggtccgtgccttacgggaagcggaaccggctcaaaactcagatttctcctttaaagaaaacggagtatacatgattacaggaggggccggcggcttaggccttatatttgcagaacatatcgcagcgcaaacgaaagccaatattattttagcgggccgttctgaactgacggaagacaaaaagaacaaaatcagccgaatgaaagcaggcggttcttccgttcaatatataagaggagatttttcagatagccgcgatgcagagcgaatcataaaaactattaaaaggaaattcggagaaatcaacggtgtgatacacagtgccggtgtgacgcacgacgctttattgattcaaaaatcaaaagatgaaattcaggaagtgatcgctccgaaaataaatggcacggtcttattggacagcttgctgcaaaccgaacctttggacttctttgtgatgttttcatcaagcagctcgatgtacgggaatatcggacagacggattatgcattggctaaccggttcatcgatctttttgctgagtggcgtgaaggaatgaggcggaaaaaagaacgctccggcgtctcagtagccatcggctggccgctatgggaagacggcggcatgaaagtggataaacaaactgaaaaatggatgaaacaaaaaatcggtatggttccccttagtaaaaccaatgggatcaaagcttttcaagattcactctctctgaacgcatcacagctgatcgtgtttgaaggtgacaaagaaaaattggaatctgcacttcaagataccttcatggtggatgaaagccgtgagatccaaataaatgaaacagctgatacaaggcatcaagacattgccattatcggtttaagcggaaagtatccgatggctgaagacttacctgaattttgggagaatttaaagagcggaaaagattgtattacagaaatcccgcctgaccgctggaatatagatgatttcttcagcgaagacagagatatgaaagggaagtcttacagcaagtggggaggttttatcagcggagccgatcaatttgatccgcttttctttcatatttccccacgggaagcagaacttatggatccccaggaaaggctctttttagaaacggccaaaaattgttttgaagactcagggtacccgagaaacatgctggaaaagatgaaagtcggtgtatttgtcggtgcaatgtggggccaatatcaactatttgaaggagaagaaaacggagcggctttctcgccggcttccgtctattcttcaattgccaatcgggtgtcttattattttcatttaaaaggtccgagtttggctctggatacaatgtgctcttcatcattgacctctattcattacgcatgccaaagcatacattgcggagagagcgatatggcattagccggcggagtgaatttgtcaatacatccgaataaatataagttcctcagcatgggacagtttctatcaagtgacggcagatgccggagttttggaaaagacggaagcggttacgttcccggtgagggagtcggagccgtattgttaaaaccattgaaaaaagcaatagaagatcaagatcaaatatacggtgtgattaagggaagcgccgttaaccatggaggaaagacgagcgggtattccataccgaatccggatgcgcaggcggaggtcatttcagaagcgcttcgtaaagctgacattgatccgaacaccgtcaattatattgaagcgcatggaacagggacatcattaggcgatccgattgaaattcaaggactcaaagattcctatcaattgaaccatccttgcgccatcggttcggtgaaatccaatatcggacatttagaatctgcggcaggaatcgctgcggtaacgaaagtgcttctccaaatgaagaataagcagcttgttccttctctgcattccgatattgttaatccgtttatagattttgatcaggttccttttcaagtgcagcggaaagcggctgaatggaatattccgcaaaacagccatgctgtccatcctttgagagccggggtaagcgcttttggggcaggaggaacaaacgcgcatcttatattggaagcgtatgaaccgccaaaagcttttgatcatcaaagcggccgagtgatctttgttttatcggctcaagacaaacaacggctgataaaatatgcaaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttatatcaggggtgaaaaaagcagcttgagccataccggtaatacattcgaatcagaagttcacaatgaaatgcctcacgtttgttcagattacgccgaagcagcatccaaatgggtaaatggaagaaagatagattgggagacttttgaggtgaatcggaatgcccgcaggatttctatcccgggacaaccgctgatcaaacagcggtattggatagcggaaaaaggggaagcacttgtttcagcggatgtgagtaagacgggtcaccctttcttggggagtaacacgtccgattttcatcagttcagtttcacgaaaaaaatcagccgtaatcatccgttcgcactaagtctgtctgaaggaaacgtgtcctttttcccttatgcatctttggctgaaatggctatcgtcaatgcagcggcggcatttggacaaccagttcaaacattgaccgatttattgtggaacgaaagcatgaacggaatgacagatatacgggaactgatgattacgctgacgcctgagcgtgactttgcgcggtttgacatatatgcaaacacaaaaaatgagaataaagtacgacttgccagcggaaatgcgcatatggttaagcctgaaagcggtatgcttcctgaagcgcttgatattgctgaagtcaaatcagaaatgactgaacatccggctgaagcgccttttgtcattgaatcagcgaaaaacagttacggaatgctgtcgcttcattcaatgccggatgagctttatgcaaaaagagaaaattttacgatttctcctgaagcgcttgagtccgcgattcaagccagtgcattttttgtcagtggagaaaccttcccggaattgatcggaatgggagcggcggatgtctatcagcctctcgctcaaaatttttatgtttatactcaaaaagtgaacaggcagaacagccgtgatgtaacgtgtcatatgacatttacagatggaaacggaagcattctggcggagtgcagagatgtgagattcagatatggtcatgaaaaagacactgttcagacggacgatgaactcattcgtctcctgcgtcaattggaaaccaatggtattgatcagaaggctgtattgaaacaattaatgggggaagaatgatgaacggaaaacgtgaacaaatcagcgatattcttgatctgattcaaacaggacaaatgtcggctgacgaaggctatgcccgtgtgacatccattcagaatcaaaaatcacgggcatcgaaccatcctcttttatattacaagccggaatggacagaatcgttcattccgagtacgaagagcgtacccttgacgggattgctcctgatttttgcagaaaatgaacggcaaatacaagaattgagcggtttgtttaaggactgcactctcttgtttgtcatccgcggagaagaatttgctgttttacatgatgatacgatttgtatgaaccacgtgaaaaaagacgattatctaaagctgttccgatacattcatgatcattatcagccgcccgaaaagattcttcacttgtggtctgattctcaggctgacatgagtaagggaggtatacagaaacaattggaaaacggattgttttctcttctgtatattacacaggcgctgattgaattaaaatggaaaaagataataaaactgacgcatatttttcaaactcagaataaagaacaactgccgctgcatcatgctctcggcggattggtgaaaaccgttcaccaggaacaccccaattttcactatcagattatcaatatcactcaatcagagggtgcgggagccgctcttccagcaatagctgatatatatcagagagagtgtgacgaaaaacgggatatccactttgaagtgcgctatgaaaacggcagacgttttacgaaaagctataataaagccggctcattcgatttaacccagccgctgaaacatcatgggaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagctcaggttcaacaattgaatacatccgatctgatgtttcaaaacaaagtgatgctgaacggatgtttgcttttgcaaaagagcagttcggcaccttgcatggagtatttcacagtgccggcgtactccgtgactcttttatcttaagaaagacaaaagaagaaatggatcaagtcacaggttcgaaagtttatggcacgctctggctggcggaagaaatcaaaaaaatgaaagttgaattacttgtcttgttttcatccacatcggcagtcttcggatcagccggccaatgtgactatgctttcgccaatgcctttttggatcagtatgcagcagttatgaccgcaaaagagtctgccgaaagggtggtgtcagtcaattggccgctatggacttccggcgggatgaatattgacgatgaaggaatatcctacatgaaacaggaactcggccttgacccgctagatgacggtgacggaatacaggctctggagaacagcttgtgtcaatcatctgaacagctgattgccctgaaaggccgaaaagaaaagattgaggatgtgctgaagcgtgccggcacaatcagcttacattcagaccagcaggaagatgccgatttgcaaagcgatgaattaagacaaaatatcatcagctatctaaaaaatataatgtccgaagaattaaaattaccggcctcactcatagatgaaaaacaatacctggagaaatacggcattgattcagtgatgatcatgcgtctgaccaaaaagctggagcaaagtatcggcagattgtcgaaaacattattttttgaatatcattccatatcgcagttagccgaatatttcctgagtcatcacggcgaacgaatgatgaaactgctgaacccggccggcaaatctgagcttgtttcatatgaaaaaaagcaaaaaagaaaaccagtggaaacaaaagcgccggcacgctctgaaggagaaggttcaaaagagcacattgcggccgatcccctttctgctgatatagccattatcggtgtcagcggcagatacccgggtgcggaaaacatcagagagttccagaatgtgctgatgaatggacgggattgcgtaagcgaaattcctgatgaccggaaggaaatgctcgagggaagctgctataagtggggaggttttctgaaaaatccagaccggtttgatcctttatttttccggatatcaccgaaagaagcggcttttcttgatcctcaggaacgtctctttctagagacggtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcgtatttctttaattttaaggggccgagtatggcggtggatacaatgtgttcatcctctcttaacgccattcacttagcctgtgaaagtatacgaagaggagaaagcacacttgctgttgcgggcggagtcaatcttacgcttcatccgaataaatatacattattaaatcaaagccgcttctttgcaagtgatggccgatgccgtacattcggcgagggcggtgacggttatgtaccgggagaaggagtgggctccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaacttctctgggagatccgattgagatcaccggattaacaaaagcgtttcgggaatttacggagcacactcaatattgttcaatcggttctgtcaaatcaaatatcggtcatcttgaggccgcagcgggaattgccggtttgacaaaggttcttttgcaaatgaaattgaaaaaactgtttccttccatacatgcggagacgttgaatccaaatattgattttaaagcatctcccttttatgtacagcggtcattgcaagactggaagaaaccgaaactgcaggaaaacggaaaaacagtaactgttccgagaagagcgggaatcagctcattcggagcaggaggaacgaatgttcatatcattatagaagaatatgaagaaacaaacgtctcaacagaacatgttgagaacgaaccgcatattgtcctgttatctgccaaagacaatgaacgtcttcttgagtatgccgaaaacatgaaagattttattcagcgttcactaagtcctgaagtaaaggataaacagcctgatatgaaagaaaaggtgaatgaagtactcaaaccgtttgtttcggaattgcttcatattcatccggaagaaattaatatttctgatcacctgagtgaatttggcgtaggtcctttggaattaagccggatggcggattttattaacgaaatgtttcatattgaactcagaatgtatgaattaacggattgcctctccattcaagcggttactgaatacttacttaaggaatatgccggagcgataagagacatgttcccgaatgaagtgatggaaggcggccaatcggaaagcgtcgttttacgggatcttgcatacactacacaatcgggcagagaagcgatggaggccagagcggcgattaccggtacctctcttaaagaaatgaaagataaattatctcagttttgccgcggtgacaagcaagttccaggcgtatatgttaatcagcaatcagatgcatttgctgaaaaaatgaaggcgttaacagaaggcagagcaggtgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaggacagagatccctcagcattcttctcaacatcacttgcaaaaaaaatggagggagaatccgtttgtaaatccatccgaaacaaaagagtacggactgacagtcgcatttgtgaatcaagacacagaatcaattgcccgcaccatttgtccggatatagatcaggagaatctgattgtcataaaacatcactcttcatttataaaacactctgatcaaatgtttgagtgttctttattagatgaaacccacgcatacgacgttatctgtgagatcttctcgggcggtgagcggcaggtcgaaaatatatttgatttctcagatatcggaaaccagagtgaaaatcagaacggcatcccatatggtaaattcttatttatacaagaaataattaagcggagtaaaaaggaaacaccattatccattttacaactaaccaatggcttgcaggtatttaaagcggaaaaaccaaagctgacgggtgcagaatcagcggcttttctgaaagccctttctgcggaatacggctttgttcatgtgaaaacaatagatatagacagcatgaaagaaacgcataagctgaaacaaatctttgagattgaaagggcgcaatgtaccggagagaatgaagtatgctaccgcagcggcgtcagatatgttccgtattttgaagaagaaagaatccataccggcggcggtcctgtttcatttcctgcggataaagccatcgtcattaccggcgggacagggggcattggcagagcaatagctgaagatttggtgaaacggggagtgaaaaaactcgtgctgacgggtacgcgtccattacctttgcgaagtgaatgggatcatttgctgaaagagggcagacaggacgaaaagacagtcagcaatataaaactgtttcaaagttttgaagaaaaaggtgtcgactatctgtattacagcggttctctcacaaatgaagagaagcttcgatcattctttcaccaagtaagccttgaatttaaagatattagcggtgtcatacattgtgccggactgcacagcggcggaaatccggcctttattcataaaagaatgagtgaatttaagacggtgtacgggccgaaagtcactggacttcagaatttggagcggatttttaataataggccgctggatttctttattctgttttcatcaattgcagcacagtcacccaaactgtcgaaaggaatgactgattacgcgtctgcaaatgcatatatggactatttcgcggcttatcattttcaaaaggggagaacgtatttcacgtccatcaattggccgagctggaaagaagtcggaatgggtactgtgacgagtcctttatatgatgaattgggattggactctctatccacgcgggaaggactggcgattttgtatcatgcactggagaaaaaatcggccaatatcattcctatcgtgaaaaaaggaacagtgtttcatgcagacagtctcctgaacatcaataaaaccggcaagacttcatttccggtccgaagacaggtgactcccggcacttttgatcattcagaagggcttgtcagtgaactttctgccgtatttgccgaggaattgagcataccccttgaaaagcttaacccaaatacggattttcaggaatacggtgtggattctatacttcttgtcagcattatacatcgtatagaagcaatgattcagaaaaaaatcgaccctactgtgcttcttgaacacaacacgattcatggtctcgcggaatatatcggtaagacggcgccgccgttgaaaaaacaaatcgaacagactgattctcaaagcagcaatcagcatgatatgcagtctgtgacgagccgaaatacagaaccgcagacggcttcctctgcaaagatagctgttatcggaatcggatgtaagtttccgggcgcggctgataaagaggaattttgggacaatctgagaaaagggaagaatcatattaaagaagtacctgattcccggtggaatatagaagaaaattactctccggtgcagcaaaagggaaaaagcatcagcaaatggggaggatttatcaatggaatcggcagcttcgatccggagtatttccgtatggaagaggagaaagccatccaaacggatccgctgataagacatttcttagaaacgagtgtacagactgtacgggatgccggttatgaagaaacagaattatcgggaaaaaaagtcggcgtatttgtcggttccagaatgggcggatacggtcacaaactgccgaaagaaagcagcagccacatcgtcgggcttagtcaaaactttattgcttcacatgtgtcgcatttctttaattttcacggtccaagcatggtgtctgataccgcttgttcttcttcattagtcagcattcatttagcctgccaaagcataaaaaacggtgattcagaaatggcgctggcaggaggggcggatctgcttttggatgaaattccttatctgatgttaacagaaggaggagctctttcgccggacggtcagtgttttacttttgatgaaagggcaaacggctttgtacccggagagggttttggcgctgttctgttaaaaccgctggagaaagcaaaagctgacggagatcggatatacggtatcattgaagcatcagctattaataacgacggtgcgacaatgggaattacgactccgaatcctaagcttcaagagcaggttattcaagatgcatttgaaaaagccgatatcactcccggatcagtcagctacgtcgaaactcacggcacaggcacgatgattggagatccgattgagcttcaggctctgacaaaagtattccgaagagacacaaacaaaacgcaattttgcggagtaggaagtgtaaaaaccaatatcggacacttattaagcgccgccggagcggcaagtttcattaaagtgattttatcaatatggcataaggaaattccgcctacattgaattgtgaaacgccaaatccccgctttgaatttgaaaagtcgcctttttatccgaatacagaactgagaagctggaaggatggaaaacggagggcgggcatcagcgctttcggtttcggcggaacaaacgcccaccttttggtaagcggcctggatgattcatatcattccgtcagaactccgctgccgcctgccgagtttgtcagaaaagagtactggccggattcaaatcgaaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgagaaagggatatcaccccgaagttttgaaatcaaacatgttttattccgtgaacctgttgcgacgtcagtccattttgataaaaaagtcaccttccagtttacggaacaagaaaacggctggcttgttgaaacaacaagcaggaaatgggtcgctgaaaaggcggaaggtgaagcgtcagtcaacttgcaggcggaaatcataagaaaaaatgcgatagacgaaaagacaatttcaatcgaagcattaaagaaaggggccgtccggacttcgaatgctgaagccgcctatcgtaatttgcgcaggggcggcctgattcataaagattttatgaaattggaaggtacggtatatgaaggtgaaaattatattctgggagaggtcagtttaagcggactttcaaaagaatatacagatgacttttacatgcaccccgcatttttggatggatctctcagcctgttgggagtccttacatcagacttgccggatgaaggaacaaatgcgtttatccctatatatattgagacattccgggcactgcataaaacaaccgggtcttgttttgtgtatattgataaaaaaagtataacgcagccgccttctaaagacattttatatgcggacatagaagtatacaggcctgatggagagcttgctttttattatgagcgattcggtgtgaaaagagtcagaaatgaaaaatcaatacaaaggctggagcattcccaaaaagctaaagaggtcggcagcgtaacgaacaataaagaaatgatcagaaataatttgatccaagagatagccggcatgattgaaaagcctgctgaaacggtgaagaatgatatttccttttacgagatgggcttggattctaaacagttattagacttatccaaaaaattagaactgatgttaggttcaaagctgtacccgactttattatttgattactccacaatcggtgaattgacagaatatctgcaggagaaatacggagctcgcgttacagactctatctctgatacagttcagcaccaagacagtcaaaaaacattaacagatgagctgtcatccattattggagatgtgacaaacacgccgccaaataaagcggacaaacatcaatctttttacgaactgggtcttgactcaaaacagctgcttcatatatcgaaaatgctcgaggaaagattggatacacaattgtatccgacattgctttttgattataacaatattcatgatttagcagcttatttagaagaaaaatatgatgtgcgtaatacgccggccgcagcttttaaagaaaaaacgcaaacgaaagagccgtctgaaaagccgatgcttgaatctttatatttacaaaaagaatggatagaatcgccattaaagtccggagaagtgcctaaggaaaatacattgattttcgatttcggcagttcattgagtgatgaaatccgaaagtacatcggcagtgaaaatgttatttatgcggaagccgccgctgaatatgaaatggtaaatgaaaagcattataaatttaatccggagcagtctgctcattacaccagactgttagatgatatgaaaaagtccggagcgtttccggcgtcaatcattcattacctgtcaaaaaaagcttatactgaggcagcgttagatttgactcacagcttttattcaatcctttatttaagcaaagcgttgatccgtcaaaaaataaaagataacatcaaccttttgtacgtacatgacaaggatcaatatacaaatccgatttacgccgcgattggaggcttttttaaaacgctgaatgcggagcagccgaatataaagtgtaaaacggttgagatttcttcaagacaaaccattgaaaaagcatctttacttctcaatgaattaagtgccggacatcatgaggctgtgaaatatgacggcgatcaaaaaaggcgggtgacagcatacaaagatgcttcgctgcaaccagggcaaaaggccgcaaagtttgtaaaaaacggagtgtatctcatcatcggagggttaagcggcatcggctggattatttcagcgtttatttatgcaaatcacggagccagcgttatcattgccggacgatcgaaaatgacagcagaaatggaagaaaaattagacagcatccgatatgacggggcaaacatttcttacatccaggctgacatgtcagataaacagcaggtcatcaatttagcggaaaaaattcatgctgattattccgaaatcaacggggtcatttacagtgcaggcgtgttaaaagactctttcattatgaataaaacagacgcggaagctcaggcggtgctgcaatcaaaggtcaatggtgtgattcatttggatgaagcgctcagaaatatgcctttagacttttttgttttgttttcttccatctcttcagaaatcggaagtctgggtcaagccgattacgcctacgccaatcgttttctggagcattttgccgagtggagggaatgtatgagaaaggcggggggaagatcaggaaaaaccatcgctgtaaattggcctttctggaaggacggaggcatgtcagttgatgccggcattcaagacattatgaaaaccgattacggactgcacccattagaaaatactgccggaatcaaagcttttgaacactcgcttctcggccaaggccaccagctgatcgtgttatacggagaaaaagaaaaaatacaaaatgatttcaatccgttatctgcccgttcagcaccgcctctggtaagagattcagcgattgcagccgattttgatgcttcgtcaatcgttacggaagaagaagctgaaagtcctttccgaatactcggcacagcttccaatcgtcatctcgacgattatttgcattattggagcagactgaaggaaggagcccttcagcacgatcaaagcgatgccgcaaaaaaactcatcgctttttaccagacagaagaaacggaaaccgttcattttctggcaaacacagaaaatgcccggcatatggaaatattgatgagcggtaagggtgaaacaattttactgatttgcggttttgctaccactgcttacatgtggaaagaacaaatgaaggagtgggcagaccaatttaatgtaattgtcatccacacaccgggttacgggctgagtgaggggagcgccgattttacactgagcgggctggctcagacttttattgaagtgctgaacgagataggggttgcttggccgatccacattgcggcagcttcttggggaggcatgataggacagaggatagcctatgaataccctgaaaaagtaaaaacactcattctttccggaagttacaccgaatacgaagaagaccctgaaagcagtgttgaggaaaaactgaaaaatgattttatagctataggaaaatcgcatgaatatgaaagtttatacaggaatcaattcttaaatgcttctattgaacgttttatgaagatacatcaacaagaaggctattctacgatcggctttttaaaagacattcatacaagaacgcttatccttacgggagagaaggaaagcgtagttgatcagaaagaaacaaaaaggctgaagaaactgctgagcaatgcagaattaaagaaaattaagggagcggggcatcttccgaacatcacacacccggaagaatttaataaagcggtgtcagaattcatcaagaaatcagtaagtaagggatgaaaacgatacatacagtacagggggagaaaacaatgaaacaaacaataagcaatccggcatttgatatgaaacaaattaacgctcttaacagccattatcagacgatgatagacaatggagatctgcaatgtgcgagttatatgatatcaagaggaggcgaggtttttgcggctgagtcgttaggggaatttaccggcggacaaaaagaaaagcaaacatttcagcttgatacaatcagagaaatcggttctttgacaaaagtgtttaccgctgcagccgtcatgcagctcgtcgaaaaaggtctgctcgatctgaaaatgccggtcaagctcattttgcctgcatttgataaaccgggtttcggagacattaaaattttacaccttttgactcatacggcgggattaagttttgagctggatattcaaaaggctgaaggcattgacttaacgaatgaggaagaatggataaactatctggtcagtacgcctttagagtacggagtggatgaagcatggaactattccagaaccggctttgtcatacttggcatcattatttccaaagtaacaggcgtgtcctacgaacagtatgtaacaaagcatattattgaagcgctcggattagaaagaacgtttttttatgtgcctgatgctttaaaagaagaagtttgtgtgatcaatgagcacgagtgcgtacagctggaaaaaagtcatcacccgcattttccgaataaagcgacaagcggtctgtactcttctttggaagatatttggaagttggctgaaatgtttagaaataaaggcagattgaaagataagaagctgcttggaagaaaaacagtcgaggccatgctgagaaatcaaataaagcccggtcttcctttttacttcttcggagcgcccagagaggagggcggctttggtttaggcattaatttgtggccggccggtgaccattatttcatgacagaaggcaccttctcacatcttggaatgggttggtgcggcatgttttctgatccagccgaagattttacgtatgtatttttcactccgatttccgagtttcatcctcatgccgtgctgacgccgctgaatatcgtgtgggcgggtattgaataattagacaaaagcatcgtcccgcctgtccggcaggcgggacgattgctaactgcccgtttttatcccgcggcaccttctcaaagcctgccctcgaagttaaataacttaatttactctttgtaattttttttaattatagtacagtagagcgtttttataatacagtttaaagtcttttatagtacagtttggcgcagtatgatcttaagttttataagcggtttcaaaataaggttataaataattgacggctttgtttaattactgtaaactatggttgttgatcatattgtactaataaaaaatctttttttattagtacagtttaaacgtcattatctttgcttaagcgctatgtgaatttctgaatgattaattttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattaataagcagtttgaaacgttccaaattttaaatgctgaaggagaagtcgtaaataaagacgcaatgcctgatctttcagatgatcagttaaaggaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcaactgatttggcacgggcttcctttacatcaggcattcctgttctcaagaggccattttaaaggtaatcagatgcctgagggagtaaacgctttatcacctcaaattattattggtgctcaaattattcaaaccgcaggtgtagctttaggtcttaaaaagcgcggtaaaaaagcggttgctattacttacactggtgacggcggagcttctcaaggtgacttctatgaaggaatgaactttgccggagcatttaaagcgccggcgatcttcgttgttcagaataaccgctatgcgatttcaactcctgtagaaaagcaatcatccgcacagacaattgcccaaaaagcagttgccgtcggtattacaggtgttcaagtagacggaatggacgcactagccgtttacgctgcaactgcagaagcacgccagcgcgcaattaacggtgaaggtccgactctgattgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttgaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccagttcttcggattcgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaagaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagtccgcttgatattgatacgattattgcttctgttgaaaaaacaggccgcgcaattgtcgtgcaggaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcttaaaagacggtaaagagagtccttttctcttatgatgaaggagtctgtttactaggttcaatgcttgcgtatgcataactaaaatttgcttaatcaactaggaggtcgaaaactgtggcatttgaatttaaacttccggatatcggggaaggtatccacgaaggcgaaatcgtaaaatggtttgtgaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaatttaaaggaagccatgattcaggagaggcgaaaactgaggctcaagttcagtcgtctgctgaagcagggcaggatatctctaaagaagagactcctaaagagcctgcaaaagaaaccggcgcaggacagcaggaccaagcggaagctgatccgaacaaacgcgtgatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcggcaccgcaagaaacagctgcacctcaggaaacagctaaacctgcagcggctcaggctcctgaaggcgaattccctgaaacacgcgaaaaaatgagcggtatccgtaaagcgatcgcgaaagcaatggtgaactctaagcatactgcaccgcacgtaactcttatggatgaagttgacgtaacaaatcttgttgctcaccgtaaacagttcaaacaagttgctgctgatcaaggcatcaagctgacttatctgccttacgtcgtcaaagcattaacatccgctttgaaaaaattccctgttttaaacacatcgattgatgataaaacagatgaagtgatccaaaaacattacttcaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaactcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttgtaaacggggaagcttatttcgtagacagcaactctgtccgcgtaatggatgagaactctgcgcaaacatacacatttaaaaacgcgatcattgctaccggttctcgtcctatcgaattgccaaacttcaaatatagcgaacgcgttctgaactctacaggcgcactggcgcttaaagaaattccgaaaaagctcgttgttatcggcggcggatatatcggtactgagcttggaacagcgtatgcgaacttcggaactgaattggttattttagaaggcggagatgaaattcttcctggcttcgaaaaacaaatgagttctctcgttacccgcagactgaagaaaaaaggcaacgttgaaatccatacaagcgccatggctaaaggcgttgaggaaagacctgacggcgtaacagttacattcgaagtaaaaggcgaagaaaaaacggttgatgctgattacgtattaatcactgtcggacgccgtccgaacactgatgagctcggccttgagcaagtcggtatcgaaatgactgaccgcggtgtcattaaaacagacaagcagtgccgcacaaacgtaccgaacatttacgcaatcggtgacatcattgacggacctcctttggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttcccgtttgcagcaaacggacgtgcgctgtctcttaacgaaactgacggcttcatgaagctgatcacccgtaaagaagacggtcttgtaatcggtgcgcaaattgccggcgcaagcgcttctgacatgatttctgaattgagcctggcgatcgaaggcggaatgactgctgaagatatcgcaatgacaattcacgctcacccgacattgggcgaaatcactatggaagctgccgaagtagcaatcggaagcccgatccacatcgtaaaataatgatgtaacaaagaaacagcccccgtttgtaaaagcgggggctgtttttattgtgcaagcacatgctgcataggtttgatgatatcctcttttttctttacggatccctcaatcttcatgaccacatgccgatgattgatcaccatcagcgcagggaacgtgttgatttcctcttcccatccctttctgttgtcataaaccttcatttgatcgacatgatggggatatttcttttctaaatcaagaatcgcatcgtaataaggaacttctttatctatatgattttcatcggaaaaaaacaagatttgagtgtgatgaatgctgtcgatccggttatttttgaatggaatgacagtagaaaccgaacagcttgacagaacgaacagcatcaaaaaaaagggaatcaccgtacggtagcgcatctatcttactcctctgttttatataatatattggttcatccatttataaggactatattaagtgtatcacgagaggtgaaaaacctaaggcttgttactgaattgttatataattgaaaccgtttttaatgaagaaataatacgtgtgacaacttgcacagccgatgtgtaaaaaaggcacattgtttttcgtgagagcgctgttttttcgttatactgggggcaaaaccatatcaggagggattgcatgtataaagccattgcagccgtcatatgtatgtgcttactcgccggctgccaatcaaatgaaaagatgcaaacaaacaaaccccattctcaagccgcggccaatcatgccaaacgggaaaaccatcatacaaaagagaaaaaacagaaggcggagccccgttactatatcaatccgaaaaccttttctgtggaaaaaatggatgaacagaaagagaaaaaaccgatcgcattggtaacgatcgatgacgcccctgatcagcatgccgctgagattgcgaacaaactgcatgatctcaatgcgtcagcgatcttttttgtaaacggacattttttgaaaaaagatgaaaataagaaagcgcttaagcatattcatgagttaggttttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactatagtgacaaacttataaaaaaagaaggaatggtgaaaatgaactggaccttcgggtatgattgggatcagaaatatcaatccaaaaaagcgcttaccgatatcaccctgagcagtccttacctgcgggacggcgccaacatattgatgcatgaccggaaatggacggctgaagccatgccggacattgtaaaaggattgcgtcataaaggatataccgtgattgaccctcgagctataaaaagaccgtaaaaaataaatgtgttatacaatttatcggttgacatattaaatgtgacataataatataataacaacaagtaaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagagtaaaaagcgtaaaaggcccgaaacgatttcgtttcgggcttctttatgtttattggatggctttttgctctttgatgactctgatcatttcaagcgtggcatcttcgggaccctgcacaggaaggccggcgtccaagtttttaaaaatgtagctgatattttcttcagtaatgatctcacccggaataaagatcggaattcccggcgggtacaccatgacaaactctgcaatgatccgtcccgcggattctgttatcggaatgacttccgtatttgcgtaaaacgcgtctcttggcgtcatcgctaacagaggaatctcaggaagcagaacttccgtttgctgatgagcatagtcatttgcggaagcctgctttgaaatgtctgtaagcgcgcttacaagacggtcggcatctcctgctctgtctccgggtgtaaaaatacataaaatattatacaaatcggacagctcgacttcgatattaaatgattcgcggagccatttttcaacgtcatgacccgtcaggccgaggtttttgaccgaaatgattaatttagtcggatcataactgaaggcagctttagaccctgtgatttcttcgccgacacagcggatgccttcaatttgattgagacgttcccgtgtctgatccgccagcagaatcgtatcttcaagaagatcgcggccttctgtagcgaggcgttttcttgcgacatccagtgaagcgagaagcagataggatgttgacgttgtcgtcagcatgcttaaaatcgactgtactctttctttggaaacaaggccttctctcacatttaaaatggagctctgcgtcagggagcctcccaatttgtgcacgcttgtggctgccatatcagcgcccgcctgcatggcggacagaggaagcttatcatgaaaatgaatatgcacgccgtgcgcttcatcgacaagaacaggcacatcgaaagaatgcgcgagctttacaatgctgctcaagtcagctgccacaccgaagtatgtcggattgatgacaagcaggccttttgcgtcaggatgctccgtcaaagcccgctcggcggactcaagcgtaatgccgtgagaaattccgagctcatcgtcaatttccgggtgtataaaaatcggcaccgctccggaaaatacaatggccgacataatggatttatgaacatttctcggaatgatgattttatctccgggtccgcatacggccatgaccatcgtcataatggcgccgctcgtcccttgtacggaaaagaaggtatggtctgcgccgaatgctaccgcggccagatcctgggcttctttaatgatgccctttggcgcatgtaaatcatccaggggttcaatattaattaaatctatgcttaacgcgttttctccgataaattgtctgaattccggatccattcccgcgccttttttatggcccggaatgtggaattggacaggctgtctgtccgcgtgctttttcagtccgctgtacaggggtgtttcatgttgcggcaattgttttcccacctttatcataatacctaaagattagtttgtattacattcagttttattacccgttttttaaacgtaaaacaaatgaattatattatgaacttgaaagaaagtaaagaacaatttatgatctatggaagatgcttatttttgagcatgatgataaaggagtgaagacatttggaatatcaatatccgatgaatgaggactggacgacagaggaggccgtggatgtcattgctttttttcagcaggtggaaaacgcctatgaaaaaggagctgaccgagacagacttctgaatgcgtaccgccgctttaaagaaatcgttcccgggaaagcggaagaaaagaaaatctgcagccgatttgaagctgacagcacctattccccgtatcggactgtgaaacaggcgaaacaatcagatcaagcgattatcaaaatgtagacaaaagcgagccggcaatcggcccgctttttatgttatgagactttctgagtcagtgtgtataaaaaggaaagcttcctaaaagcatcttcaatggtttgcaggaattcattgttgttcatgttgatcacgtcttctttttgcagctgaatgccgcataaaagctctgcttttttcactgtctgcaggcgttcaaataatgttttcagctgctcctgatccatgtcggactgcttgtacgcacctggcttcgtatgatccggcgaccatacaaaatgaccgggaatctgttttgagatttcctcctgcttcgcttccagcaatctgccgtattcctcttttatcggagattcataaatgatggcaaaccatacaaacatatgggtgtcccataaaccgatctgaaagtgagggagtttcttatagccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcggatctaaaccttctattgtaaatgtatcgaagtcttcttttgtaaaacgcatctgagtcatctttttcctccttaacgtaagtattcatattttaccacagccgccgccggccgcaaaaacattgagaacgtttgagccgagaggaatggtggtaaaaaacgaataggtaaacacacaattttaagaatgttgttacagccgaatataagtttccatacgatataagaagtatcattaatgaattggaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtatgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaacaatgggtaaaagaagccggaacgagaatcagacaatccatgcaggaaagcttgacgattgaaacaaaatcaaatccgaatgatttagtcacaaatattgataaagagacggagcgctttttcattgaccgtatacaaggaacttttcccggacaccggattctcggagaagaagggcagggggataaactccgctcacttgacggaatcgtctggatcattgatccgattgacgggacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaatgatacgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccggtgttgcggccggccgcattgacgcatacattacgatgaggctcgcgccgtgggattacgctgccggctgcgtgctgctgaacgaagtcgggggcatttacacgaccacagacggcgaaccgttcacgtttttagacaaccacagcgtgcttgcgggcaatccggctatacataaaattatctttgacgactatttacatgctgacaggtagagattttgaagaagaagatctcgggtttctggagcagctggcggcatcacacccggtgtggaaaaacgaagagttcggaacaaaaaatgcggcggagtttatgcttgcatactccatgtacaatggaacgtggctcgtatgggagattgacggcgctcctgccgccgtcagttttcatttggaatgggccccttcaaacggaaaaccgtggctcggaaccgtggccgtcgctccggaggcaaaagagaaaggaatcggacgcacggtcattgaagagattgcgggccggctgagaggagagcataaagcgatgttttcagccgttcccctggacaggcaggaatgggttttgtttttaagccaatgcggctttgaacagcttaagcttgaaaaagacgatcgggaaaagacatatatgatcatggtgaagccattgtgaaatgttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcgatagtaaatctgctccgcttttttcacgccgatttttgtaatcgtgttgtaagcggctttgttcggaattccgctgtttgtatgcacgccgccgtagtcgccggcatcagtgttcggaaggttttgataatttttgtaatggtcgggctgtccgtattttgtcggattggataagctgcggagagccggctggctgaccgtaatatcctcaccgatatcccagtcctcagtatcggtgaagtacccgaatacatcggagaaggattcgtttaaagcgcccggctgattttcatagttcaggttggctgtttcctgtgtaacgccgtgtgtcatttcatgggccgttacgtccattgaaccggaaagaggcgagaagaatgagccgtcaccgtcaccgtaaatcatttggtcgccgatccaggccgcgttattgtatctgctgccgtaatgaacggaagatacgattttgccgcctctattgtcgtagctgttgcgtttaaacgtctgatagaaataatcatacactttgccgagattgtaatgcgcatcaaccgcagcgcgctgagaagaagttgtgaactggtttgtagtgcttgatacgagcgtgcccggcaggttatattgtcggttttgcagatcgtacgtaataatttgtgttccggtaggcttcgaaagatcacgcattacatatttgccgttttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgagtcggtatttaccgtcttttgtggccgctgctttcagctcggctttgtttttgtttgcaacgttgccgttagagacggcttcaggtgatttgccgattgctttaaaagcatgatccagcgcctgatttgcagataattttttgctgtttgccgttttggcagaagcatcgttgtttaattcaccgttaatcgcatagacattgttggatttatcgacgtgaataatgacttgcgagtctttcacaggcacaccgttaacgacaggcacataacggaagtgcttgtagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagacttcgctgatgaattgatagaatcgtcccgtaaaggcttcaggcgggcagcgtcaggggataagccgagaggcacgtgttgaatcaaacatgagtcgaatgatgcgatttattctgaaaaaaatgacaaatgaagtcgggagaaatgatagaggaaaaatgttccgatctgtaaaactttttttatagccgtttgtctaaacaggtgaggccttaataaacgaaaaggattgtttcagatgtcagagattttcagtcattttattcagcatttcgacagatatttcaagagctgtcttacgaagagattgctgatgttttggactggagtctttcgaaggtgaagagcactctgtacagggcgagaatgcagctgaaacagcacttggcggaaaaaaggaaggacggacagatatgacttgctgtttagtgagagatttactccctttatatattgaaggcgattgtgaaacagaaacggagcggtttatttcccgccactttgaatcatgcggtaagtgcgaaagtttatatcatatgatgaaggagccgcttgacctcggcagccccgagatgaaggagcccgcctgttatgcagaagaagaaaggcggtttaaggaacggtattacgggaagctgctgataaaagcagcctgtttgttcggcgctgttttctttatcatgctgatctttaaactgctgatttaaaaaaacgcccggctgcatgacatgaccgggcgttttatccgtttactcagccggatgaaaggctgtataaatgccttcaagcaagtcctgaggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagcggtgaacagctgatcagcgataagggcctctttttccgtaaatccgagctccaccgctttttctttattaaatgtatattcgccgtccgttttctcaatacattgagaaagaacggttaaaaattcggttgaactgtcccacagcttttgaatggtctgtgcggcttctttatctaatcccaattcaaccgctttttcaccgtcaaaataatagacgccgtctttttcgtaaatcgattggctgatgatgtcaatgagttttgccgcgtcttccggtgttttctctgcggaaacctgcagggtatgcggttcatttgcctggatcgtttttgcgccggcagaatcaagcggactgaatgcaagcaaggcggctgaggcggttgcggcggcagttacagcggttttcttcaaaaaagatgttttcatttcattctctccttgtcatgtgtatttgcttacagtcacaagtataaatagacaatgatggaattgatataggaggtatggtattttctgcataacgatgccggactatttcagactgcattttctgagggaatctgctgatgtaactagaatgggggccgtcattcccggcttcctgactaggcggcgggggagataagccttacatctggagtctgtttttgaggatgtaaaaaagcctgaatctttgattcaggcttcataagatattgtctttccatgtttacggaattttgcaaagggtcatgcttttaatcaagcagtccctgttcgcgcatttttttctttacggtgaaaccgcttcccatcatggcgataacgagaacaatgcttccgatgatgccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgaacgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcttatgaaggctgcatgccgcaaacccgtttcgtactgaaaaaagcccttgagcagaacttaaatccggttgtcgtcgtaaacaaaatcgaccgtgatttcgcccgcccggaagaagtcattgatgaagtgcttgatttgttcatcgagcttgacgcaaacgaagaacagcttgagttccctgtcgtctacgcttctgcgattaacggaacggcaagtctggatccgaaaaagcaggacgaaaacatggaatcactgtatgaaacgattcttgaacatgtccctgccccggtagataacgccgaagagcctcttcaattccaagtggcgctgcttgattacaatgattatgtcggccgtatcggtatcggacgcgttttccgcggcacgatgaaagtgggtcagcaggtttcattgatgaaacttgacggaacggttaaatcattccgcgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagcctacgcttcaaatgacatttgtcgtaaacaacagcccgtttgcaggccgtgaaggcaaatatgtcacagcccgcaaaattgaagagcgtctgaacgcgcagcttcaaacagacgtcagtcttcgtgtcgaaccgactgcatcaccagacgcatgggttgtttcaggacgcggtgagcttcacctgtccatattaattgaaaacatgcgccgtgaaggctatgagcttcaagtgtctaaacctgaagttatcattaaggagattgacggcgtcagctgcgagcctgttgagcgcgtgcagattgacgtgcctgaagagcataccggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgacgtcagggtgtgctcgtttccatggaaaacggaaaagcgacatcttacggaattcaaggtattgaagaccgcggcgtcatcttcgttgaacccggaacagaagtgtatgaaggcatgattgtcggcgaacataaccgtgacaatgaccttgttgtcaatgtcagcaaaatgaaacagcagacaaacgtacgttccgctacgaaggatcaaacgactacgattaagaaagcgcgcattatgtcgcttgaagaatcactcgagtacttaaacgaggatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtgagtgaacggctgtcgttctttgcggctctttaccaagtggatgagcatccgctggcgggaatgtggctgttatacggaacgatcgtcgtgctttcggtgattgtatttaaactcggctttgccaaacggctgccggttttgaaggctgcggcagtttatctctttctcgtgctcggctgcaccgtgctgagttttttcggtgtgtttctgccggtcggagaagggcttgttgttgccgccttgattttgatcatttacaaaatccgtctgcaccagtccaaaaaaagccagtcagctaaaccgcaataaaaaaatgaccttgccttccggcgggtcattttttattcggtttattttttcagtttatcttttttcgctttttgtccaggatgaaaggaaaagtgtccggtattcagccgcgcctccgttttgattttgattcggtcatggcattcccggcacatatatgtatgaatcggacgattgcggaggcgtttggctgtcagtgtttcatcatcaatttgttcgattttgtcgcaaatggaacattttactctcattgattttcacctctttcactatgacaagcattatatcatggatgcccctcctgccaaagggaaagaaagcagcgcccttcttttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcaaccgtgtatttaatgctctccaccttgcttctttctaaattgtcatccacatcgattccgacaacggagtatcttccgagtacaaccgcggtggcatctgaaatgccggggattttttcggttacctcgacgagatgcttagcgatgtctgtccggccgggattttcagctgtctcaggagccgtatttttcacatgaatcggttttgcatcacgctgatcggttgattcgttctggatattgcggccgcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggaaggctgcacgagaaagttccgcttgaaagcggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctagtcagcaaagatgtgcttgtcagggtaaaggcggatgccatcgggcttttggcggaggactttttaaacgacagagtcgttgaccatgatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtcaaaagactcgttttcgatgatgagcacgtatgggggatcaggccgaagaacgtccagcagacaatggcgctcgaactcctgctgagggaagatatcccgcttgtcaccctgatcggaaaagcgggaacgggaaaaaccttgcttgctctcgcggcagggcttctgcagacggaggatctcggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattattgatgaggctcagaatctgacgaggcacgaggtcaaaacgcttttgacaagggtgggagagggcagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccggaccgccgtcttgaagcggtttccccgcatcgctgaaatgcgcgattgcgtccatcgccttttcgagcggcacttcggttctttctgattttgaaataaatgcgcacaggacagcgctttctttcggctcggcatttgctaaaacagcgccgagcttcatggcgaagctgccgttcatcagtctttctttttcataacgtttttcgctctttaaagtcggcggcgaaatgcgcccttctctgatcacccgttcaggatcaagcgtatgctcctgggtttctgcagagccgtccggatgaacaggctgattgttttcaaacggaaatttgcggtcatcgaaaatccagacactcggatcaattgtaatcgggtatgtaacattgccttttacttgaataacgctcatgttgaagcccccctttacttaaagtataaaagttttcgcatgaattgtcactttgcgtcgcaaattagatgtatacaacggcagcgaagtgaggatgatcgacatggtatgccggcattaccaagagctggacgcattagttcaggaagcgaaaaaaagaaccgaagaaggcaaagtagcagactatattccggctctggctgaatctgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaactccatgattaagcttgaaacagtgaatccgggcaagcctttaaatccgatgattaatgcgggagctctcatcgttacgggtttaattaaagggcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacgggaagcatccggaaaccggggagcaggtcattaaaaaagatgtggcgagaatctgcaagacgtttatggtgacatgcggcatgtacaatgcgagcggggaattcgcaatcaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgtttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcggattggtaatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgcccatcaaaagattcagaaaatcatactgcttgcgtcagtggctgcgctttgcgcgctgtttgttttcggacatgttgccggaaatgcgcaaagctggtttaaaatcggcggaatggccattcagccgggggaatttgtcaagctgaccctgatactgtatcttgccgcggtgtacgcaaagaaacaaagctacattgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattactccttgtcagcccgatcatttatctgaaatgggacgatattttgacacccgggcgtatgagccggtttgaaagccttgaaaatccatttaaatacgccagcacatcaggtctgcagattataaattcgtattatgcgatcggctcaggcggttttttcggtctcggtcttggagaaagcattcaaaaatacggttatctgcctgaatcgcatacagactttattatggcggttatttcagaggagctcggcattttcggcgtcctgtttgtcattgtgctgctggcttttgtggtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacgggggctcatcaatgtttttgttattaacgagcgccggtatattggtgaatgtcagcatgcatgtcaagtactcagaaaagaagaaaaagagggagcctgttccgtctaagggggtaaaaagacggcagacggaaaaatctgtgtatctctaaaaaacaagtgtatacacagggcggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagactcgggctcctatcatcgctataaagcggatgaagcttatcttgtgggggaaggcaaaaaaccgattgacgcgtatcttgatattgaagggattattgagatcgcaaaaagaaacggcgtagatgccattcatccgggctacggatttctctctgaaaatatccaatttgcgagacgctgtgaagaagagggcatcgtattcatcggaccgacgtcagcgcatttggatatgttcggagataaggtaaaggcgagggagcaggcggaaaaagccggtatccccgttattccggggagtgacggaccggctgaaacattaaaagatgtcgaacaattcgcaaaagtccacggatttccgtttattattaaagcatcgctcggaggcggaggccgcggaatgagaatcgtccgaagcgaaagtgaattgaaagaatcgtttgagcgggccaaatcagaagcgaaagccgcattcggaaatgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaagtggcgccgagtgtatctttgcagcctgaattaagggacgaaatctgtgaagcggctgtggcgctcgcgaaaaatgtcggctatatcaacgcggggaccgtggaatttctcgtagcgggcggtgaattttactttattgaagtgaacccgcgcgtacaagtggagcatacgattacggaaatgataacgggggttgatatcgttcagacgcagatcctcgtcgcgcagggccacggactgcacagccgcgccgtcaatatcccagagcagaaagacatttttacaaacgggtatgcgatacaatcacgtgtgaccactgaagatccgctgaatgactttatgcctgacacgggtaaaattatggcttaccgctcaggcggcggtttcggcgtccgccttgatacgggaaacagcttccagggcgccgtcatcacgccttattatgattcactgctcgtcaagctgtcgacatgggcgctgacgtttgaacaggcatcagcgaaaatggtccgcaacctgcaggaattcaggatcaggggcattaagaccaatattccgtttcttgaaaacgtggcaaagcatgaaaaattcctgacgggccaatacgacacatcgtttatcgacacaacgcctgagctgtttgttttcccaaaacagaaggaccgcggaacaaaaatgctttcctatatcggcaatgtcacggtgaacggttttccgggaatcgggaaaaaagaaaaacctgcatttgataagcctcagaccgttacgttagatatcggggaaaagccggcaagcggtacgaaacagattcttgatgaaagaggcgccgaggggcttgcagactgggtgaaagagcaaaaatccgtgctcctgaccgatacaacgttcagggatgcccatcagtccctgctcgcaacacggatcagatccaatgatttaaaaaaaatcgcgaatcctacggctgccctgtggcctgaactgttcagccttgaaatgtggggaggcgcgacatttgatgtagcgtaccgtttcttaaaagaagacccttggaaacgccttgaagatctccgtaaggaagtgccgaacacattgttccagatgctccttcgttcatcaaatgccgtcggttatacaaactatcccgacaatgtcattcaaaaatttgtccggcagtcagcggagtccggtattgacgtattccggatctttgacagcctgaactgggtaaaagggatgacgctggccatcgatgccgtccgtgaaaccggaaaagtggcggaggctgcgatttgttacacgggagatattcttgataagacccggacgaaatatgatttgcaatattatctttctatggcgaaagagcttgaggcgtctggtgcgcacattctcggcattaaagacatggccggtcttttgaaacctcaagccgcatacgaacttgtctcagcgctgaaggaaacgattgatattcccgttcatcttcacacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcgcttgaaggaaacagccgccgtcctgaaatggatgtccggcaggtggaaagactgtcacaatattgggaatccgtccgtcagtattacagtgaatttgaaagcgggatgaagtctccgcatactgagatttataatcatgaaatgccgggcggccagtacagcaatctgcagcagcaggcaaaaggagtcggcctgggcgatcgctggaatgaggtgaaagacatgtacagcgtcgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggccagccgcacggcggatttccggaaaaactgcaaaagctcgttctgaaaggacagacgccgatcacggtaagaccgggggagctgcttgaaccggtatcttttgaaggcattaaagaagaatggaaagaaacgcatcagatggaattgagtgatcaggacgcaatcgcgtatgctctttatccgaaggtgtttactgaatatgttaaaacggctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcaacacgtgtcgtttatttcgaattgaacggccagccgcgcgaggtggtcattaaagatgaaagcattaaatcgtccgtgcaggaaaaattaaaagcagatcggacaaacccaagccacattgcggcatctatgccgggaacagtcattaaattgttaacggaaaccggggcaaaggtgaataaaggcgatcatctgatgattaatgaagcgatgaaaatggagacgacggtacaggcgccgttctccgggacgatacagcagattcatgtgaaaaacggtgaaccgattcagacaggcgatttactgatcgaaattgaaaaagcgtaaaaaatgaacataaaaaaccctgatccgccccgtgtgcgatcaggttttttatatgtaaaaaggccgaagctctgatgcttcggccttttcgtgtgcctcagatgttccgctgttttgattcatagcggaagcgggcgattaataataagaaatagcataagacgccgaacaggccggcaataaagagcgaatgggcaagtgcaaagccggtggccatttctgaataaacaaccatgattccggacagcgcctgtaatacaacaaaggcaagagccgctatccagcccccaagaatctgtttttggtctttgtaggagcgcaccgcatgcgcaaaagcgacaagaatccatacgaacagaagcagcgctgccgttctgtggcccatctgcacccattcctgaaaatgagacggaaacccgtggttcagcctgctgcaaagcggaacgtcagggcaggcaaggcttgatttcgtatggcgcacataagcccccgtataaacgacgatatacgtgtaaatcgaaaggccgatcatatgaaactgcattttcctgccgattctgagcggcttgacgagctttttgtctgatttatcagcttcaaatatgagaagcgtcaaaatcagaacagaagcgaaagaaatcagcgatatgccgaaatgaagcgccataacgagcgcatttgatccgaaaacaaccgctaatgcgccgagaagcgcctgtaaaaataaaaagataatggacataatggcgagaaaggttgtttcacggaaaacaggcgtgacttttctccatgcccaaaaagcgagactcagcacgagaacgattgagacaccgcttgcgagtctgtggctccattcaatgatagaagcggcgttaagctccgggaaaaaccggccgtggcaaagcggccactgccttccgcatccgagacccgatcctgtttttgtgacaagagcgccgccgatcagcacgacgagcataacgaacgtcgtcagcacgccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattatgaaaccggcggatttggtaaaattcataaaaagttcacaaataaattcctgtttctcgtttaatatttaattggtaaaattcataaaaagttcacaaataaattcctgtttctcgtttaatatttaattggtaaaattcataaaaagttcacaaataaattcctgtttctcgtttaatatttaattggtaaaattcataaaaagttcacaaataaattcctgtttctcgtttaatatttaattggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgaccgtgatattgatcatttaatggaacgcacgaaagtaagaccgacggtaaccggaaagattcagccgaatcaagcgctgtggtcaggaattttactcattgctttaggacttatcatgcttttgatgaccaccgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacggcggttgaagggcacatcggtgttgtcgcgtgggttttattcatgattttattcatctggcagattccgcactttttagcgcttgcgattaaaaagacggaagattacagagcagcgaatattccgatgcttccggtagtgcacggctttgaagtgacgaaaagacagattatcgtctgggtcgcatgcctgctgccgcttccgtttttcctcggcagtctcggtcttccgatcgtcattctcggcactttgctgaatgtcggatggcttgttctcggactgatgggattccgcatgaaaaacatcatgaagtgggcaacccttatgtttgtctattcgcttaactacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtataggggaagacacgataccgaaacaggtggaggggaaccgttttttagaaatcacctggaccgttattccgatcctgcttctgattattcttgtcattccggttgtcatcgatacattggcactggcggatacgtcgccgatggataagaaaaaccgtaaagcagaggatgcgctcgtgattaatgtaagggcgaatttatactggtgggaattcgagtatcccgattacgggtttgtgacaagtcaggagctgatcgttcccacagatgaacgcgtctatttcaagctgaagtcctcagatgtgaaacactctttctggattccgtcagccgggggaaaaatcgatacgaatacggataatgacaacactttctttctgaccttcgattctaaacgcagcaaagaagcgggagaatatttcttcgggaaatgcgcggagctgtgcggaccttcacatgcgctgatggatttcaaagtgaaaccgctgccgtcaaaagaatttaaacaatggacgaaagcgatgaaaaattataagcatacaacagattccggtttagccgcgcaaggagaagagctgtttaaggagaaaaactgcctgagctgtcatgcggttgagcccaatgataaacgggctgaagcggcaagaacggctccgaacctcgctaccttcggtgaacgggtcaaagtggccggcattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcaggggggaggtcgcaaatgatgaatacgcttacaggacagcaaagaaaaagctctttgctttgggattatttgacgacggttgaccataagaaaatcgcgattttatatatgatcgccgggggatttttcttcgtcgtcggcggacttgaggccatgcttatcaggattcagctcttgaggccggggaacgattttatgggtgctcagcagtttaatgaaattatgacgatgcacggcacgacaatgatcttcctggcggcgatgccgctgttattcgggctgatgaacgcggttgtgccgctgcagatcggggcgcgtgacgtatcattcccatttttgaatgcgctcggattttggctgtttttcttcggaggcatctttttgaatctgagctggtttttagggggcgctcctgatgcaggctggacgtcgtacgcgtcgcttgcgctgaattcgaaagggcacggcatagactttttcgtgctcggcctgcaaatatcaggcttaggtacgctcattgcggggatcaattttctcgccacgattataaatatgagggcgccgggtttaacgtatatgagactgccgctgtttacgtggacgacatttgtggcgtcagcactcattttattcgcatttcctccgctcaccgtcggtttggcgctgatgatgctggatcgtttgttcggaacgaatttctttaatcctgaattgggcggcaatacgattatctgggagcatctgttttggattttcgggcatccggaagtatacattttaattcttcccgcctttgggattttttcagaaatcattcccgtatttgcgaggaaacgtctgttcggttattcgtctatggtctttgcgatcgtgctgatcggctttctcgggttcatggtatgggttcaccacatgtttacaacgggactcggaccgatcgctaatgcgatatttgcggttgcgacgatggcgatcgcggtgcctaccggcattaaaattttcaactggcttttgaccatctggggaggaaacgtcaaatttacgacgcctatgctgtatgccgtcgcctttattccttctttcgtactcggaggagtcacgggtgtcatgctggcggccgcagcggcagattatcagttccacgatacgtattttgtcgtagcgcatttccactacgtcattattggcggcgttgtgttcggcatcctggcgggcgtgcatttctggtggccgaaaatgttcgggaaggtgcttcatgaaacgatggggaaaatttcgttcgtcttattttttatcgggtttcatcttaccttcttcattcagcattttctcggcttgatgggaatgccgcggcgcgtttacacatatctgcccggccaggggcttgataccggcaacctgatcagttcaatcggcgcgtttttcatggcgggcgcggccgctttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtggcagcgttcgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgctggaggggaaaaataagtttttgggattttggctgtttctcggcggcgaaacggttctgttcgcctcgctatttgcgacattccttgctttacgggaatctaaagccggagggccgtcaacggctgagatgtttgagctgccgatcgtgtttatcgcgacgatgcttcttttgacgagcagcttaacgagtgtgtatgcgatgtatcatatgaaaaatttctcctttaaaaaaatgcaggtgtggcttctggttaccgtattattgggagcgggatttttaggggttgaaatctatgaatttatgcattacactcacgagttcggatttaccattacaagctctgcgctcggctcagcgttttacacgctcgtcggcacacacggagcacacgtggcgttcgggctgttgtggatcagcgcgctcatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagagactgtcagtacgaatcttgaatatcggagaaggaaaaatgccgaggagatgaaatatcaggtcatctccttcggcttgatgatcggccttacgcttgtcgcgtttttgacggtggctgcagacggcattgccggatggtttacgatgccgtttctgatcctgcttgcggtcattcaggtcatctttcagctgttttactttatgcatatgagccagaaggggcatgaagcgccgtcattatttctgtattcgggaatatttgtcgcgtttatcaccgtgcttgcatttgtcacgattatttggtggtaatcggggcagcggggagtgagagatttgattaatttggaaatgttcgggtttcgcgcaatgtggagcccgtatctgttttgtataactgccgtgataacaggtgtttacttttactggtgcagccggcataaaggacgtgtggccgttaaggagaaggtgctgtttgtgctttccgcgctatttttttacgcggctgcgggaagtccggtcgatttattgggccatgtgatgttcagcgcccatatggcgcagatggcggttctgtttttagtcgtaccgccgctgttgatctccggaattcccggctgggcatggaaaaaactgatcttccgtcctgtcgtaaagccgctgttttcgtttttttcaatgccgcttatcgctttagtgctgtttaacggtattttttcgctgtatcacatcccgtttatatttgatttcgtcaaaacggattcgctgtatcacacgctgatgaacggactcatctttgtaacggcgttttttatgtggtggccgcttgtgcataaggtggacggtctgccccgtctcagcggtttaatgaagctggggtatattatggcggacgggattttgttaacgccggcctgcgcgctcattatgttcagcggggcgcccatgtatgccacgtatacagatccggcggcttgggccgaagcaatgaagctttgcgttcctttagatttgctggaggagatccctttatccgggccggagatgtttaacacgctacctcctctggaagatcagcagcttggggcagtgctgatgaaaatcattcaagaggcggtctacggaatatatttggctgtcatcttttttcagtgggtcagaacggaacgggaaaaagatacgctgtcagagccgccgtatatcgagcataccgtctcataaaaaaagtacagcagaatatgctgtacttttttattacatttgcactgtttttaatgactcttccaattcaagcagtaaagctttgctttcagcgacgacatgttccggaaattcttcagcgctgccgtattctacgccgtgcggataataatgctttcctaaaagaggggccttcagctgaatcacggcccgtctgccgccgacatcgccctcttttgccgttccttgaatccgcagataaaatgtcccctcaggtactgaaaactttttgtcgtaagtcactctttcataatcccattgtccagccagaatgagccctttgccttccatcagatcgttcaagcggctgagctccgctgttaccccttcaagaccgctgttttcaaacttcaaaccttccccctccttttaaaaatgccctttcctgacaatcatagtatgaaagcgttacactttcaatgattcatacggtgaaagtatgcaaaaacaaaaatttgacgacaatagtagcagaaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgccacacttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaagggataaaaaactggtcggcattgttacgctcggcgatctttcgttggccgagcaatcaaatgagcaagcaggccgggcgctgtctgacatttctgaagacggaggtccggaggggtttatccattaaacataaatcacggacgatgcaaataggctgtactgtataagagtacacaaaaacagaacggtttgatgatatgggggtgagaggttgaaaaatattgcaagggctctcgttatccttttgcttatttacggagcgtatgttctgtttatacaatatggatcggctcctcagaaaaagaccaatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattctgaatgataaagccgtgactttatacgcttcgggaagcggcatcaacgcaaaaccgtttaagatcggcgaatcgacgggcgaagtttttaaaacgacgcaggtttctccttttgtcaatgtgactgacaagggaaacacgtatcggtttgagttttccgaagaagatatcaatacccgtcccactgtcaggataggcggaatgtatgttcagctgtacatggacaaatttgacgggaatctgtcaagcatcagggcttttgatgcggaaacgctggtgaaacaaaggccgtatgaggtcatgtacagaggaaagctgacagaacccgagccagtttctgataaaaaatggaacgacattgaacgagcgagtgaacagcagattctcgacattacaaatgtcatccgcgtgaaacacggactggcaaggctgaaatgggacgaaggcgccgcgaaagtggcattcggccacagcaaggacatgaaggataacaagtatttctctcacgtctcaaagaaatacgggactctgaaggaccgcttggaaaaaggcgatgtgaaataccgggaggccggtgaaaatattgcctacaactatgtggacggtcctgcagccgtggagggctggctgaacagcgaaggccacaggaaggcgctgttaagcccggattatacgcacctcggtgtcggcgtggaccggaagtattatacgcaaaacttcattaagccttggcagtaaaaaaccgcagaggggcgcgtcccccgcggtttttttatgttttttcgcgagcggcgctcctgctgaaaaaaatatacctgctttttttcgcaatttaggcgaacattaaggcgcatgaaccgatacattatagcaggcaaaacttttcggagggggtgagaattgtggcgaatcagcaatcacggcaatcaatcgatgattttaaacaattcgtaaaaaagcatcccaaactgatccaaaatgttcgcaaggaacaaagaagctggcaggaagtctatgaaaactgggttctcctgggcgaggatgattcgatgtgggacccttttaaagacgaggccgttcagccttcttccgacgcggaaaccaaacaggaaccagctgaaaagaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcattcagaaaggattaaagaaggtgatcgtgtatgcgaaaagaggttcaggaattcatatccgcagatgaggaacggaaacggtttatacggcagcgtcccgtctggtaccgcagacttgcgagaaaaccggacgatctcaattcctttcagcttgacatgatgaatttttatgaaaagacgataccgcatcgggtaagtcaattctcaaacgggattcaaatggcgcagatgatgatgcagatggtacacgccatgcgttcgcaggattaaaaagcgtttaaacgccgcattttccaattgggtggtttcatggtaaactagcaactggaggtgcgtatttatgtatgcaacaattgagtccgtcaagcttcaaagtgaagcggagcagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgctttggcaaataccatcctgattatagagagatttcccgcaaaatgagagaaatgaagcgggagctcgatttaaacgataaggtggccgaatttaaaaaagcggagactgagcttcagtcgctgcttgatgagatcagcattgaactcggaacggccgtctcggagcatgtaaaagtgccgacggggaatccttattttgacggcctgtcatcctgcggcggcggctgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattctttaaaacacagcaaaatgctgagaaaattcggcaacgttcattatgtttccaagcggctgaaatacgttgtgctgtattgcgatatggacctgatcgaaaaaacaatggaaaagatttcttcttattcttatgtgaagaaggtagagccttcttataaaccttttttaaagctggaatttgaatcaaagcttgataaagcgaaagagtacgattataaagtcggtatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacgtagtcttgacaggaatgtgaatatgtatacacgtttttcacgttcattgtttgaaagaatgctttatgataagatagggattgtttttatacataacggctcagccgatgagaaacatcaaagttttcagaaaaagtggtgtgaataatgagagtaatttccggttcaagaaaaggacgagccttaaaggcggtgccgggcacatcaacaaggccgacgacggataaagtaaaagagtctatttttaatatgatcggcccgtattttgacggaggaacggggctggatttgtttgcgggaagcggcggtctcgggattgaagcgctgtcgcgcggatttgaccgctgtatctttgtggaccgtgatttcaaagccatccaaacggtaaaagcgaatatcaaagcgctcgatctgctgtcttcatcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaagacggttttgtcgtagccgagcatgataaagccgttgtgcttcctgaagccgtcggcgcgctttctgtaacaagaagggaaatttacgggcttacaggagtgacgatataccgaaatagggggtaatgatgtggcaagtatagctgtatgtcccggaagttttgatcccgtcacctacggacacctggacattatcagacggggggcaaacgtgtttgagcatgtgtacgtatgcgtgctcaataattcttctaagcagccgctgtttacagtcgaggaacgctgtgagctgttaagagaagtgacaaaagacattccgaatattacggtcgagacgtcacagggactgttaatcgactatgcgaaaaaaaagcgggcgaaggcgattatcagggggctcagagctgtttctgacttcgaatatgagatgcaggggacttccgtcaaccgcgtgcttgacgaatcaatagaaactttttttatgatgacgaacaatcagtactcttttttaagttcaagcattgtaaaagaagtcgcaaaatataacgggcctgtttcagagtttgttcctccggaagttgaacaggcgctgaagcagaaatttaaaggatgagaagcgctgatcggcgtctcatcctttttttgtccgtgctgacagcctgtaacaataaatcaatgcgtatacggcgagagctgtcagcgtgatggcgggcccggtttcaacaagtgtattccatccgctgacggcagcagatcccgcgtcctgatcgcggaaagggaggaatacggactgataaggttcgtccaatgcaaggtaaagcggcttccacagtaagagaataaagagtgcagcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaaggcggcatcagcttcactgaccagcttgctcccaagtgtaatttcaaacattccgctgataagagggatgtccagatttgccggaagatgaaaaagggaaagcagcgcgtttgtaaatacagaaagcacatccatgacttgtacgattgataataaccggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtgaggccgacggcgatgtttccgagatagtgagccgatgccagcagaatgccgagagacgcgttatgaaaaaagccgaccgccacggcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaatttgacaatgccgaatccgattaaaagctcagatagaataaaaaacggaagcaatgaaggaaaaacgacctcccaccacatggaaagaccggttttggaggcttcgaatgaggcctgagggtgtgaaataaccgtcgccgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagcatgggagcattagtcgggagcttttatgcggccgggcatgacgtggctacgatgaaaaaagtcgccaaagcatttaagcggcggctgtacgcggattatacgatgccgaggctcggatttttaaaaggagaccgcatcaggcagctcgttcatgcctatacgtacggcaagccgatagaagaactgcggatcccgctcggcatcgtggcctgcgaccttcagaccggcgaaaaactcgtttttacgaaaggttcagtatccgaagccgtccgcgcgagcatcagcataccgggcgttttcgtcccgcaaaaaatgaacggacgtatgttagtcgacggcgcggtggtcgacagaataccggtgtccgccgtaaaagacatgggtgctgatatcgtcatcgcctctgacgtatcccgggtgaaaaaaacggaaaaagcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaattgctgttacatttattaagcttccgtattacattacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgatgaaagcataaaagaagagggcgaatcggactcggattatatgaagcgccagctgcaaatgatgaaaagctcccaagaaaacgcggtcattgccgcttatcaaaaagccgggaaacaggtgaaatactcatttaacgggattttcgccagctcagtcgtctctgacatgccggcaaaaggaaaaatagaggtcggtgataaaatcatcagcgcggacgggaaaacatacgaatccgctgaaaagctgattgattacatcagcagcaaaaaagcgggggaaaaagtaacgtttcacattgaacgggacacgaaagaaaagaccgttgacattgtgctgaaatcattcccggacgacccgaaaagagcgggaatcggcgtcgcgttatatacggatcggaacgtgaaagtgaagccggatctccatttcagcattgaaaatatcggcgggccttctgcgggtctcatgatgtctttagaaatttacaaccagctgacaaaacctgacgaaacaaaaggctataatatagccgggacggggacaatcgacgtggacggcaaggtcggaccgatcggcggaatcgatcagaaagtcgtcgccgcagacaaagcgggaaaagatattttctttgcgccgaatcaaaacggagctgaaaattctgattacaaaaatgcggtaaaaacagcgaaagcaatcaagtccgatatgaagatcgtccctgtcgacaccatgcaggacgcacttgactatttggatcagctgaaagtaaaaagcacctgatacaggcaggtgctttttttacgcattcaaaaaacgctgttcgtcttcatcatagcggatcggcgcttgtgaaaattcctgtttctcaaacaatgtgcgttcaggttcttttatcggcaggctgtaaacccgtcccgccagtatgtccagatccagagcgggatgagagaaagaagagagcttgctgacgagaggtgcggtaagctcttttttctttgccgacaggtacgcctgtccttttttcgtcattccgagaagacggatataaggagcgcttgaaggctgtaagagccgatgcatgtcctcctttttcgtccgtgtcagaatgtgcgtgttcatccgctgcagcctcgtccacgtgtatcgttttgttttcaatcgttccatcatttcgcgataggatcgggcttgtctgatggtgcgcagaattctgtgctcaaggccttcttccacttcatagattcggctcaattcttcagcggacagagtgctgaggctgtattttacatatgaaaaatagtcttccgtgctgtgccatatcccgtatgaatttctgtatgcctccagctcacgcgcagacacttccgggagaaagctccttgcggccgccgttcctttttctatcagcgctttccggatgcttgttgcgctggctatccggctgttatctccgggaagctcagcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctttgaatatgtgtgaaaaagcttttgaggcggcggccggatagctgagaccctttttcagctcctctttcagaatcaggctgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattccgctttttgtacggcatacatataagggagctcaatgacgatatccacgccgttttccagcgccatttttgtccgggcccactttgagacggcggccggttctccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgtttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgtcgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttctttttttttgcccctccggcctgcttccgccgaaaaaattgtgagcgccagtagtctatctaatctatcagcggcatatgtatgaggtaaatgagcaaatatggagggagatacgattgacgataacgagacaagacgcgtggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgttcgtcatgaaaaagaaaaactcacagaacagctgaccgcgctgcaaaaagaagtcgaggatctgcgtgaggaaaatgaaagcttgagaaacaagctggagatgacggaagaagattataaagcgttaattgacattatggacagagcgagaaggatggtcaattcaaaagaagacgacaggaaatcggcgcagagcctgtaaaatgaaccggcctgagggcggcggcccggccggttttttattatgccgtttctccggatgtcatttcaccgtccatatcgggatgccagatgtaaggattttctcctttatcacgcgccatatcatatttaacgggctcgaaattcatcttatcccagaattctgctgatttcatgcgtgaatttgtcctgatcggcattctgaaggattttgcaaaatcaacaagcgcttttccgtatccgttgttttgatagcccggaagaacctcaagcttccaaagttccaaaaagtcctgacgctgatcaaaatacggattcgcgcctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcaggcgctctattttcaacacaaactccccctttgttgtgttctaccattattgtaaacgctttaattgaaaattccaactataatatgcttgcctgtctttttgctcaaaacgaaattgaagtaatttgcggcggcttctgctatgataatatggaaaaatgcagatatagggtgtgacagtgtgaaaatcggaattatcggcggcggagcggtaggccttttatgtgcttactacttatcgtcccgccatcaggtaacagtcattacgcggcggacggagcaggctgatgcgattaactcaggcggtatacggcttttgaaagacggaatagaatgtactgcggcatgcagagcgcaaacaggcatcacttccggattcgacctcttaatcgcagccgttaaacagcaccagctcagtgctgtgctgcgggatcttgagacggtaaaagggacgaatgtgctgtttttgcaaaacggcatgggacacatacacgacattagagattggcatacggatcattcgctttatgccggcactgttgagcacggagcaaaaaagatatcggatcatgccgttgaacatacgggagcgggagccgtaagatggagtgtattcagcgcatcccggccggaaacgctcaaaagcatcttttccggcatgcaccgggattttcccgtatatgatgaaaacgactggtatcggcttttaacgggaaaactgatcatcaatgtatgcatcaacccgttaactgcattgctgcgcgtgaaaaacggagagctgttaagaaatgacgcttacaaaaaatatatgagaaatgtgtttgaagaagcggagacaatacttggcctcgccgatagagaaaaagcgtggaacaaggtttgcgaagtttgcagactgacggaaaaaaatcattcttccatgctcgtcgatatcatggcaggcaggcggaccgaggccgatgcgattatcggctaccttgtaaaagaagcggaaagccgcggattgccggccgttcatctcacgtttttacaccgcagcataaaagcgttagaaagaaattgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacctctcttcgcggccgtttgccagagaggaattagcggattatttatcctcctatcacgaaaaatttcactccgccgccatgcaggcctccatcgaaaaactgagagatccaaaaagcgcagcggttgtaggcggccagcaggccggtcttttaacggggcctctttacaccatacataaaattatctccattatcgtacttgccagacagcaggaagaggcgctgcagattcctgtcgctccgattttctgggtggcgggtgaagatcacgatctggaagaaattaattatgtgcatacgtcaacagagaataaaggtccggtgaagcggaaactaccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgatgaattcgggagatccggggattaaaaagctggaaacgggtatgtttcagcagattttaaaacacaatcacgagcttgccaaagccgtgtcagaccagcagcgtcttatgcgggaagccggttatcacccgattattgaatcggacaaagatcaggctaatctgttttacgaacacgagggagagcgtttcttaattgaaaaagaaaacggcgtttttgtcattaaggagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggtgagctgaagcaggctttctcattaatgggcttccgcatgacgccggtagtgccgagactgaacattacgattcttgagcgccatattgaaaagaagctttcagaacggaatattccgcttcaggaagcgatcgaacacggcaccggacacctgaaagacgcttattttgaagagcagattccggaagagttttcttctgtaatggaacaggcgaagtcgaagattgaagctgtccataaaagcgcaaggaacgaagcgctgaaggtcgattcaagccttgagccgctcttacagaagaatgccgccttcattcaggatcagctcttgtttttagaacggacggtaacgaaaagaattgaagaaaaagaaggttttgtgctgcgtgactatgaaagaatccaaaacagcatcagaccgctcggcgctccgcaggaacggatttggaatgtaatgtattatttgaaccgttatggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtgggggtccttatcatgtttatgggtgaataccagcatacaattgatgcaaagggccgcatgatcgtacccgcaaaattcagagaaggcctcggtgagcagtttgtgctgacaagaggacttgaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcctgatcgcctttgaccaagatgacacggcgcttgaaaacgcacagaaaacattgtccgaatacaaaggacagctcattctggtaaaaagcaactttcgttatttaaaagagtgtttacatgaacacggcattacgagtgtcgacggaattttatttgatttaggagtatcctctccgcagcttgatacaccggaacggggattcagttatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccggaaaattgaagaggcaagagaaaaatcgcctattcaaacaaccggccaactggtcgatctaataaaggacgcgataccggctccggcgagaagaagcggaggtcatccggccaaacgtgtattccaagccattcgaattgccgtaaacgacgagcttcaggtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactgattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcggcgtaccaatccaatattgaggtgcaaaaactggaggagaaagtatctgagaagaataagcagatcggtgatctcgaaaagacggctgctgacttaagccagccgcagcgcctgatggatatcgctaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggagtagaacttgcaacaaaagcgaccgagcagcacgaaaaaaagcggacgatagaagcgagccgcggctctattcttgaccggaacggcaaagtgcttgcagaggacacggcgacatataagctcattgccgtgcttgataaaaaaatgacgagtgatccgaagcatcctcagcatgtcaaagacaaagagaaaacggcggaaaaactggcgaccgttatcaatcttgataaaagcgagattctggacatcttaaacaggaatggcgcgaagcaggtggaattcggttcagccggccgcgatatctcttatgcgaaaaaacaaaagatcgaaaaaatggatcttccgggtatttctttcttaagagatacgaagcgctactatccgaacggcatatttttgtcaaatgttctcggctatgccgatgtgaatgaaaaaacaaacgagatacaaggctctttagggcttgaaaaaatactgaataactatctgacggaacgtgacgggtccgtcacttacgaaagtgataaatccggctggaaacttccgaacagcaaagaaaaaatcaccgcacctaaaaacggtgacaatgtatatttaaccattgatcagaaaattcaaacctttttagaagacagcatgacgaaagtggcggaaaaatataaaccgaaaaaaattatggcggctgtcgtagaaccgaaaacaggcaaagtgcttgcgatggggcagcgtccgagttttgacccgaatatcagaaacgtcaccaattattacaacgacttagtgtcgtacgcatatgaaccgggatcgacgatgaagatctttacgcttgccgcggcgattcaggaaaatgtgttttccgcaaacgagaaatataaatcaggaacatataaagtgggaggcggacctgttaaagattggaacgatggcgccggatggggtatgacaagcttccatgacggcctcatgaggtcatcgaatgttgctttcgccaaactggccaatgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacaccgatccagcagcttcaggccgtcacggcgattgctaataacggcaaaatgatgaaaccttacgtcattgatcatattgtcgaccccgatacgaaaaaagtcgtcaagcagacaaaaccagagcaagtaggcacgccgatttcagccgatacggcgaaaaaagtccggaacctgctcggagaagtcgtgacatcagacatcggaacggggaaaccttataaaattgaaggttttgacgtcgcgggtaaaacgggaaccgcacaaatcgccgggacgggcggatatttaaggggaacgagcaactatgtgttttcattcatgggcatggcgccgaaaaatgatcctaagctcgtcatctatgtagccgtgcagcagccgcagttaaaagcgggtcaaagcagctctgatcctgttgcggaaatctttaacccgacgatgaaaaacagcctccactacatgaacatcgaaccgacggaaaaaacagattccggtcaggaagaaacgaaaagccaaaagatgcctgacctgacagataagacagtcacgggcgctgagaaggaagcgaaaaatgaacatctcacaccgattgtcatcggcagcgatgttgccgtaaaagagcagtatccgacagccggagaagatgtgatcaccaatcagaaaatcttcttaaaaacagacggaaagatgacgatgccggatatgtccggatggtcgagacgggaagtgcttcaattcagcaaagtatcaggcattcacatcgatgtgagcggtgaaggttacgcttcaagccaaagtgtgaaaaaaggcaaagaattgaaagaaaataccgtgatcaaggtgaaatttaaaaatcctgattaaagggacagagaagtccgcggatgtccgcgggcttcttttttatgcgccgccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggagaaaagctgacttcactggctaaggattcctggagccggaatttgccgtttgagcctgagcggggagagatccttgaccgaaacggcgtgaagctggctacgaataaaagcgcgccgaccgtctttgtcgtaccgcgccagattcaaaatcccataaaaacgggcaagcttctcgcgtcagttttaaatatgtcggaagagaaggtctacaaacatattactaagaaaacctccatagaaaaaatctcacccgaggggcggaaaatttccaataaaaaagcgaaagaaatcaaagcgctcgacttaaaaggggtttatgtggctgaagacagcatccgtcattatccgtacggaagctttttgtcccatgttctcggttttgccggtattgataaccagggccttctcggattggaggcttattatgatgatgacttaaaaggtgtcaagggatctgtgaaattttatacggatgccaaggggaagaaaatgcctgatgaagcggatgattacacccctccgaaagacggacttgatatgaaattgacgattgacgccaaggttcagacgattatagaaagggagctcgacaatgcagcggcgaaatataacccggacggaatgattgcggtcgcaatgaatccgaaaaacggggaagtgctcggcatgtcaagccgtcctgattttgatccggctgactatcaatcggtggatccgtccgtttacaaccggaacctgccggtatggagcacatatgaaccgggttcgacctttaagattattacgcttgcggcggctctccaagagcaaaaagtaaacttgcaaagagaccacttttatgacaaaggatttgccgaggttgacggcgcccgcctccgatgctggaaaaagggcggccacggttcgcaatcttatcttgaagtcgttcaaaattcctgcaaccccgggtttgtacagctgggggaacggctcggaaaacaaaagctgtttcaatatattaaggacttcggctttggaaagaaaacaggcattgatctgcaaggggaaggaacggggattttattcccgcttgacagagtcggcccggtcgaacaggcgacaaccgctttcggacaaggggtttccgtcacgccgattcagcaggtggcagccgtttccgcagcaataaacggcggaacgctttatactccgtttatcgccaaagagtgggttgatcccgttacgaaaaaaacagttaagaaacaatcgccgattgcgaaaaggcaagttatttcccaggaaacgtcaaagcagatcagatatgctttagaaagcgtcgtcgctcagggaacggggcggaatgccttcgtggaaggatatcgcgtcggcggaaaaacaggtaccgcacaaaaggtcaaagacggcaaatatctcgaaaacaaccatatcgtctcctttatcggttttgcgccggctgatgacccgagtctcgtcgtgtatgtcgcggttgataatccgaaaggcacgattcaattcgggggaaccgtcgccgcgccgattgtcggaaatatgatgagagacagtctgccggagctcggcgtgaaaccgcgaaaaaatcaaatcgagaaaaaatatcaatggaacgacacaaaaacaatagaggttccgaatgttgtagggatgtctgtctctgatcttgagtcgctgcttgtcaatttgaatattgactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgccttttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtgtgtataaaagggtatacggtagacggacatgatttcgctcaaaaagccgcagaaaacggcgcagcggccatcgttgccgagaaagagcttgacgtcgatgttcctgtcattatcgtccgccggtcacagcgggcgctcagcgttctttctgacgcgttttacgggcagccgacaaagcagcttcagcttatcggcatcaccggcacaaacggcaaaacatcaacgacgcacatggttgatgagattttcaaaaaagcgggaagacagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcatctcacgctctgtcactcggcagggttcacggctgcgattatgatatcgccgtattcacgaacctgacgcaggaccatttagactatcacaagacgatggaagactacagacaggctaaaagcctcctgttttcccagctgggcggctcctttaaccatgaaaagccgaagcgggccgttttaaacgcagatgacaaagccagtgcttattttgaaaaagtgacggcggcgcacatccttacatacggaatcgagaacgatgccgatgtcatggcgaaacaaatcgagatctctgcgcaaggcacaagttttgaactcgttacgccgaaaggaacaaagcagatcacggtttcactcgtcggccgcttcaacgtgtataacgtactggctgcagcggcgacagcgatcgcagcgggtctgccgtttgatacgatcacgagcgctcttgaagagctgcaaggtgtcagaggccggtttgaactggtgaatcataatcagccgtttcctgtggtcgtcgattacgcgcacacgcctgacagtctggaaaacgttctgaatacatgcaaagacatgacagagggcaagcttttcgtcgtcgtcggctgcggcggagaccgggataaaacgaaacgcccgaaaatggcggaaattgcggtgcggattgccgacgaaccgattttcacttcagataacccgagaagcgaggacccgctggccatattaagagatatggaaagaggggtagaaggcacctactatcacagtatcgcaaaccgcgagcaggctatcttttttgctattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagggaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgccattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaagtatttatgggggataccggttcgcttgcgctcggaggagcgatcgtgaccgttgccattctgacgaagcttgaaattctgctcgtcattatcggcggagtttttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcaaaaacaaaactttctggtcctcggactggcgaaaagcggatatgcggctgcgtcgattcttcatgaaaaaggcattaacgtattcgtgaatgatcaaaaagcctttgaagagaacgaacctgccaaaaggctttcagaaagaggaatcgaggtcatctgcggtgagcatccgacgtcactttttgaccagcatcacattaccattctgatcaaaaatcccggaatcccgtatgaaaatatcatggtggaggaagcgcaaagaagaggcatcccggtctggacggaaatcgagcttgcgtattatatcaccaatgcaaaattcatcggcattacaggttcaaacgggaaaacaacaacgacgaccctgatttatgaaatgctgaaagctgactcgataaaggcgctgatcgcaggaaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagtgcaccaggaactgtcaagcggcgcatttattaaagacggaatgctgatgttcggcgatgaagcgattctgcctgttgatgacatcgtgctgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaacagcaatccggaatcgtaaattttataatgacagcaaagcgacgaatattttggccacaagcaaagcgctctccgcgttcaaagcaccggttattcttcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcgagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttatcattacgttattgcttttaacaataggattaattatggtctacagtgcaagtgcggtatgggcggattataaatttgacgactcgtttttcttcgcgaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagtgggagcgttcagcattcagccttcggagtttatgaaactcgcgatgattgcgtttctggctaaatttctttctgaaaaacagaagaatattacgtcattcagacgcggattcgttcccgcgctcggaatcgtgttttctgcatttattattattatgtgccagccggacctgggaacggggacggtaatggtgggcacgtgcatcgtgatgatttttgtatccggtgcgcgaatcgctcattttgcgttcctcggactcatcggtttaagcggatttgcggcgcttgttctgtccgctccttatcggattaaacggattacctcttacttaaacccgtgggaggacccgcttggaagcggatttcagatcattcagtcgctctatgccgtaggtccggggggactgttcgggatggggctcggccaaagccggcaaaagtttttttacctgccggagccgcaaaccgatttcatttttgctattttatctgaggaactcggctttatcggcggttcgctcatattgctgctgttcagtattttattatggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatctatacgttatctataaaaaaacagacaacatcaataaccctgtcctaaaaaacagggttatcgctatgtgattaagggggacatacgaatgcgtattgcagtaagcggaggcggaaccggaggacatatttatccggccctggcctttattaaagaagttcagcgccggcatccggatgtggaatttttgtatatcggaacagagaacggtctggagaaaaaaattgttgaacgggaaaatatcccgttccgcgccattgaaattacaggtttcaaacgaaaactttcttttgaaaatgtaaaaaccgtcatgcgtttcttaaaaggcgtgaagaaaagtaaatcatatttaaaagagtttaaaccggatgccgttatcggtacaggcggctatgtatgcggtccggtcgtatacgcggcggcaaaaatgggaattccgacgatcattcatgagcaaaacagcctgcccggcatcacaaataagtttctctcgaaatatgttaataaggtggcaatttgctttgaagaagcaaaatcgcattttcctgctgaaaaagttgtgtttacgggaaacccgagagcctctgaagtcgtctcaattaagacaggccgctcattaactgagttcgggctgaaagacaatcaaaaaacggtgctcattttcggcggaagcagaggcgcggctcccattaaccgtgccgtgatagatatgcaggaagaattgaaaacgagaccttaccaagtgctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaagacatgagtgagcggacaaaatcactcggtgttccggatgcggcagccagactgtacagtatcatggaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggcccggcggacattttgatcatccccaacagtgtggaagcggtcaaagatattatggatattgtgaagaaacatgatctgccatggacggttatcggccggggttcaaatctgctcgtgcttgatgaaggcataagaggagttgtcatcaaactgggcgcgggtctggatcatttggagattgacggtgatcaggtgacggtcggaggcggctattcggtcgtccggcttgcgacttccatgagtaaaaaaggaatgtccggtctcgaatttgcagcgggcatccccggatcaatcggcggggccgtctatatgaatgccggggcgcacggatctgatatgagtgaaattcttgtgaaagcgcgtatcttatttgaagacggcacaatcgaatggctgacaaacgaagagatggatttcagctacagaacgtctgttttgcagaaaaaacgccccggcgtctgtctcgaggcagttcttcagcttgagcaaaaggaacgggaagccattacggcgcaaatgcagcagaacaaagattacagaaaaaatacgcagccgtattcaagcccatgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctcgacctgattgagtatgtgaaaaagacaatccgtgagcagtatgatgttgacatgcatacggaagttgaaatcatcggagggaatcgttaaaaggttctctgatttccatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccgggaacgaaaacgtgtctgtaaaagagatcaacgcgctttctgatatacataacggacaaaccgagttctggagtctgaacaagaaaaaaacagaagaaaagattgagcagaataaactggtgaaaaaggcggatctttcaaaagtatttcctaataaagtcagcattcacattgaagaatacaagacgatcgcgtatctgcagcggaatgatgtgtattatgaagtgctggagaacggcaccgtgctgccgaacgaagtcacgccggatgacgcgggcccgattttggttgactggacaaacgcgaaaaagcgggtcaaaatggcggagcagcttgataagctttccggttcgctaaagcagtcgatttctgaaatctattatacaccggtaaaaatggaccaggaccggatcaagctgtatatgaacgacgggtatgtagttaccgcttctattaaaacatttgccgaccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaattttaaggtgattcaaaagaatctattacaatcagcggggcagccgatataaccgatagcggaataattatgactatgtttgtttttgcccgggatatggctgccggacaaggggaaaattctcaatgcaatgggcgtgtcttcttcaatgaacattgcatttggaattttcctcctgtttcttcttttttcggatgtttctggcaatatctatagcttttctggaggttcatcttagtgtagactaatggaaagcgggtatatttgcatctggtttgcacattatggcaccgtgacaagaaatcttacggtaaggtgggccgtctctaaaaaaaataaaaaaaatgcgatataaaagaggatatacatagaatataacgaatagtttcattaaacataaattgtgagaaatcagataagaatttgttgatgctgttgtttttgttacacacttgtaaagccacattcattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggtcgtgtcggttccgcatgagcagctgatcgttgacgtcgttccgaaacagtttatcgttgacggaagagacgaaattaccgatccgaaaaaaatgctcggagtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggcggcggctcgacgacggtggcggtatttgaacaggggcacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgcaatgcccggagtgctttcattggcacaggaagtgctgaggcacaatgtaagggtcgcaagcccgaattacatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggccagaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtgcagggtgtagagtatattgcggtaaacacggacgcgcaagctcttaacctgtcaaaagcggaagtgaaaatgcagatcggggaaaagctgacccgcggtctcggagcgggagcgaatccggaagtcggcaaaaaagccgctgaagaaagtaaggaacaaatcgaagaagcgttaaaaggcgctgacatggtgttcgttacagccggaatgggaggcggtaccggaacgggagccgcaccggtgatcgctcaaatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcaacgcctggtttaatcaacttggactttgccgatgtcaaaaccatcatgtccaacaaaggttcagcattgatgggtatcgggatcgctacaggagaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcctctgaccctgatgtcaatatgattttcggttcagttatcaatgaaaatctgaaagatgaaatcgtcgtcaccgttattgcgaccggttttatcgaacaggaaaaagatgactcaaaaccgcagcgtccgactttaaaccaaggattgaagtctcaaagccaaaacgctgcgaaacgtgagccgaaacgagaagaaacacagcatcaaaacacggtgaaccgccatacatcacaaccggcggatgatgccctcgacattcctacatttttaagaaaccgcaacaaacgcggctgatgtaaaaaaggacaagaccacatggttttgtcctttttcttttttgtgcacagtcttccttcctatcccccatgatctatacagtgaaaaaagaagctttatacctatgacgaattgattgttttttagtttcatacggctttctacagaatgtgacaatatctggatggaagattgtctacatttaacgtacagcatcgaaatgacaaacgattccaattatgaaggggggatacacattttatagggcgttaccaaataaggggggatacgattgaagaaaaaaacgagaaacagatggacaggctccgttttaagcgcgattgtcgtcagttcactgttgtttccgggtgcagccggagcgaacagcacaccgggggcagtttctttcaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaagaagcagaaaaaaatgccgagtctcattcgctttccgcagcaaaaaccgaatatcaaaagcggtcagccgttgtttcttctttaaaactggcagctcatgatgcgcagcagaatctgaaaacatatttggaaaaacaaaaaaagaaaggaaaggctgatcacatccattcctattatattgtcaacggaatggcagtcactgcttcgaaagaggtaatggaaaaagccgcctcatttcctgaagtagaaaaagttcttccgaatgaaaaacgtcagcttactcaacggcaatcaaaagctccttttcaaatgaagaaaaaacaaaaagaggtcaaagcaaaggaaggcatcgaatggaatatcagccaaattgatgcgccgcaggcctgggcctcaggatacgacggaaccggcacggttgtcgcctccattgatacgggagttcagtgggatcatcccgcgcttaaggaaaaataccggggttacgatcctgaaaatccagcagcgccgaatcatgaaatgaactggtatgatgccgtgtcccataaagacgctccctacgatgaccttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgcttgcgcctaaagataaaaacggcacgccgcatcccgagatggcgccggatgttgtcaataattcctgggcgggcggttcgggaatggacgagtggtaccgcgatatggtgaatgcgtggagagcggcagggatttttccggaattctctgcgggaaatgaagacttatttacaccgggaggaccgggttcaatcgcaaatccggccaattatcctgaagcatttgcgacaggtgcgactgacatcgacaagaaactcgctgatttctcacttcaaggcccctcaccgtatcatgaaacaaaaccggacatttcggctccgggcgtgaatatccgttcttctattcctggaggaacatacgaaggcggctgggacggaacttcaatggccgggccgcatgtggcggcgacggcggctttgttaaggcaggcgaacgcctctattacggtcgatgaaatggaagacgttttgacgcgcaccgccgaaaagctgacagattccgtttttccggaatcaccgaataacggttacggccacggtctcgttaacgcttttgatgccgtttctgccgtaacggacggaatcggaagcgtagaaggcaaggtatcttctgcgggcgaagatcacaatccgcccagctttcatcatgaaccggtctcagaggcttacaaaggggcaaaccttccgttaacggttacagcagaagatgatgtaagcgtaactgaggtgatcctttcctatcagtttgatgaaggagagtggaaaacgacagccgccgttcaaaaaagcggtgatgaaaaaaagggaacataccaggcggagattccggacataacgggaagcaagataagttataaatggaccataaaagatttcggaggtcattctgtagaatctgatacgtaccgggctgacgtgaaaccgagcattacggcgggatacaaagaggattttgaatcacagccggcgggctggtccagttacgggacacatgatcaatgggaatggggtatcccgggttcagggcccggcgccgcattttccggagataaagtgtatgcgacgaatctgtccggcccttatgccgattcggccaacatgaatctcgtgatgcctccgattcaagttccggaaacagggcggctgtttttacaatttaaaagctggcacaagctcgaagaattttttgattacgggtatgtgttcgttctgccggaagggaaatcaaattgggagcaggcggccgtttacaatggtgattccgcaggatggaatgatgaagaggcggatttatctgcgtataaaggccaaaacataaagctcatgtttaatatgcagtctgacgaagtactcaatgaagacggatggtatatcgatgatgtccggctttcaagcagccctctcggcaaggcggctaaaaaaagtaaacacaatagacaaacacctcccggccacctgaagaaaaaagccatcagtccgaaacaggccaaaccggcagtgagatcacccggaaaaagagtgaaacgtgaaacaaacctcctgccgctcagagcgcaaatcagtgtcgccgagacggggaaatccgtatattccgaccctgcaagcggaagctacagcctgtcacataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtccacaggcgaaccggtaaaaggggctgcgctttatgtggccgaggatgccgcaattgagccggcggtgacaaacgataaaggggaatattcgcttaaggcgtatgaaggctcctacacaatcaaagtagcggcaaaaggcttttacaatagcgaattttctgtcgacatcaaaggagatgctgaaaaaaacgtcaagcttaagccgtatgtcggttatgaaggagaaatcgcctatgataacgggacggaagaagccgcgctgtcatattttaaagccggcagcaaatctgccgttaagatgaccctcaaagacggaaaagaacacggtatgctgacgggaggcctttttaaattttggggcgccgactggcctgatccgggcggtaccgaatttcaagcagaagtatatgatgcatccggccctgatggagctccgggcagcaaaattgccggcccgttccaagctgaagcacttcgaaacggcgagtggaccaaagtgaatctcagctcaaaaggaatcgcggtcggaaaggatttttatcttgtgttccgtcagacgaaacccgatccttatacacctgccctgtcatctgatgacggcagtccgtactcgaacagaaactggcaatacctcgacggccgctggtcaaaagccgataaatcagacggaaactttatgatcagggctttggtcgactacgaagcttctgtgcctgagataacgtcgcctgaagaccggtcatttacaaacaagaagtcaatcacggtgaaaggaacggcttcaccaaaaaccgctgtccgtcttaccaataacggtaaaaccgccgcagaaacgaaagcagatgcagacggcagtttccaggccggtgtcacactcactaaagatggcaatcggctgacagcggcatctgtgacagacagcgggtcaaccgatgagtcacgccctgtcacggtcatactggatgaggataagcctgatgtgacgattgacagtccggcaaacggtgataaaacaaataaagaagcagtgactgtaaaaggaaaagtgcacgacgcccatttaaaatgggtaaaggtgaacggaaaaaaagctgaagtaaataacggttcttatcaagcgagaacccttctggaaaacggcagcaatgagatcaaggtcacggcctcagataaagcgggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcggcttcttccatcaaagcaagcggagcaaaaattgacgttatcgcaagagatgactacggaaatgaaacgagacagacggctaaaggaaaactttatatcaatgagtaaaaacagagcgctgccaaatcacggcagcgcttttttagttgaaggggacaatagaaaatcaaccttttcggccctcgacaaataaaacggttatcccttaaaaattgtactttaccctcaacattaattgacagactttcccacagagcttgctttatacttatgaaacaagagagagaaacagatatgtaagacaaaagaggaaaggggtcagatgtgaaaatctatctggatgtcatttggctgttgaacttttgttttgattctcttttgcttttattgaccgcctttattttaaaacgccaggtgaaaaaaagaagagtggccgccggcggtttcatcgggtcagccattgtgcttctgatgtttacgcctgtttctccctttgtggagcatccggcgggaaaaatggcgttttcggtagtcatcgtgcttacggcttttggctttaaacggttccgatacttttttcaaaatttgttcgccttttatttcgcgacttttctcgtcggcgggggaatgatcggcgtacattccctgctgcagacagaatcaattgtgcagcaaggcgtaatggttacaagccagaccggattcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcaataggattggtggattccgggaatcagctgtatgatccgctgacgaaaacgccggtcatgatccttcacattaacaaattcgctccgatcctcagcgaaaaggaaacggacttcatcaaatccgccagtccgcttgaagtgatagagcagcttgatgattcgttccgccatgcggataagctgaggctgattccatacaggggcgtcggccaggacaatcaatttttactctgtttaaagccggattacgtcacgattttaacaaaagacgagatgatcgcatgtgaaaaatgcctgatcggcatcagcacgaagccattatccgctgacggtgaatttgacggaatcgttcatccgaagatgctgacagggaaggctgtaaaacatgtttcctgacgaaaagtctgttattcatcatactcaaaacgcgtggtatttagaagggggaggaagatgaaaaaacttaagctgcgtctgacatatttgtggtataaatggctgatgaaactcggactgaaaagcgatgaagtgtattacataggaggaagcgaggcgctgccgccgcctttgtctaaagaagaggagcaggtgctcttattaaagctgccgagcggtgatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacgtttaatccggaaaagaaaatcaaactcgccacctacgcatcgcgatgtattgaaaacgaaattttaatgtacttgcgccgaaacaataaaatccgttcagaggtgtcctttgatgaaccgctgaacattgattgggacggaaacgaactgctgctttcggatgtgctcggcacagatgatgatattattacgaaagacattgaagccaatgtggataaaaaacttttgaaaaaagcgcttgagcaattaaacgaaagagaaaagcagattatggaactgcgtttcgggcttgtcggagaagaagaaaaaacccaaaaagatgtagccgacatgatggggatttcacaatcttatatctcccggctcgaaaagcggattatcaaaagactgagaaaagagtttaacaaaatggtgtaaaattttttccatctgacagcccttactgctgcaaggattgccgccgccggatgtttatttctgtaaaatggcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattgcaggatgagggcgatgattcagcgagggaaaagcttgtaaacggcaacctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataacaatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccatccaggatccggtttcactgtttgagccgatttataatgacggcggcgatccgatctacgtgatggaccagatcagcgatgagcgcaataaggatacacaatggattgaggagctcgctctgaaagaaggcatgagaagactgaacgaacgggaaaaaatgattttgcgaaagcgctttttccaagggaaaacccaaatggaagtcgctgaagaaatcgggatatcccaagctcaggtctcaaggcttgaaaaggcagccattaaacaaatgaataaaaatatccatcaataacggaaaaagcctttaaaccttgtttaaaggcttttttcatgcgatggtttacgtttgcaaaaaagtgatgtattctaatgtgtaaaagtttttagaaaatttaaataaagtaaacgggggaaacggcaatgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcagttcggcaaaacagagctcggtgacaggctcagaaggaaaatcggccttgtttcggcaggtcttcagcacaaattatatgccgcggactccgcttttgaaatcgccctcagcggcgcgtacgcctcaatcgggctgtacgaaactccgagtgagcaggtaagggaaaaagcgatcggtcttctgaaggatttgggcgccatcagttacgccgacaggcggtacgaaacattatcacaaggggaaagacaaagagcgctgattgcgcgggcgcttatggctgatcccaaactgctgattttggacgagcccgtgacgggtcttgattttatggcaagggagcagctgctggacacgattacgtcgatcgccgaaaaagaaaatgcgccgtccatcctttatgtcacccatcacgctgaagaaattctgccggtatttgatcaggcgctgcttttaaaacaaggcgaggtgttcgcctccggggaaatcagggatatgctttctgacgagcggcttacagcgtttttcgatacgcctgtcaatgtcttatggaacaatggccgcccgtttttaacacgtgcaaaagaggcatcatccgtaaaataacatcaattcaccctgggggtgctgccatgcggctgagagagacgttgtctcaacccttaacggacctgatccggatcatgccggcggagggaagcggtgaaaaaagcggaggaagatccgttttttacccgtttcattttaatgaaacgggttttttgatacagccaaaggggagatttccaatgcatcagattgatatgctgttacaccaggcggagaaacggaggcacgacttcatacatattgctgaaaggttgatcgcctttcccactccggccccgccagcaagaaatacggcagaagcccaaaagtgggtggccggctttttaaaagaaacgggctgctcggtcgatatgtgggatgtgtatccggaagatccgaatgtagtcggtgttttaaaagggacagattcaagcaggcatcaaagcctgattttaaacggacacattgatgtggcagaagccgggggcgaagactggaactctgacccgtttcagccgctcgtaaaagacggcatgctgatcggaaggggcgccgctgatatgaaaggaggtttggcgtgtgttcttttctctctgaagctgatccatgatgccggcattaagcttccgggcgacctcattgtacagtctgtaatcggagaagaagtcggcgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcactgccttgggagagctggagcgccactgggcggtaacgaaaagctatcccggcattgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctggaaatcgatccggatcatccggcagtttctgtcttggctgcatcacactctgccgtcaaaaaacaggagcccgtcattgatgtttcccaaaccgtaacagacggaggatggctttatcaggccgggattccgagcgtcatatacggccccggcgatttaaaaaacgcccactccgtaaacgaggaagtgtccgttgatgagcttatggactatacgaaaatcatgctgagatttattctcggctggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggggatattgatattaacgtgacaacgggaaaaattcaggcgattattttaggcggcagcggaaaagttctcggttttttcggaaaagaagaggaaatgatcattccttggcgaaatatagttaaaattggggaagatgtcatcttagtgcgtgtaaatgaaccaaaggggggagcgtaatcctccctttacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacaacgaaaaacggcggtgtcagcaatcctccgtatgagtcattaaataccggattgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcgagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggtccgtccatcagcgcgggaagttatacagtcgacgaccgcgtcatcaatgaagtgcgggcgctgccctttacggctgaatccgccatatgcgaaacggaaaaaggccagtatcaacttgatttaaaagaggtcaaccgtcttcttctgatacattgcggcattccggaagaaaacatttcagtcagcggattatgcaccgaacgagagcgtgaactattcttttcacaccgccgcgacaaagggaaaacgggacgcatgatgtcctttatcggaatgaaggaggcataagatcttgcgtgttgctgatcaattacgacatataaacgaaagaataaacgaagcatgtaacagatcgggccgaagccccgaagatgttaccgtcatcgcggttacaaaatacgtatcagctgaaagggctcaagaggccgttgatgccggtattacaagtctgggagaaaaccgggatgccgagcttatccataagcaggaagtcatcaaaggaagcccgaagtggcactttatcggcagtcttcagtccagaaaggtgaaggccgtcgttgaccgtgtatcttatattcattccttagacagactgtcattggcaaaagagattgaaaaacgggcgcagcatacggttcgctgttttgtgcaggtgaatacttcgcttgagccgtctaagcacggtttgaaaacagaggaggtcatcccctttatcagagagctttctgagtttagaaacatttctgtagagggcctgatgacgatggctcccctgacagacgatacagaaacgatcagagcctgcttccggcaattgcgtgatctgagggatcaggtgcaaaaactgaatcagacaaacgcgccgtgccgggaactgtcaatgggcatgtcaaatgattatgaaatcgctgttgaagagggcgcaacttttatcagaatcggctcttcattagtcggaaatgaaccggggggtgtaaacaaatgagcatgaaaaataaactgaaaaactttttctcaatggatgaggaggagtacgagtacgaatacattgaaacggagcaggatcatcaggaagagcatgaacagcagaaagataaacagcctgcttacgctcagaagccgcagggcaagcagaacgtagtaagcttgcaaagtgttcagaaatcctctaaagtggtcttgagtgaaccgcgtgtatatgcggaagcgcaggaaatcgccgatcatttaaagaacaggcgggcggttgtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgctggatatatccccgattgtagcgattatcgtgcttcggtttgccacgacgggactttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggtgcttgaatggaaacagattgtcctggaccagtatcggatgaagctgactgatttcttagatcccagggaacaggtgattgtaaaagccgttatcggcgacgcctgcggtcttgcgtttttcggaggatatgacagagctgagcgcaaacgcgcgattttataccctgaatatatggaacctgaacaggatgattttgagctccgggcttttgacgttcaatacgctgaaaaattcgtcagcattgaccaccgctctcttctaggatcattaatgggggtcggcttaaagcggcagaaatacggcgatctgattttctcagaggaagccgtgcagctcatcgtctccggtgaaatcgccgattttgtcagcactcagctgacgaaggcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccggcagaaagcgcaggcgcttgtgaaaaacgggctcgttaaggtgaattggaaagctattgaagatccgtcttttcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagcagcagaagacgtaaagcgcaactcgcagaaagaagcgaagctgatcgtccgtgaagcagaaaaaaatgccgatcgcatcatcaatgagtcactttccaaatcaagaaaaatcgcaatggaaatcgaagagctgaaaaaacagtctaaagtcttcagaacacgtttccaaatgctgattgaagcgcagcttgacctgctgaagaacgatgattgggatcatctgctggaatacgaagtcgacgcggtatttgaggaaaaagaataattttctgattttcttgacattcttcggcccgttcgaatataatacgttcataaattcagatgaaaagacgattgaaagggaccggcatgactcaaaacaggctataaagcgaaccggggaaggtgaaagcccgggatggccggaatcatgcagatcagccctttagtttcctttctgaacctagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcggggaaatctgccgaatcgtgagccggacatgcaaaaagactgggaggagcaggacatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaagtaaaccggaaagaaatgtccgtcgctgatttccgcaagctttgcgaagattatgcatggcagcagatcgaaagacagcgcgaacaattcaagcgtctcggcgtcagaggcgattgggaaaacccgtatgttacgcttcagcctgaatttgaagcgcagcagatccgcgttttcggcgagatggcgaaaagaggctatatttataaaggtctgaagccggtcaactggtcgccttcaagtgaatctgccttagcagaagcggaaattgaatatcaggacaaacgttccgcgtctatttatgttgcgtttaaggtgaaagacggtaaaggcgttctggaaaacggagaaagcttcatcatctggacgacgacgccgtggacgatgcctgccaacctcggaatttccgttcatcctgatcttgaatacaatgtcatcaaggttggagacaagcgttatgtagtggcggctgaactgatcgaaaacgtagcggaggcatgcggctttgaaaatcctgaagttgtcgcatcatataaaggcagagaattagaatacatcactgcagaacatccgctgtacggcagagattcactcgtcatgctcggtgaccacgtcacaaccgatgccggaacaggctgtgttcatactgccccgggccacggggaagatgactttatcgtcggccaaaagtacggcttagaagtactgtgccctgttgatgaaaaaggaaacatgaccgacgaagcgccgggctttgaaggaatgttttacgataaagccaataaaccgatcacggagaagcttgaagaaaacggcgcgcttttgaaactcgagtttattacacactcctatccgcatgactggagaacgaaaaaaccgacgatcttcagagcgactgcgcaatggtttgcgtcaattaaagatttcagatccgatctgcttgatgccatcaaacaaacgaagtgggtgccggagtggggcgaacagcgcctttacaacatggtgcgcgaccgcggtgactggtgtatctcaagacagcgcgtctggggggttccgatcccggtattttatgcagaaaacggtgagccgatcatcactgacgaaacgattgaacacgtgtctgagctgttcaaacagcacggctcaaacgtatggtttgaaagagaggcaaaagacctcctgccggaaggatttacacatccgggaagcccgaacggaatcttcacgaaagagcaagacattatggatgtatggtttgattcaggttcttcccatcaggccgttcttgaagaacgagatgatcttgtccgtccggctgatttataccttgaaggctctgaccaataccgcggctggtttaactcatctctttccaccgctgttgcagtcaccggcaaagcgccgtataaaggcgtattaagccacggatttacacttgatgcaaacggccgtaaaatgagtaaatcactcggcaatacgattgacccgacaaaaatcgcaaaacagcttggagctgaaattctgcgtttatgggtatcttccgtaaactatcaggccgatcacccggtttctgaagatattctgaagcaggtcgcggaagtataccggaaagtccgcaacacgttccgcttccttcacggcaacctgttcgattttgatccaagcatcaatgccgtggatgtaaaagatctccgcgaagtggatcaatatatgctgatcaagctgaataagctgatcgataaggtgaaaaaagcgtacgatgaatacgaatttgcggttgtttatcacagcattcacaatttctgtacgatcgagctcagctccttctatcttgattttgcaaaagatgttgtgtacatcgagcatgcggatcatccggaccgccgcagcatgcagaccgtcttttatgaaacgctgctggcgttagtgaaactgacggcgccgattctcccgcatacggcggatgaaatgtggtctcacttatcatttgttgaagaagcgagcgtgcagctgacagatatgccggaaaccattgctgttccggacagtcaggcgacagaagaaaaattcgaccgcttcatggagcttcgaaacgacgtgctgaaagctttggaaacagcccgtaacgaaaaaattatcggaagatcattggaagcgagcctgactttgtatccgaacaaagaaaaccgcgacctcttgtcatccattaaagaaaacatcgcgcagctgtttatcgtctcagaactgacagtaaaagacgaaagtgaagcgccggaaaacgcgcaaagctttacaacaggaaaaatgaccgtagaaaaagcggaaggccagatgtgtgagcgttcccgcgtaatttctaaagatgtcggagccaatccgaaatatccgacattatcactgcgcaatgcggaaatcgttgaaaaatattatcaaaaataataaatgagaaagcgcccggtgtcagccgggcgcttttttacatgccagcaatgtcatcgattagaacggcaggaaaattcttatgggcttcaaatggcgctctgagggcaacaataaagctataacatcaagagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggatgttcttcttgccctgtctaagtttgaaaacaatacgtacggttattgtgaaaaaacaggcgcccccattccgattgaaaaacttgcggtgctgccgacggccagaaccgctgatgatttttattatcccgctcaatttgaaaagaaaacccttccatactgggtaaccggagattatgcatatgatcaggcgctgtatgagtgacagcgtctgtttgtatacgcttatgatctgcctttactccggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcgaccaggtgctttatatcacatctcatcgcaacacgggagcagcgtgggggattttagccggccaaatgtggtttttctacgtcattaccatcgccgtgattatcggaatcgtttattacatacagcgttatgcaaaagggcagatgttactcggaatttctctcggcttaatgctgggaggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcaatgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaagaccaggatgtcttggttgtgaacaaaccgcggggcatggtcgtacatccggctcccggccatgtgacagggacgctcgtaaacggactgatggctcactgcaatgatctttcaggcattaacggcgtcatgcgcccgggaatcgtccaccggattgataaagatacctccggcctgttaatggtcgccaaaaacgatatggcgcatgaatcactcgttaatcagctcgtcaataaaactgtgacgagaaagtacacagcggttgtccacgggttgatttcacatgatgacggtacgattgacgctccgatcgggagagataaaaaagatcgtcaaagcatgaccgtaacaagagaaagcagcaaaaacgccgtcacgcatttccacgtgcttgagcgttttcaagacttcacgctcgtagagtgccgtcttgaaaccggaagaacgcatcagatccgtgttcatatgaaatatatcggatttcctttggcaggcgacccgaagtacggaccgagaaaaaccattgatttcaacggtcaggcgcttcatgccggaatattaggttttgaccatccgcggacgggcgaatacatggagtttgaagcgccccttcctgaagatatgaaaaaactcattgaacatttgagaaatagccattgacagcgagtttcttttctgaaataataaaaacaagctgaatagattctttaacacagtccagagaggctgagaaggataacggataggacagaagagatacacgtgtgtcttggtcctggaaaggaacccctctatgctctggcaggaggggttttttcttcttatatacgaatggagaggtgtcacgattgaatcaaaaagctgttattctcgacgaacaggccatcagaagggcgctgacaaggatagcccatgaaatgatcgaacggaataaaggaatgaatgactgcattcttgtagggattaaaacaagaggtatttatttagcgaagcggctggccgaacggatcgaacagattgaaggaaatccggtcaccgtcggggaaatcgatatcaccctttaccgtgacgatctcacaaaaaaaacgagcaatgaagagccgcttgtaaaaggcgcggacattccggccgatatcacagaccaaaaggtcattgtggttgatgatgtgctttataccggccggacggtgagagctgcgatggatgctctcgttgatgtcgggcggccgtcatcgatacagcttgccgtgcttgtcgacagaggacaccgggagctgccgatcagagcggactatatcgggaaaaacattccgacctcaaaagctgaaaaagtgatggttcagctgagcgaagttgatcagactgatatggtcgccatttacgaaaatgaataaccaccctttttaaatgcattccagagagtttgcaaagaggattttaaaacacaaagccgggcggatcgacgcggccgggctttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggttcaaccatactcgtgccgaaactggtcggaatgagcccggcagtggcgcttgtcacgagcggaatcgggacactcgcctatctcttggtgacaaaaggccagattcccgcttatctcggctcatcattcgcctttatatcaccgattatcttggtgaaggcgacgggagggccgggggctgccatggtcggcgctttcctggcgggaattgtgtacggcctgatcgcgcttctcatcaggcagcttggaacggggtggctgatgaagctgctgcccccggtggtcgtcgggccggtcatcatcgtcatcggcctcggactggcaagcacagccgtcaatatggcaatgtatgctgatccgaatgcgaaggaactcgtttacagcctgaaacatttcagtgtagccggcgtcactttggccatcaccattatctgcgccatctttttacgaggatttttaagcttgattccggtattgatcggcattataggcggatatctgtttgcgctgacacagggcatcgtcaattttcagccggtcattgatgcaaaatggttcgccgttcctgaatttatcatccctttcaaagactacacgccgtcagtgacattgggcattgccgctgcgatggtgccggtcgctttcgtgacgatgtcagaacatatcggccaccaaatggtgctgagtaaagtcgtcggacaggattttattaaaaagccgggactgcaccgctccataatgggggacagcgtagcgacgattatcgcttcgttaatcggcggcccgccgacgacaacatacggcgaaaacatcggtgtcctggcaattacgagagttttcagcgtctttgtcatcggcggcgcaggagtgattgcgctgtgcttcggatttatcggcaaagtttcagcgctgatcagctctgttccgtccgcggttatgggaggcgtttccttcctgctcttcggaatcattgcctccagcggcttgagaatgctgattgacaacaacattgattatgaaaacaagcgaaatttaattatcacatccgtcatcctcgtgatcggcgtcggaggggcttttattcaagtatcaaaaggcgggttccaaatatccggcatggcgcttgcggcaatcgtcggagtcatcctgaaccttatcctgccgcatgcaaatgaagaagacgcgattgcatcggaaaaactaaatcatatgtaaaccttttaaagaaagtccagagaggcttggaagggttataacgggaagacgctgtacggctcttctctctttaaccgcaccccgagtctatagaccggggtgttttttacggccttcaagcggaaacggaggagaaaaaacatgaatcatttaacggcgatgtctgaactgagcgcggctgaaattacagaactgctgcgagaggcaaaagcgataaaagagggtgcagtccgtcccgatctcgcgggaaaattcgttgcgaatctgttttttgaaccgagcacgagaacgcggttcagctttgaagtggcggaaaagaaactcgggatgaacgtgctcagcttagacggcacgagcacaagcgttcaaaaaggcgagtccttatacgacacggtcaaaacactggaatcaatcggagcggacgcctgcgtcatcaggcacagcacggatgaatattacaaagatctgaccggcagagtcaatattccgatcttaaacgcaggagacggctgcggacagcacccgacccagtcattgcttgatttaatgacgattcaagaggaatttgagacctttcagggcctgacggtttccattcatggcgatatcaaacacagcagagtggcaaggtcaaatgccgaggtgctgacaaggctcggcgcacgtgtgctgttttccgggccgccgcagtggcaggatgagaaaaacgccttcggcacctgtgttcagacggatgaggccatacaagcttcagatgtcgtcatgctgctccgcatccaaaatgaaaggcatcagacagaagccgaccaaaaaggctacctggaagcatacgggctgaccgaaaagcgggcgcagagcatgaagcggcatgctatcatcatgcatcccgcaccggtgaacagaggagtcgaaattgacacaacattagtggaatgcggaaaatcaagaatctttaaacaaatggaaaatggtgtgtatatcagaatggcagtcttaaaaagagcactgcaaaccaatgtgaaaaggggagaagcggcttatgtcttatctcattaaaaacggctggatattaaatgaacagggagaaaaagcggtacatgatatccgggtaacgggtgaattcatttcggaaaccgggcttctgacagcgaaagacggagaaacggtgatcgacgctgagggactgttcgtttcacctgggctcgtagaccttcatgtccacttcagagaaccgggcggcgagaaaaaagaaaccattgagacgggctctaaagccgcggcgcggggcggttttaccacagtcgccgccatgccgaatacaaggccggtgccggatacgaaagagcagatggaatggctgcaaaacaggatcaaagaaacctcatctgtcagggtccttccttacgcatcgattacgatcagacaaaccggcgaagagatgacagattttgaggcgcttcatgaagcgggcgcattcgccttcaccgatgacggcgtcggagttcagacggccggaatgatgtatgaagccatgaaacgggcggcttcaataaataaagcgattgtcgctcattgtgaggataactcacttatttacggagggagcgtgcatgaaggttctttttcaaaagcgaacggcctgaagggtataccttccatttgtgaagcggtacatatcgcccgtgacgtgctgctggcggaagcggcgggctgccattaccacgtgtgtcatatcagcacgaaagaatccgtcagagccgtaagagacgcaaaaaaagcgggcatccgcgtgacggcggaagtatcgccgcaccacctgctgctttgtgacgaagatatcccgggacttgataccaattttaagatgaatccgccgcttcgcagcaaagaggacagagaggcgctgattgaagggcttttagacggcacgattgatttcatcgccactgaccatgcgccgcatacagaagaagagaaaaacacggacatgaagcttgcgcctttcggtattgtcgggttagaaactgcctttccccttctgtacacacattttgtgaaaaacgggacgtggacgctgaagcagctggttgatttcatgacggtaaaaccttgcgaggcattcggtcttccgtacggaacgcttgcaccgggggcgccggctgacatcaccctaattgatctggacaaagaagcggccattgacaaagatacatttttatctaaaggaaaaaatacgccattcaacaagatgaagtgcttcggctggcctgttgcaacgatggctgccggtaagcttgcatatgaagaagggagactcgtcaaatgaaaagaagactagtgctggaaaatggagcggtatttgagggtgaagcattcgggagcctggagcataccgcgggtgaagtcgtattcaacacgggaatgaccggttatcaggaaattttatcagacccttcttactgcgggcagatcgtgacgctgacgtatccgctgatcggcaactacggaattaacagagatgactttgaatctatcactccttttgtaaaagggctgatcgtaaaagaactgtgcgagctgccttccaactggcgctcggcttacacgcttgatgagtatctgaaaatgaaaaatatccccggcttacaagggatcgacacgcgaaaactcaccagaatgatccgcacggccggggcattaaaaggaacgtttgcttcaagtgaggagaatgtcggagaggttcttgcaaggctgaaagaaacggaactgccgagaaatcaagtcgctcaagtatcggcgaaaacggcatatccgagtccgggccgcggcaaacgcatcgtgctcgtcgatttcggtatgaagcacggcatcttaagagagttaaacaaaagaaaatgcgatgtcatcgttgtaccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgtctcggccatcaattatttgcgctggcatcgggagcggaaacggaaaaaatgaaattcggacacaggggttccaatcatccggttaaagagcttgcgacagggaaagtcgctttaacagcccaaaaccatggatatacagtttcttcaatagatgagacagagcttgaagtgacgcacattgcgatcaatgatcaaacgatcgaaggactcaagcataaaacattgccggcatttacggttcagtaccaccctgaagcttcaccgggaccggaagacgccaatcacttatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagtcattctcgtcaactcgaatccggcaacgattatgacggatacggaaatggctgatcgggtatacatagaaccgctgacgccggagtttctcacgcgtattatcagaaaagaacggccggacgccatcctgccgactctgggaggacagaccggactgaatcttgccgtcgagctgtctgaactcggggttcttgaggaatgcggagtggaagtgctcggcacaaagctgtccgccatccagcaggctgaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctcgaatgaagcggaactgaaagagatcgtcgaaaacggattaaagctcagccccgttcatcagtgtcttctggaaaaaagcatcgccggttacaaagagatcgaatatgaagtcatgagagacagcagagatcacgcgatcgtcgtctgcaacatggaaaatatcgatccggtcggcatccatacgggcgacagcatcgtcgttgccccgagccagactttgagcgaccgggaatatcagcttttgcgcaatgtttcattaaagctgatccgcgcgctcggcattgaaggcggctgtaatgttcagctcgcgctcgatcccgacagcttccaatattacattatcgaagtgaatccgcgagtgagccgctcatctgccctcgcttcaaaagcgacgggttacccgatcgcaaagcttgcggcgaaaatcgcagtcgggctttctcttgatgaaatgatgaatcccgtaacgggaaaaacatatgcggcttttgagcccgcgcttgactatgtcgtttctaaaatcccgcgctggccgttcgacaaatttgagtcggcaaaccgcaggctcgggacgcagatgaaagccaccggagaggtcatggccatcggacgcacccttgaagaatcgctgttaaaggcggtccgctcactggaagccgatgtctatcacctggaactgaaggatgcggaagagatttctgacgggcttttggaaaaacggatcagaaaggccggagatgaacggctgttttatcttgcagaagcgttcagaagaggctacacagtggagcagcttcatgagttttccgcaattgacgtattctttttgcacaagctctgtaagctggtcgcttttgaaaccgagctgaaagcggaaaaaggcagcctcgccgtcctgcagacagcgaaggaactcggtttctccgacaaatatatcagccgggaatggaatatgccggaacaagagctgtatcaaatgcgaaaagaagcagccatcaagcctgtatataaaatggtggatacatgcgcggcggaattcgaatcagaaaccccgtacttctacagcacatatgaggaagaaaacgagtctgaggtaacatcaagaaaaagcgtcgtcgtcctcggctccggcccgatccgcatcggacagggcgtcgaatttgactatgcgaccgttcactctgtctgggcgattaagcaggcaggatatgaagcgattattatcaacaacaaccctgagacggtgtccactgatttcagcatatcagacaaactgtattttgaaccgctgacggtagaagatgtcatgcacatcattgatttggaacagccggaaggcgttgttgtccaattcggcggccagacggcgatcaaccttgcggaagaattgagcgcccgcggcgtcaaaattctcggtacatcacttgaagatttagatcgtgcggaagaccgggataagttcgagcaggcgcttgaggcgctgaatgtgccgcagccgctcggaaaaaccgccgtgtcggtgaacgaagcggtcaaaatcgctgcatccatcggctatccggtacttgtccgcccttcgtatgtgctcggcggccgggcgatggaaatcgtctatcacgaagaagaactgcttcactatatgaaaaatgcggtcaaaatcaacccgcagcatccggtgttaatcgaccgttatctgacggggaaagaaatcgaagtcgatgccgtatctgacggtgaaacagtcgttattccggggattatggagcatatcgagcgggccggcgtccattcaggggattcaatcgccgtctatccgcctcagtctttaagcggagacattaagaaaaaaatcgaacaatacactgttgccttggcaaaaggccttaacatcatcgggttgctgaacatccagttcgtactttcgcaaggtgaggtgtatgtgcttgaggtaaatccgcggtcaagcagaaccgtgccgttcttaagcaaaatcactaagattccgatggcgaatctggcgacaaaggtcattctcggccaaaagcttgctgatttcggctatcaagaggggctgcagcctgaacagcagggggtgttcgtgaaagcgcctgtcttctcattcgcgaagctgagaagagtggatatcacgttaggccctgaaatgaagtcgacgggagaggtcatgggcaaagattcaaccttggaaaaagcgctctataaagcgctgattgcctcaggcattcaaatcccgaactacggttcagtgctgttgaccgttgctgataaagataaagaagaaggactgctgatcgccaagcggttccacgccatcggctataaaatcttggcgacggaaggaacggcggcttatttgaaagacgctcagattccggctcaagtcgtcgggaaaatcggcgaagaagggaaaaatctgctcgatgtgatcagaaacggagaagcgcaatttgtcatcaatacgctgacaaagggcaaacagccggccagagacggcttcagaatccgccgcgaatccgtggagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagaaattgccgaccggatttataagatggtgctgaaaggagagcttgtccggcaccttaccgagccgggacaatttcttcatctgaagatgagtgacgcggtcacaccgctattaagaagaccgctcagcattgcggacgtcaatttcgccgcggatgaagtatccgttatctacagagctgacggtgagggaacgcgccttttgtccgggaaaaaagagggcggcaaaatagacgttctcggccctctcggcaacggatttcccgtgcggcggattgaacccggcaaaaccgcgctgttagtcggaggcggagtgggggttccgcctttgcaggaactgtcaaagcgcctgacggaaaaaggcgtaaacgtcattcatgtgcttggatttcaatcagcaaaggatgttttttacgaacaggaatgccgtgcgtacggagacacttatgtggcgacggctgacggaacatatggagagaaaggatttgtcaccgatatcatccgtgaaaagcagctcgaattcgatgtcctgctaagctgcggaccgacaccgatgctgaaagctctgaagcagcagtacggccataaagaggtttatctttcgatggaagagcggatgggctgcggcatcggggcctgcttcgcctgcgtgtgccgcacgggtgaaagcgatacatcctatgtaaaggtctgccttgacgggccggtatttaaagctgaggaggtggcgctgtaatgttagaggtgaatctgccgggtctccaattgaaaaacccgatcatccccgcttccggatgtttcggtttcgggaaagaatatgccggattttacgatttatcatgccttggaggcattatgattaaagccacgacgaacgaagcccgcttcggaaatccgacgccgagagtggcggagacaagcgcgggaatgctgaatgccatcggactgcaaaatcccggccttgagcatgtgctcaatcacgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacgggggggattgcttttggtactgatcccgtcatggcggccgaactgacaaaagcggtgaaagaagtttccgcagtgcctgtgtatgtgaagctttcgcctaatgtcgcaaacatagccgaaattgccaaagcgattgaagcggccggtgctgacggtctgacgatgattaatactctcatcgggatgaggctcgatctcaagacgggccggccgattttagcaaataaaacgggcggactgtcaggcccggcgatcaaaccggtcgccatccggatggtatacgaagtcagccaggccgttcaaattccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccatgtgctgcgccaacacggctttcaatctgtaagtgaatgcatcggaaggagctggaaacatgaaaaacaacctgcccatcatcgcgcttgattttgcatcaggggaagagactttaacgtttttagacttgtttgaaaaggaaaggctctttgtcaaaacggggatggaacttttttatcaggaaggccccgccatcattcaccaattaaaagaacggaactgtgatatatttttagatttaaagcttcatgatatcccgactacggtcaataaagcgatgaagcggctggccggcctcggcgttgatctcgtcaatgtgcatgcggcagggggtgcacgcatgatgcgcgcggcccttgaggggcttgaagaaggcacgccggcaggcagaaaacgcccgtctttaatcgcggtgactcagctgaccagcacttcagagcaggtggcgagggaagagcttctgctgcataagccgctgttagaaacggttgtgcattacggcaaaatggcggaagagtgcgggctggacggagtggtatgttcggtccatgaaacaaaagccatttatgaagcggtccggccttcatttctgacagtcacgccgggcatccgcaccgccagtgacgcagctgacgatcaagtccgtacggcgactccgtcatttgcgaaagaaaacggttcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgcccgaatgagccgtttacgtgggcgagcggcattttatcaccgatctattgtgacaaccgtctgacattgtcgtttccaaaagtgagaaatgatgtggcggacgggctcggcaaactgctgaaagagcattttcccgaggcggagatgatcgcgggcactgcaacggcgggcattccgcatgctgcgcttctcgcagaccgtacaggcgcgccgatgtgctacgtcagaagcaaaccgaaagcgcacggcaaaggaaatcaaatagaaggcgccattaagaaaggacaaaaaacagtcgtgattgaagacttgatttctaccgggggcagcgtgcttgaagctgcggcggcccttcaaagagagggcgcggaagtcatcggcgtcatttccatttttacatacggactgccgaaagcaaaagaagcctttaaaaaagcgggtcttccttattactcgttaaccgattatgacacgctgattgaagtcgcgcttgaaaacggaacgattcattcagctgacattgaaaaactgaaatcatggaaactgaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgtattgcaaggtgccgcatccagaaaaatgcacagcattttgaagataagggctataccgggtcactgtctttcattccgctggattgaaagttttttatatgaaaaaaagattgagggataagacaaccggcagagaacaacagctgtttgattgtctccgggaggaggaaagaaaaaatgctgacgtatgacacatgggaggaaccggcgattacatttccggaagacgatccctataaaggcgcgctgtccgttttaaaatgggcatacggccactacggagaccagcttgtttacgcgtgcagcttcgggattgagggcatcgtcctgatcgatttaatttctaaagtaaagaaagacgcggaaatcgtgtttctcgatacgggtcttcactttaaagaaacatatgaaacgatcgaaaaagtgaaagaacgttatccggggctgaacattatcctgaaaaagcccagccttactctcgaggaacaggccgaggctcacggagataaactgtgggaaagagaaccgaaccagtgctgctacatcagaaaaattctgccgttaagagaagcgctcgcagggcatccggcatggctgtccggccttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccatgatcaggggtatccgagcatcggctgtgaaccgtgcacttcacctgcgtttaccgcggaagatttgcggagcggcagatggaacggcatggcgaaaacagaatgcggactgcatgaataaaggagctgcccgatggaattagccgctattttattctgtctgttttttgccatgaatatcggagccagcggagccgcggcatcaatgggagtcgcttacgggtccggcgccgttaaaaagaaaacgtatgcgctgatcatctgcgcggccggagtcctgtcaggggcggttatcggcggcggtgaagtcgttaagacgatcagcggcggaatcattcccgaacaaaccattacgctcaccattgtctgcattataatcggagcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgattttttgggtgctcgtaccgttcgtcgcgttctgtttcacttttctcgtatcgaaggtattcagttctctgaatattcgagtcatttcgaaacggaaacagaagattttaggaattgtgctgctttttgcggggttttgggaagctttttcagccggaatgaacaatgtcgcaaatgcggtgggccctttggtggctgcgggcgtactcagcgtgtcaaaaggaacgctgtacggaggcatctttgtcgctctcggcgctctgcttttaggacgcaaagtgcttgaaaccaacgggaaaaagattacgaggttttcagccggagaaggcatactgctttcaggaaccggtgcggggcttgtcattatcagttccgtcttcggtctgccggtcccattggcgcaagtcacatcatcatcaattatcggtatcggaatggccaaaaacgggccgaacgtttttcataaagaagtcgtgaaaacgatgctcaaagtatgggttgtttcgccgtttttgtcactgtcgatttcgtatctgcttgtctccctgctgttaaaaggagattactattccatctttatgatggccagcgtgcttttggcagctggcggagccgccagtctgatgaaagccatccgaaaagagaaacgctctgtccatgaacaaggcgggggcatttaactattaatctgagtttatttatctgttaactgggaggaatcatgtattatgagtttagcaccgcacggaggaacattaattaatcgggtgaatgagcagtatgatcttacatccgtccacaaagaaattgagcttgatttgatttcgttcgctgatttagagctgatcgggatcggggggtacagcccgattgaaggatttttcacagaaaaagattacgtatcagtcgttgaaaatatgcgtctggcatcaggggttgtctggtccctgccgatcacgcttccggtcgattcagaaaaagcggctgagcttgccgtcggcgacacggtgaaactgacttacggcggagaaacatacggcgtcgtcgacatcgaagatatttatacgccggataaacaaaaagaagccgttcacgtatataaaaccgatgatgccgcgcatccgggcgtgaaaaaattattttcacgcggcgatacgtatgtcggcgggccgatcacattaattaaaaaagcgtcaaagcagtttcctgagtttacatttgaacctgccgatacaagacgaagcttcgaagaaaaaggctggaaaaccatcgtcggtttccaaacgagaaatccggtccaccgcgcccacgaatatatccaaaaaaccgcgcttgagacggttgacggcctgtttttgaacccgctcgtcggtgaaacaaaatcagatgacattccggcggatgtcagaatggaaagctaccaggtgctgctcgatcattattatccgaaagaccgcgtattcctcggcgtgtttttggcggcaatgcggtatgcggggccgagagaagccattttccacgcgcttgtccgcaaaaactacggctgcacgcattttattgtcggccgcgatcatgccggcgtcggtgattactacggcacatatgaagcgcaagagctgtttgatcaatttacagcggatgaactcgggattacaccgatgaaattcgagcacagcttcttctgccagaaatgcggcaacatgggaacggccaaaacatgcccgcatgacagagaagaccacgtcattctgtcaggaacaaaggtcagagaaatgctgcgaagcggcgtcatgccgccggcggaattcagccgtcctgaagttgtcgaggtgttgattaaagggctgaaaacgaaagaagaagcaggcgtttcttaaggaggaaaatagagtgacaaatcgtgatatcgtatggcatgaagcctcaataacgaaagaagaataccagcagaaaaacaagcataaaagctctatcctctggctgacgggcttaagcggttcagggaaatccacaattgcaaacgccgcagcgcgcgagctgtttgaacaaggctatcaagtcattgtgcttgatggtgataacatccgccacggcttaaacaaggacttaggtttttccgatgatgaccgcaaggaaaatatacgccgcatcggggaagtggcgaagcttttcgttcagcagggaaccatcgtcatcacggcttttatttctccgttccgtgaggacagagatcaggtgagagagcttgtggcagagggcgaatttaatgaaatctacgtgaaatgcgacctcgatatatgtgaaaagcgcgatccgaaagggttatataaaaaagcaagaaatggtgaaattccgttctttacggggatcgactcaccgtatgaagagccgaaagcgcctgagctcgtacttgattcaggcaaatttgaacgtgaagaatgcaccggaagactggttgactttgtgaaaaacagcttagcataataggtccaaaaaggccgcgcaatcagccggatatcctccgcaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaaacaaagagattttacagtacgccggcgaagaagcggatctgatttactgcggcaagctcccggattttcacattatgaaacaggatacgatcaaccgtttccttgtgaagtatgcgaaaaagggaaaaaccgttgtaaggctcaaggggggcgacccgtttgttttcggccgcggaggcgaagaagcggaggctctcgcgcaaaacgccattccgtttgagatcgttcccggcattacatcaggaatcgcggctgctgcttatgccggcattccggtgacgcacagagaggcgagctccaatgtcgcattcgttacgggacattataaacaagaagacgactttgaagaaaaatggaaagcgctggcgacgggcattgatacgctggtgatttatatgggaattaaaaatatccggcagattgaaagaatgctgctggaaaacggcagagacggcggcactccggcagcctttattcattgggggacgacggacaggcaaaaaacagtcgtctgcaccgtcggcacgctttcagacacagtgataaaagaagaaatcaaaaacccgagcttaattgttatcggtgatgtcgtcaattatcactgcacactggactggtatgcatctgaacagaaaaatccggatttgagcgaggcgttgtaaatgaagcaggcgattttatatatcggacacggaagcaggctgaaaaaagcgcagacagagtcggcggcgtttttaaaagggtgcatgccgcacgctgacgctcccattcaggaaatctgttttttagaactgcaggaaccgtctattgaagcgggatttgaagcttgtgtcagacaaggcgccactcatattgcggctgtgcctttgctgctgttgaccgctgcccacgcgaaacatgacattccggctgaaatcgcccgtgcggcggccctgcatcccgatataaaagtgacatatggtgttccgatcggagtggacgatgaagtcgtaaaagccgtgcatcatcgcattgaagataccggagtgcccattgagcaggcgaaagtggtgctgatcggaagaggaagcacagatccggccgtaaaaaacgcagtcagtgagattgccggaaaacttgaggcgattacacctgttaaagaagtcatcccctgttttttaacagcatgtgacccgcactataaagaagtgtttgccggccttgaagaggatgacggagcacccgtttttatcgttccatatcttctgtttaccgggcttttaatgactgagattgaacgggaagttcaaaagcttcaaacggtcaatcaaaatgttcatctcgcttcatacttaggttttcacccgcatattaagcaggcgtttttgaaccgtgtgacggaagctgtccgaaaccccggcgggcagtttgattttaaggggggacagtatgctgcctctgcacattaatctcagcggaaaaagaattgtcatcgcgggcggaggcaatgttgccttaagaagactcaaaacagtgcttccggaaggcgcggatattactgtaatcagtcccgatgccctgcctgaaattaaacagctggcggatgaaggacgtatccgctgggtttcccgtaaaattgacatgaaggatcttgcgcccgcttttttcatcattgccgcgacaaatgaccgcagcgtgaatcgggagatagccgagggcgcttctgaaacgcagctggtcaattgtgtaagcgaggctgaacggggcagcgtgtatatgccgaagatcatccgcaaagggcgcattcaagtatccgtatcaacaagcggcgcaagccctgcacatacgaaaagactggctgaggacataaagcctctcattactgctgatttggctgaagaagtggatcgattatttgagaaaagaagaagaccataaaaaacaccctgtctgtcatcaggcagggtgttttttatactgtcctgacagtccgccgaatgtgaaaaattcaaaacgaaagcgggcagtttgaatggtatatgccgacaagcggtcaggattgcgaagtgatgcggaatatgtatgtgatcccgatgccgcctggatttcgcccgcatacaaaggaaaggtcagagacccgtccggatgtgctcaggttcggcgagggaaggtgaaagtatccgccgccaaatcaggtgtgaccgtttaaatcacagacggcccggcggatcatgcagacatgacgggaaactgatcagatactgtaaagatcggttctgacggctgggagagtttcgtctccgtttatacgtaataaaaaacacctccaagccgagtgcgggtttcagcttggaggtgcgtttattttttcagccgtatgacaaggtcggcatcaggtgtgacaaatacggtatgctggctgtcataggtgacaaatccgggctttgcgccgtttggctttttcacatgtctgatttttgtataatcaaccggaacggagccggaatctttcgctttggaaaaataagcggcgatcgcagccgcctccagtatggattgttcatccggatcgctgcttttaatcacaacgtgggaacccggaatgtctttcgtgtggaaccataaatcatccctcgcggcagcttttgtcgttaagtactcattttgtttattgtttttgccgacaagaatcgtcaatccccgtgaagattcatattgctccaaaacaggaacgtgctgcttctgttttttctgtcctctctgctgtttcggccgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttcgccttttgatactttgtaaaatacatctgcgcgttttctgacggtgttttgttcggatttaaagggatggtcaccgtcttactttcttcatcataataattgatgacttccgcttctttgtcaccttttttcagcatatacaaatttgccgtcagcagttcgccgtatagctggaattccttcgcattttctgagtagtcgagcgtcttttccagcttttttatcttattggcattctttttccgttcatttgcgacaaaacgctcgagatcctgagcctgctgtttgacgcggtcgcgttccgctttgccgaaataaaaccggtccaacagctcactcagtgagtgaaaggtgcgctcctctccgtttacatgtgtgagagacaggagataaaagtattcctttccgccggctgtcgtaatgttcggtgtaaacctgcaatctttcacggcatggaacatttcaatcagcgtcttcggcagcgttattttgttagcgagacccgctctgtgcacggcttcttttgcaaacagcggagaaacaccggaaaaatgtctgacgatctgctggtcaagccgtccttcctgaaaactgagataacgcaaaacgtcctcttcatccgcggcaagcggcgaaattttttcctgagcgggaggaagcttgtaatcatagcccggcagaacggtccggtagctgttcattgacggagataaatgcttcagcccgtcgatgatggatccttctccgtcagtcagaataatattgctgtgccgtcccataatttcaacatacagcgttcttacggtttcgtcgccgatttcatttctgctttttatgcggaatatcataatccggtctaatccggcctgttctattttctcaataaatccgccttctatatgctttctgagcagcatacaaaacatcggcggctcgctcggattttcataggcctggtttgtcatgtgcacccgtgaatagctcggatgcgccgacaataataatttgtggtttgttccgttggcgcggatatggaatatcacatcgtgcttaaaaggctgatggactctcgtgatccgtcccccggcgatccggctgtttaattcatgtgtcattccgtatgtaaacatgccatcaaaagacatataaaacaccctttccttcttcctgcattcgataattatagcatgaaaagggacgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacgggccgaacgagcttcaggagggcaagaggacaccggcgatcgccgtgtttttcgcccaatttaaagattttatggtgctcgtgctgctggcggcaaccttaatatccgggtttttaggcgaatatgtagatgccgtagcgattatggcgattgtatttgtcaatggggttctcggtttttttcaagagcggcgggcggaaaagtctttacatgcattaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagccgataaattgagaaagccggatgtttcgttaggcgacatcagcaatatggcgtttatgggtacgatcgtaacgcgcggcagcggtgtcggcgtcgtcgtcggtacaggaatgaatacggcaatggggaaaattgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggctggggtgtcattggccgtcgccgcaattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcaggcatcggctatgtgccggagggcgttttcacccgagatgagcgggaaatcaagccgaaagatgagaagattcttgaacagatgctggttttcggcgcgttgtgcaacacatctgaaatcgcactgaaagacggccgttatgtactcgacggtgatccgacagaaggagcgctgctgacggctgcaagaaagggcggctattcaaacgattggctcagcgggcattaccgcgtggttgccgagtttccgtttgactccgtccgcaaaatgatgaccgtcattgtagaggatcaggaaaaaaagcagttcgtcatcactaaaggagcgcccgatgtgctgattgaccgctcatcacatctgatgcacggcgcaagaagtacgcctttttcaggagaaaagaaagcagaaacggaagcggttctgaaagagctggcgtcgcaagctttgcgtacgatcgcgattgcttataaaccgcttaagcccggagaaaagccgacaatggagcaggcggaaaaaaatctgacgatgctcggcttgtcaggcatgattgatccgccccgtccggaggtcagacaggccattaaagaatgccgtgaagccggcattaaaacggttatgatcacaggggatcacgtcgaaacggcaaaggccattgcaaaagatttgcgtcttcttccgaaaaaggggcgtgtgatggacggcaagacgctgaatgagcttacggacaaagaacttatcgaaacggtcgatgatgtctacgtcttcgcacgcgtgtcacctgaacataaattgaaaatcgtcaaagcgttccaggaaaacggacacgtcgtcgccatgacgggagacggggttaatgacgcgccggccataaagcaggcggatatcggtgttgccatgggcgtgacgggaacggatgtggcaaaggaagcctcttctctcattctggtagatgataactttgctacgattaaatcagccataaaagagggacggaatatctatgaaaatataagaaaattcgtccggtatttgctggcctccaacgtcggtgaaattttagtgatgctgtttgcgatgcttctcgctctgccgctgccgctcgtcccgattcagatattgtgggtgaacttagtcactgacgggctgccggcgatggccctcggtatggatcagccggaaggagacctgatgaggcggaagccgcggcatccgaaagaaggagtgtttgcgagaaaactgggctggaaagtcgtatcaagagggtttttaatcggagccgcaaccattttagcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatttatctgctcggcgccatcgtttcttctgtcttcctgatggccatcgtcatctattatccgccgctgcagccgattttcaaaacagtgccgattacgccgggcgattggatgctgattatcgggatgtctggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtcaacagtgacgcgctcataaaaagaagcctgaacatcgattgggagctccttgatgaatatgtgagcgccgcacgcgccatgaaagagcgctacagcctggccgcagaacccgatgcaatggatttctttagatttgaacacattgcgcagattcacgaagaacagatgcgtgatgacaagcttgaagaagtcatcagggaagccgctgagctggctgtaaaggaactttgtgacatgagggaaaaagaaggccggcttttggcggaagactgctttctgcacattgcgcggcttgagacgctgtccgaacaggtgaaagagcgcgcttcggcagttgttattcaataccgcgagcgtctttacgcccgaatgaaggaatggacggaggacgcgctcgacgaaagcaggctgatcacggaatgcgccattttcgccgatcgttctgatataacggaagaaattaccagattaaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggcatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacgaaatttgaatactcaatttcagtcacgacgagaaacccgagagagggcgaggtcgacggcgtcgattatttctttaaatccagagatgaattcgaacgcatgattgaaaacaacaaactgcttgagtgggcagaatatgtcggcaactattacggtacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgagctgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgtgataagattaacgcaatcgttctcgccgagcacttaaaacgtgaacgcgttgctccgagatataagaaaatgctggaggtagaataacttatgttagatccgtcaattgactctttaatgaataaattagattctaaatatacgctggtgactgtgtctgcaagacgcgcgcgtgaaatgcagatcaaaaaggaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggggagaagacttcatgaaaaaccgaaacattttgctatgcgtaagcgggggaattgccgtttataaagcttccgcactcacgagcaagctggttcaggccggcgcaaatgtcaaagtgattatgactgagtccgcgcgtgagtttgtttctccgctgacatttcaggcgctgagccggaatgaagtgtatacagatacatttaatgaacaaaatccgaaggtgatttctcatattgatgccgctgactgggcggatttaattattgtcgcgcccgctacggcaaatatcatcggcaagcttgccaacggaattgctgatgatatgctcacaacgacggtgctggcggctgaggccccggtctgggtggcgcctgcgatgaatgtccatatgtatgatcatccggcggtgaaacggaacatctctgtgctttatcaggacggggtccgctttatcgagccgagtgaaggctatttggcatgcggatatgtcggcaaaggaaggctggaggagccggagcttattgttgagcgtgtcagagagcattttaaggagcctgaagacgatgcgccgctgaaaggaaaacatattgtcattacggccggtccgacgcgcgaagccgtggaccctgtccgcttcttcacaaataaatccaccggcaaaatgggctacgctgctgctgaagccgccgtccgtctcggggcgcgggtgacgctgatttcaggcccggtgtcaatagagccgccagtcgggctgtatcagtttcttcctgtgcaatcggcagccgatatgagagaagccgtgctttctgtgtttgattcatgcgacatggtgattaagacggcggccgtggccgattttacgccggcggctgtttctgatcacaaaatgaagaagaaagacggttcgctcgtgatcgaattcaaccgtacggcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaatgatgtgaaagcggaaggggccggatttggcacggatacgaatgtcgtcaccttctatttccgggacggaagaaaacgggagcttgcgcttatgtctaaacttgacgtttcctttgaaatgctgaaggaaatgacagctttgaaagccgaggaccgaaaacccgtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgacgggtttgaaagattcgtccgaattaaacggcggctcaatgaaggaagtcgagaagcttcttgatttgacgcccgttctgactgaggaactgatgcagctgtcttcatggctttctgacaaaacgctgtcgtttaaaatcacggcgcttcaggcaatgctgcccgccgcattgaaggcgaagtacgagaaagagctgaaagtcgttgacgaagaagcgctgacaccggacatcaaacagcttttcaggaatcaaaaaagtcttctgtactcggatattaccgatgaaagcattctttcgtcacttcagaaattcgtgcgtaaaggaagcattgatgtcacatataaagtcgcccaaaaaacgaataaaaaaatgatccgcatgatcgaagcgggggcagacaaagaagaactcgcccggcacgcagattcattgacaaagcaggcttctaaacagctcgccgtgcttacttattttatcggcgggggagaaaagatttccgcggctgaactttgcaaaaagaccgattccagttccgcgacgctgaaaacgcttcttaaaaaggggcttcttacggaaagctttgaggaggtttaccgtgatccttatcaggacagaatgttcaaaaaaacagagccgctctctcttacagaagagcagcaggccgcttttgagccgattaaacaagctgtagccgaccatgtccatcacgtctttctgcttcacggcgtcacgggaagcggcaaaacggaaatttacctgcaatccattgaaaaagtgctggcaaaaggaaaagaagccatcgtgctcgttccggaaatctcgttgacaccgcaaatggtcaaccgttttaaaggccgcttcggctcacaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcggtatcatgcaaaggacgtagctatccgccgggccgagcatcacagctgtccggtcgtcctcgggagcgccacgccgacattggagtcatttgcgcgggcgaaaaaaggcgtttatgagctgcttccgttaaaacatcgcgtaaaccgccagctcatgcctgacgtttctctcgttgatatgagagaagaactgagaaacggcaacagatcaatgttctcaagagagctgatggaacagctggaagagaagcttgcaaaaaaagagcaggccgtcctttttctgaataaacgggggtattcctcgtttgtgatgtgccgggactgcggttatgtgccgcaatgtccgcattgcgacatttccatgacttatcaccgctacggacaaaggctgaaatgccattactgcggccatgaggaacctgtcccgggaacatgcccggaatgcggcagcgaacatatccgctttttcggcacgggaacgcagcgtgtggaggaggagcttaccaaagtgctgcctcaggcgcgtgtgatcaggatggatgtggacaccacttcaagaaaaggcgcccatgaaaaactgttgtcagcgttcggtgaagggaaggcggatatcctgctcggtacgcagatgatcgcgaaagggcttgattttccgaacgtgacgctcgtcggagtattaagcgcagatacgacgcttcacatcccagatttcagggccgcggagaagacattccagctgctgacacaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccgtattattacgtggcgctggtgaccgtttctcatgaagaagcggcaaaagccgcggtcaccgcagaaaagattacaaactatttaagagcgggatgcgggcctgatacgaaaattctcgggccggcggcttccccgattgccaggatcaaagatagatatcgctatcaatgcgtgataaaatacagacaggaaaacgagttgcagattcagttgaaaaagatactggagcattataaacgcgacattgcgcaaaagcatgtaatgatttcaattgatatgaatccgtacatgctgatgtaacattagtttttggagggcaaaattttggctgtgaaaaaaatcgtcacacacccggcggaggttctggaaacacccgccgatgaagtgacagtgtttgataaaaaattaaaaaaactgcttgacgatatgtacgatacgatgctcgaaatggatggcgtcggtctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagttttcccggggttttcggtgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacggatatgaagtggttggtgtcgttacgcagcctgaccgcccgaaaggcagaaaaaaaatcatgacgccccctcctgtaaaggctgaagctgaacgtcacggcattcccgtgcttcagcccgaaaaagtaaggctcgaagaagaaatagaaaaagtgctaagcctgaagccggacctgattgttacggcggcattcggacagatcctgcccaagcagctgctggacggcccgaaatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattgatgaaacggataacgtcggcacgctgcacgacaaattaagcatagcgggggcaaagcttttgtcagagaccgtcccgaacgtcatctccggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgcggcaaaaactgatgctgcgcccggaacagtcatccgcacggagcaaaacggcattgtcgtcgcatcaggaaacagcaccgcccttttaatcactgagctgcagccggcggggaaaaaacggatgaagggcgaagattttgtaagaggcaaaaatgtgcagcccggtgacgtgttaggagcagcaaatgaagaaaattaatgtccgggagctcgcccttgaagcgcttgagaagcttgagcaaaatcaggcatacagcaacctgcttcttacatcggttatcaaaacgaacacgctcagcgatcaggacagaggactgctgacagagcttgtctacggaacgctgcaaaataaaatcgccttagactatatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcattctccgctccctgcagcgtgagggggcgccgtcatttgctgaaattgaagacccggttctccgtctttctacagagacaagccatcccgaatggctcgtaaaagagtgggtcgaggcgtacggctttgaggcggctgaaaaaatctgccggattcatctcattccgccgaagcagacgctccgtgtcaatcacataaagagcgacagggaaacggtgctgaatgagatggagaatgccggtctggaagcggaagccggagacctttctcctgatgcgattaagcttttgaaaggaagcatcgcgaacacggcatttttccaaaacggccgggtatccatacaggatgaaagctcaatgcttgtcgcgcgggcgctggacccgaagccgggcgaaaccgttttagatgcatgcgccgcaccgggcggaaagtcggctcacattgcggaactgatggagaacgaggggagccttacatcgcttgatcttcaccgccataaagtgaagctgattaaagagggcgcagaacggctcggacttacgatcatcgacgcgcaaacgatggatgcgcgaaaagcgggagaggcctttggcgcagaacggtttgaccgtattctcgttgatgccccttgctcaggtttcggcgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggatcggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaaatgacacaattaaaaaagacaagcgtacggaaagagctgcggactgagcagccgtccatttactcttttgaattagatgaaatcaaacaatggctgaccgagaatggcgaaaagccgttccgcgcagcacagatttttgaatggctctatgaaaagcgggtttcttcatttgatgaaatgacgaacctctcaaaaagcctgcgtgaaaaactcgagagcaattttgtgctgacaacgctgaaaacggctgtaaaacagacatctcaagacggcacgatgaaatttttatttgagcttcatgacggttatacgatcgaaacggttttaatgagacacgagtatggtaattctgtatgtgtaacgacacaggtcggctgccggatcggctgcacattttgcgcatcaacgctcggcggtctgaaacggaatcttgaagcgggagaaatcgtcgctcaagtcgtgaaagtgcaaaaggcgcttgatgaaacggatgaacgcgtcagctcagtcgtcatcatgggaatcggagagccgtttgataatttcaatgaaatgctcgctttcttaaaaatcattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgcacaccgagagatcagattttcgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtccgcttgcgaggattggctgaaagaccggattcatgaggcgaatgtcaaagtacatgatcacgctaaagcgaatgaagaatgccggggaatgggcaccaccattgtctgcgccttattcacggggaagtttgtcactgtggctcatattggtgacagccgatgctacctgcttcaagagggggaattcactcagctgactgaggaccattcgcttgtgaatgagctggtcaagacgggggaaatttcgaaagaggacgccgagcaccatccgcggaaaaatgtattgacgagagcgctggggacagatgaaaccatcagccccgacgcccgttcttttgaactgtctgacggcgatcagctgcttttatgctctgacggactgtcaaataaaatagaagatcacgagatcaaacaaatgcttcaagccgaatctgatcctcaggaaaaagtagaccttctcatcagcaaagcaaatcaaaacggcggcgaagataacatcacggctgtgttgattgagttttccgcagatgcaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaccgcacacggaccgcttcatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcgcttacgtctacgacaatcacacatacgaattctgtgctgggctcggttcattatttgtctccggagcaggcgagaggcggtctggcaacgaaaaaatcagatatttacgcgctcggcatcgtgctgtttgagcttttaacaggcaaaatcccttttgacggagaatcagccgtcagcatagcgctaaagcacctgcaaacagaaacgccttccgccagaaagtggaacccttccattccgcagagcgttgaaaacattattttaaaggcaaccgccaaagacccttttcaccgctatgaaagcgccgaagacatggaggcggacatcagaacggcttttgacgccggcaggctgaatgaacaaaaattttccgtgcaggatgatgaggaaatgacaaaagccattcccgttattactgacggcgcaaaagccgcgtctcaggcggaaacgccgggggagacggatgataaggaacagcagccagccaaaaagaaaaaacggaaatggccgtgggttttgctggccgtctgtttcattttcattatggcggctgttcttgcggtcaccgtgttcccgtctttatttatgcctaaagatgtaagcgtccccgacgtacggggcatgaagtacgaaaaagcggaagccctgcttgaaaagaacgggctccgggctgatcctgatataacggatattgaagatgaaaaaatagaagaggaattaatggtcaaaacggacccaaaagcggggtctaccgttaaagaaggctcttctgtaaaactgtacaaaagcatcggaaaaccgaaaacccagctgatcgacgtgaaaggacggcagatcggcgacgcaaaaaaagcgctgaaggaaaaaggtttcaaacatgtcaatgtcaaagaagaaaacgatgacagcgaggccggcaccgtaattgatcaggacccgtcagccggcaccgatatggtcgcaagcgacgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccggaaggacaagtcatgaaacaagagccgtcagccggcactgcggttaagccgggaagtaatgttgaagtgacgttctcgctcggacctgaagaaaaaccggcgaaaacggtaaaagaaaaaatcagcattccttacgaacccgaacatgaaggggacgagcttgaagtgcaaatcgccatcgatgataaggaccacagcatctctgatacgtatgactcatttaaaataaaagagccgaccgaaaaaacaattgaactgaagattgatcagggacagaaggggtattatcaagtgatggtcgatcataaagtcgtcagctacaaaacgattgaatacccgaaagataatgactgataaggagggaccctatgcctgagggcaaaattataaaagcgttaagcggattctattatgtcttggatgaatcacaggacaagatcattcaatgcagaggccggggcattttcagaaaaaataaaataacgcccctggtcggcgattatgccgtttatcaggctgaaaatgataaagaaggctacctgctggaaatcaaagaacgaacaaatgagctgatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggcgatcggttatgacgtatatgtgacgtcatcaaaagaaaacagcggcttaacaggcattgtgaaacacttcgaggacaaaacgacggtgtttgccggtcagtccggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggttgcggatactccggggttcagttcgcttgaatttaccggcattgaggaagaagagctgggcagcacgttccctgagatcagagaaataagcgcctcttgcaaattcagaggctgtctgcatcttaaggagccgaaatgcgcggtaaagcaagcggtggaagaaggagagattcagccgtaccgctatgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacatcccggcattcgcaaaagccggtgcggacatcctttccgttcacgctgaagcgtgtccgcatcttcaccggaccattcaattgataaaagagcagggggtaaaagcgggagttgtgcttaatccgcatacgcccgtccaaatgattgaacatgtgatcgaggagcttgaccttgtgctgttaatgacggttaaccccggttttggcggacagcgcttcattcattcggttctgccgaaaatccgtcaggtcaaacagctggctgaggagaaaggcctgtctgagcttttaattgaggtggacggaggcgttaataaagaaacagcccctttatgcgctgaagcgggcgccaatctgcttgttgccgggtctgccgtatataatcagccggatcggaaaaaagccatcgctgatatccgaaacgtatcataaacatgctgaaaaagagcccggtgaaagccgccggctcttttcgcgtctaagagagaggatagcatatgaagacaatcaatatcgttgcgggcggcccgcgggagcttattcccgatctatccgaatacacagacggagatacgacgtgggtcggagttgataaagggacggttgctcttttggaggccggaatcattccgcaggaagctttcggtgattttgacagcattacggaagaggagctcatgcagattcaaaaagcggcgccggccctccatgtgtatcaggcggaaaaagattataccgatcttgaactcgcccttgactgggctttacaaaaagaaccggaaaacattcgggtattcggtgtgacgggcggaagagccgatcactttttagggaacatccagctgctgtataaagccttacataagcataacgatgtcaagctgatcgaccggcagaatgacattcagatgttcgggcccggccgttatacaattgaagaaaaagcgcgaaaacgctatatttctttcattccgtttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattagaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaatcgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatctttttaaacatagtgtctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcacctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaacgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaattgatgcccaagagtttgccgcagcactccaagcgggagtggatatggcatataaggcggttatgaaaccggttgaaggaacgattttaaccgtggccaaggatgcggctaaaaaagcggtcgcctcggccaaagaagaaaccgatattatttcagtcatggaggccgttattgaagaagcggaagcgtcgctcaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcagagcatgctgagtacagaagacattgaattcggattttgtacggaagtaatggtgaggctggatcaagataaacggacgttcaaggaagaggcgttcagaaacgaactgagccgtttcggcgattcattgctggtcgtggctgatgatacgctggcgaaagttcatattcatgccgaagaaccagggaacgtactcaatctcgcacagcgttacggcgatctgattaaaattaaaattgaaaacatgagggaacagcatacttcaatcatcagccaagaacatgatgaaaaaaagccggccggtgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtggctgaagaaaatgtcattgtcattccggcaaaaacggtccctcaaggcatgaccgccctgcttgcgtttaaccctgaccagccggctgatgaaaatgaagccaatatgcttgaggccatccggaatgtgaaaagcggacaggtgacatattcagtcagagacacccatattgacggcaaagatattaaaaaaggtgattttatcggcattttaaacagttcaattatcggcagcgccgaagatcggataagtgcggcgaaattgctgctggatgaaatgatcggggaagaagatgaaatcgtcaccatcctgtacggagaggacgcgccggaagaagaagctgagaaactcgctgagtatattgctagtgtctgtgaagatatcgaggttgaaatccataacggcagacagcctctgtatccatatatatttgcggcagaatagaagggcttatcaggcccttctattcttatgcctttatttacctgcggcagtgcggcagtgtgcctgcttgccaattgagaaatgttcaattagtctaaagaaaagcgctgaatgaagtgatgttaaggaggagcaaaccagcatgaagtatagaagcgtttttgatattatcggcccggtcatgatcggtccgtccagttcacataccgcaggcgccgcccggatcggcagagtggccagaagcttattcaggcgggagccccgccggatcgttgtgtctttttacggatcatttgcagaaacgtataagggtcacggcactgatgtcgcgattatcggcggcctgcttgatttcgatacatttgatgaacggattaaaacagcgattcaaattgcggaagagaagggcatatatgtagagttccgtacagaggatgccgtgcccgttcatccgaatacggcgcgtatcgtcatttctgatgatgagggagagcttgcccttaccggtatttccatcggcggcggaaaaatagaaatcacggagcttaacggctttgagctgcgactttccggaaaccacccggctattttagtcgttcacaatgataaattcggcacgattgcaggcgttgccaatgtgcttgcgaaattctccatcaacgtcggacatatggaagtggcgcgtaaggacgtcggccagcttgcgctgatgacgattgaggtcgatcagaatattgaagaagaagtgcttgacgagctttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacccaagagatggaagtgacgcaaaaaacacgggaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctgtcgggcaatctgattttagacgccgtttctaaagctgtggcgacaaatgaagtcaatgcggcgatgggaacgatctgcgctacaccgaccgccggctctgccggggttgtgccgggaactttattcgccgtaaagcataagctgaaccctacgacagaacaaatgatccgttttctgtttacagccggcgcgttcggttttgtcgtagcaaataatgcgagtatttcaggagcggcaggaggctgtcaggcggaagtcgggtcagcatcaggcatggcagcggccgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcgatgatcgcggcggatatggcgctggccgggattacaagccgcattccttgcgatgaggtgattgacgcgatgtacaaaatcggccagacaatgccgacagcactgcgtgaaacgggacaaggcggtttagctgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttataacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctgtcgtcacgatatctgggaagtgggataaacacagacagaccgtttccgtgcaggaattaaaaaacggtcctcatcaagaagataaaagcattgagcctgtttattccgttaaagaaaacgtcaccgtaaaaatgatgagacggtttattaaggaagcgctgcagcatcatttggacagtgcggccgatccgcttcctgaaaaattaagaatccgctataagctgcctgattacaaacatgccctgcagacgatgcatcagcctgaaacgagggaatcgttacagcaggcaagacgccggtttgtttatgaggaattcttattatttcagctgaaaatgcaggcgttccgtaaagcggaaagggaacagtcaaaaggcatcagccatgtgtttcctgctgaaaagctcaccgctttcacagacagcctgccgttttcactcacgaccgcacaggcgcgcgtgcttcgggaaattaccgctgatatgacatccccttaccgaatgaaccgtctgctgcaaggtgatgtcggttcagggaaaacggccgtcgccgccatcgctttgtacgctgcgattctgtcggggcatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggatgaagtagaattcaaagcgctgagtcttgttattacggacgagcagcaccggttcggggtcgaacagcgcaaaaaactcaagaataaaggtcaggatccggatgtgctgtttatgacagccactccgattccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaagcagggaaggcaagcctatattatctgcccgctcattgaagagtcggataaactggatgtacagaatgcgattgacgtatataacatgctgtctgacgtttaccgcggtaaatggaatgtcggcctgatgcacgggaagctccattctgatgaaaaagatcaagtgatgagagaattcagcgccaatcaatgtcaggtacttgtgtcaacaaccgtcgtagaagtcggggtgaacgtgccgaatgcgacgattatggtcatctatgacgccgaccgtttcggattatctcagctccatcagctccgcggccgggtcgggcggggagaccaccaatctttctgcatcttgatggccgatccgaaatccgaaaccgggaaggaacggatgagaatcatgtcagagacaaacgacggcttcgagctgtctgaaaaggaccttgaactgcgcggccccggtgatttcttcggaaaaaaacagagcggtatgcccgagttcaaggtggcggatatggttcatgactacagagctttggaaacggcccgccaggatgcggccaatctggtgtcttcagaggctttttggaaagatgacgaataccgcatgctgcgcggtcaattactttcaagcggcgtcctagaaggggagaaattaagctgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcattgtctttagacgaagtgatcggtgaaatcattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacgatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacaggcgcactcatgacagcgggactgtttatcgtcggcagaattaaaggaatcgaccggcctgcgcttgcgccgacgcttccgaccgtttcaggcgacggtttccttcttttggacgtgggcgccaatgtcgatgccaaaccggagcacctcgtccagtacggaattatgggatctgtatatgcccggcaggtcctcggaatcagctcgccccgcgtcggattgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgtttctaagctcgcagcgggagtgctgaagccgaagctgatggaaatgaaactgaaaatggactattctgagtacggcggggcgagtcttttcggtttgaaagcgcccgtcattaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggtatgggaaaagacctgtacgaacgcgaagaagcgtcaaaacgtatttttgatgaagcggatgaaacgcttgaaacaaagctgagctcgctcatttttgaaggtgacgccgaagaattgacccttacatacaatgcgcagcctgcgctgttgacaacgagcatcgccgtattggaaaagtttaaagaatccggcatcacccctgatttcaccgccggccacagcctcggagaatattcggcgcttgttgcggcgggagcgatgacatttaaagatgccgtttacacggtaagaaaacggggagaattcatgaatgaagccgtgccggccggagaaggcgccatggcagcgattctcggaatggatgcggagtccttgaaaaaggtgacggatcaagtgacggaaaacggtcatctcgtacagcttgcaaatctgaactgccccggccagatcgtcatttccggaacggcaaaaggcgtggagctggcttcagaggaagcgaaaaacaacggagcaaaacgggcgatcccattagaagtaagcggaccgttccattctgaattaatgaagccggcagcgcaaaaactcgaggaggtgctcagcgcctgtgagttaaaaaatgcggctgttcccgtgatttcaaacgtttcggctgacgttatgacggaaaaagacgatatcaagaaaaaactgatcgaacagctgtattcgcctgttcgctttgaagaaaccattaacaaactgattgacgaaggcgtcacgacgtttgttgaaatcgggcccggaaaagtgctttcaggccttgtgaaaaaagtgaaccgccgccttaaaacaatctcggtttctgaccatgaaaccatcgaactggcgattcaaacgctgaaggaggagaatcaggatgcttaatgaaaaaacagcagtggtaacgggagcgtcccgcggaatcggtcgggcgatcgcgcttgatcttgcgaaaaacggctgtaatgtagtagtcaactactccgggaatgaagcgaaagcgaacgaagtcgtagatgagatcaaatctttgggccgaaacgcgatcgccgtaaaagccgatgtatcaaattccgaagaagtacaaaacatgatgaaagaggctgtcgctgcattttcttcaatcgacattctcgtgaacaatgcggggatcacaaaagacaatcttctgatgagaatgaaagaaaatgaatgggatgatgtcattaacattaacttaaaaggtgtattcaactgcacgaaagccgttacaagacagatgatgaaacagcgctccggccggattatcaacgtatcatcaatcgtcggcgtcagcggaaaccccggccaggcaaactatgtggcggcaaaagccggtgtaatcggcttaacgaagtcatcagccaaagagcttgcgagccgaaatattacggtcaatgccattgctccgggctttatttccacggatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgcctgacagcggggctttagccctttaatcgttcggttaccggcgtctgacgctgtacgcgctgctgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaacgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccacgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagagtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgctcgtctctcttaaaggtgaggcgctcggtatcgggaacggacgttccaaaaaagaagccgagcagcatgcggcacaggaagctcttgcaaaattgcaaaaacatcatacgaaacaataaaatccccctgtatccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcagcccgctcgcttcggggcggaaaaatggaagatatcatttttgcgggaagtgattcgcgcaagcggctgaaccttgccgaagtcacgttaacgcttgataatgaagatcattttctcccgatcgattatcacgaagtcagcgtgacgaggcgggtgtaccgttccggagaaagtgaatttctcatcaacaatcagcagtgccgcctgaaagacatcattgacttatttatggactccgggctcggaaaagaagcattctccattatcagccaggggaaagtcgaagagattctcagcagcaaagcggaagaccgccgcagtatttttgaagaagcggccggcgtgctgaaatataaaacacgaaagaaaaaagcggaaaacaaactgtttgagacgcaggataacttaaacagggtggaagatattctccacgagcttgaagatcaggtcgaaccgctgaaaatccaggcatcaatcgccaaagactacttagaaaaaaagaaagagcttgagcatgtcgaaattgcccttaccgcctttgacatcgaacaactgcatggcagatggtcgggtttaaaagaaaaggtgcagacggcaaaacaagaagaattggcggaatcatcagctctgtccgcaaaagaagcgatgatagaagagacgagagataaaatccacgcgcttgatgaatccgtcaacgaactgcagcaggtgctgctcgtgacaagtgaagagctggaaaagctggaaggccggaaagaagtgctgaaagagcgcaaaaaaaacgccgcgcaaaaccgggaacagctagaggaatccgttacacattacacgaacaaagaagccgaactgaaagcggacattgaaaaacagtctgccgtctatgataaacttcgtgcggaagtgaagcggttaaacgcccaggtgaaagaaaagcagcaggctctcagtctgcataatgaaaatgtagaagagaaaatcgaacaattaaaaagcgattactttgaattgttaaacagccaggcgtcgattcgcaacgagctgcagcttttagatgatcagatgtcccaatctgcggtccagcaggcgagactgaccgcaaacaatgaaaaataccttgaagaacgtaacgatattgcagtccgcaaagcggcgtgcgaagaggaattggccgccgttgaagaggatattcacaatcaggtcgtccgctttcgcgaagtccagacagcatatgaacagaaaaaacgccagtatgaaaagaaagaatcagcgctgtatcaggcatatcaattcgtccagcaggccagatccaaaaaagatatgcttgaaacgatgcaaggcgatttttcaggattttaccaaggcgtaaaagaagtgctgaagcagaaagagcagctcggcggcatccgcggcgccgttctcgaactgattgcgaccgaacaaaaatatgaaacggcgattgagattgcactcggcgcagcggcgcagcacgttgtcacagacgatgagcaggcggcgcggaaagcgattcaatatttaaaacagaattccttcggccgcgcgacgttcctgccgcttacagttatgaaaccgcgccagcttcaaacccgtgatgaacagacggcttcaaagcatccgtctttcctcggcacagcgagcgggcttgtcacatatgatgcggcgtatcggaatgtcattcaaaaccttctcggcaccgtgctgatcactgaagatttaaaaggcgcgaatgaactggccaagcttctcgggcaccgctaccgcatcgtcacgcttgagggcgatgtcgtcaatccaggcggatcaatgacaggcggcgcggtcaaaaagaaaaacaattctctgctcggcagaagccgcgagcttgagacggtgactgcgcggcttgccgaaatggaagaaaaaacagctctgctcgaaaaagaggtcaaagcgctgaagcaggccattcaagagcttgaacatacgctgagcggcctccgtgaagacggtgaggctttcagaacaaagcagcaggatgtaaaaggcaggctgtatgaactcgaagttgctgaaaagaacatcaatacccatttggagctttacgatcaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaggaagacaacctcaaaaggctgaaaaaagagcttgaagaaacgcagctcgctctgaaagaaacacgggaagatttaagcctcctgacctcagagatgacgtccagcacaagcggagaggagcagcttgaagaagcagcccatcataagcttcacgataaaacgagaacgatcgaattgatcgccagccggcgcgaccagcgtgtgaagctccagcgggcgcttgatacgaacgagcttgaattgaaagagatgaagcgtctgtacaagcaaaaaacggacattctgaaagatgaagaggtaaaactcggccggatggaagttgagcttgataatctcttgcagtatttacgcgaggagtacagcttatcctttgaaggagcaaaagaacaatatcagcttgaactcgagcctgaagaggcgagaaaacgggtcaaactgatcaagctttcaattgaagagctcggaacggtcaatctcggcagcatcgatgagtttgaaagggtaaacgaacggtatcagtttttaacagagcagaaaaatgacctgacggaagcgaaaaacacactgtttcaagtcattgaagaaatggattctgaaatgacgaagcgattccatgaaacgtttatccagatccgttctcaattcaacgacgtgttccgttctttattcggaggaggacgggctgaactgaagctgactgatccgaatgatcttcttaattccggggtggacattatcgcgcagcctccgggcaaaaaactgcaaaacttaaatcttttgtcagggggagaacgggcgctgactgccattgcccttttattctctattctgaaagtaaggcccgtgccgttctgcgtccttgatgaagtggaagctgcgcttgatgaagccaatgtattcaggtttgcgcaatatttaaaaaaatacagcggcgacagccagtttatcgtcatcacccacagaaaaggcaccatggaagaagcggatgtcctctacggtgttacgatgcaggaatccggcgtttcccgaatggtttcggtcaaactggaagaaacaaaagaattcgttcagtaacgaggaaagaggttgaaagatgagcttttttaaaaaattaaaagagaaaatcacgaaacagacagactccgtctctgaaaaatttaaagatggtcttgaaaaaacaagaaattccttctcaaataaagtgaacgaactcgtctcccgctaccggaaagtcgacgaggatttcttcgaggagcttgaggaagtgctgattggcgctgacgtaggttttacaaccgtcatggagctgattgatgagctcaaaaaagaagtgaagctgaaaaacattcaggatcctcaggaagtgcagtccgtcatttctgaaaagcttgtcgacatttataacagcggcgacgaacagatttctgaattaaatattcaggacgggcgcctgaacgttatactgcttgtcggggtaaacggcgtcggaaaaacgacaacgatcggaaaacttgcccataagctgaagaatgaaggcaaatccgttgtgctcgctgccggagacaccttcagagccggggcgattgaacagcttgaagtgtggggggagcgtacaggcgtgcctgtcattaagcaggctgccggaagcgaccctgctgcggttatttatgatgccgtacacgcggctaaagcaagaggagcggatgtgttgatttgtgatacggccggccgccttcagaataaagttaacttaatgaaagagcttgaaaaggtcaaacgcgtcatcgaacgcgaagtgcctgaggccccgcatgaggttctccttgcgctggacgcgacgacaggccagaatgcgatggcgcaggcgaaagaattctccaaagcgacgaatgtgacgggtatcgcattaacgaagcttgacggcaccgcaaaaggcggtatcgtcctggcgatccgcaatgagcttcacatccctgtgaaactggtcggcctcggagaaaaggttgacgatctccagcggtttgatgcagaatcttacgtatacggtctcttttcggatttagttgaaaaagccgaagattaatgaataaaaaacgagtataaaatggacggttttatactcgtttttttatacgcattgatagatcggaatggagggggcagttgttggacaaatggctgaaagctgaattggaaagtaagatcggcgcgataaaccatatgtcgctgctggatgaacagggaggcacttcaaccgttcgaaaaatagtgaccggccaagacgcatttctgctgaaaagttcttttcaacagaagtatcgggaatggttaatgagagaagccttcgttttacaacaactgacggaaactcgtcgtctgcctgttcctatttactatgggatgatacaggaacagcatgccagccatatcatcatgtcatttgaggatggaatcaccctgacttcggctttaagaaaagccaaaggggatactgaaaagaaaaagctgatcaaaagtttcggccagtttctgcagcggctgcatgaaaccgaaatggtctctggtttacagccggaaacagactggctcgatctgcaaatcaaacgagccggggaatatgtcaaaaaaggacaagctgaaggaagtgcagagcttttgaaggaattggacaggtacaggcctgttcctgttcagcagacaatgattcacggtgactgcacgactgataatgtgctggtgagagacggagaggtctatctgtttatcgatgctgcgggaatatcggcgggagatccgcgttatgatgaatcattagcgatcagtcgttttgtcacaaatgaatcatgtctcaatgctttttacgaaggctattgccgctatcgtgtatcaaaacaagaattcgagtattttaacgacggtctgtatgaatttttttgaaaacacttattatgtaaaaagagcatcctgctttgacaagataaaaacttgacacacgctctgaaaccatgtaaactaagtttttgtaaagggatttgacttaacaaaggggagagctcaaatgtcgctcgaaaaaacgacgagaatgaactatttgtttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccggcttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagtccgtcttgcgcttcttgaggctgacgttaactttaaagtcgtaaaggattttgtgaaaaaagtaagtgaacgggctgtcgggcaggacgtcatgcagagtctgacacccggtcagcaggttattaaagtcgtaaaagaagagcttaccgagctgatgggcggcgaagaaagcaaaattgccgccgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttaccgccccgccgcgattaaacagctggaaacactggggaaacagcttgatatgccggtcttttcgcttggcgatcaggtcagcccggtggaaattgccagacaggcgattgaaaaagcgaaggaagagcatcatgattatgtgattttagataccgccggacggctgcacatcgatcatgaactgatggatgagctctccggcgtaaaggaagtcgcaaatcctgaggaaattttccttgtcgtcgactcaatgaccggtcaggatgcggtaaacgtcgccaaaagctttaatgaccagctcggtttaacgggcgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggcgcaggcaaaatgaaaggcttaaaaaacatccaagtcgatgaaaaacagctgaatcatgtggaagcgatcattaaatcaatgactgttcttgaaaaagaacagccggatattattaacgccagccggcggaagcggattgccaaaggaagcggaacatccgttcaggaagtcaaccgtcttttaaagcagtttgaggaaatgaaaaaaatgatgaagcagatgaccaacatgtcaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaatgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctgcgcttatctgtcaataagtcggataccggtaagattatcggaaagcaaggccggactgcaagagcgattcgaaccgttgtttttgcagctggcgcacagtcttctaagaaagttcaatttgaaatatttgactgaaaaagggagagggccggcacctcccctttttttacacgtaaaaaaggcaaatgaacagaaatatgttggaagagtggggagtctggtcctatgcagattattcacagggtaaccgttatgcaggttctgaccgagcaaagcaaggaaaagcttttggcctcttttgcagaaaaaaagcaaacgcttgaacgagaatgcagccagctctattttcagcttagaaaacatgaaaaagatcagcagaatcccgatgtagcggaatcttttaaaaaagccattgaaaaaagacaagataaaatcaaaatgatcgatttccaaataagccagacggagtcgctcccgcttggaagcgaagtgaaggaaaaggagatcgatgcgctgctttcaatcaacgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctctatttgtttgcggagggggctgcggagccaatcaaagtaacggtcagcgcccacaggcttcacaagcagtttcacctgctgcaattcaaagaaatgccgagtctcaatgaagtcgaacacctaagaaacatggtgatcaaagttcctgaagaagacttgggagagcttgaagaagatgaattttattttcatgaaatcatcggctgcgaggttgtgtcagaagacggggaactgatcggcacagtgaaggaaatcttgacgcccggggctaatgacgtatgggtggttgcaagaaaaggcaaaaaagatgcgctcattccgtatatagcttctgtggtgaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggttttttcggataataaacaccaaacggttgatgattacccgtacggcgggggagccgggatggtgttaaagccgcagcccgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcgggcattatgaagggtatgatgaacggatccgggaacatcttgtcactgatgaaatctccatcggggattttgtgctgaccgggggagagctccctgccatgatgattgccgacagcgttgtcaggcttttgccgggcgtcctcggaaaagaagcatcccacgtggaggattccttcagcacggggcttttagagcatcctcactatacgaggccagccgattataaaggcttaaaagtgcctgagacccttttgtccggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggtgatgaagatatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaatgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggtgttaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaaatttgaagatgagcttgtcggcttgcgcctggcgatcaccggggcgattaaagatacgattatcaacctgcaggatgtggctgttttcgggctgcgctttctggaagagcactatcccgaccgcttgaaggagcgctacggacttcaggaaatccctgaggatatcgccgctcttttcgacgcgatcggtgaaaaacgcggctgtttgatgggcggcggaatggttgactatgataaaacaacggaagttatcattcgggacatccggacggaaaaattcggcaggctttcatttgaagcaccatcagaataaaggcgcgcagcgatgcgggtctttattttttccgcagaataccgatatacataatgtaagggagaagagaacgtgaatacattaaccgtaaaaagcgtaaaagaacgcctgcaagagatcagggacgaaagcgaccccttccttgcccaatgtgagaaagacccgagaaaaagcgtaaagacgcttttagagcaatggctgaaaaagcatgcgaaggaaaaagctcttaaagagcaatggctggacatgacggcatacgaaagactgtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcgaggagtattacagccggatcacggaagaagcggcggctgtaggagtcggcattgtccatgcggacgtcattgaccggatcaacatttatgaggccgcgagactggcgatggtaaaagccgtcaatgctttaatggaaacacctgattatctgcttgttgatgccatgacccttccgcttgacattccgcagtcatcagttataaaaggggatgccaaaagcgtgtcaattgccgccggagcctgcatagcaaaagtaacgcgggaccgtctcatggctgagtacgccaaaacctaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcggtaaagacagcggtactcaaaggctgctgttagggaaggttctccgtttgctggacgatcaaagcgctcttattcagatcggcggccggacgatgcagggaaaacttgaaaccgcccttcgtccgcaggcgtattactggttttcttatgacaaacagccggcggaaaaaacgggccggcttcatgtcatcgaccaattcgaaggaagcccgaaaaccgttcaggaagcggcgggtagactgttaaacgctctttccgtcaaaccgggccctgtgtctctgcagattgccgaaacgtttatgcagcagaagctgccgatgacggaaaacagcctcaaagcctgca

SEQ ID NO: 107 - DNA, 196273 bp, Bacillus velezensis FL50S
gaagagcaggaagcagccccgattctgagggagcaagaagaggtgcctaaacctgtttcctttactgagcctcctcctcccgtttccttccagcacgaagaagagccggaagaagctgaggagcctgcaatcatgtcagctgtgaggaatgaacccgtatttgaggatgattcagcagaagtgcaggaagagccgaaagatgatatcgaaccggttttccctgctttcactctgactccgcatgcagaaaaaccaaaaattgcggaacagcccttccttcaaaaagaagagcagccagaggccgagccgcttctccgtcagagcgatcataaggcggcagaagacgaagatgagcctgcggtttttcaagaggagcaggcgcccgtttatcgcgagttcgttccggaacggcaggaagaggagttttacagcgctcctaagctgcttgaagaagaggctcatgatgaagaagggtttgaaattgaggtaaggaagatggcgccgccggaggaggaaaccgggaagcctctcgatttgtcttttcagttttccaaactgccgcctgaggagccggcgcaagctgaacagcctgagccgcttaagcctgaaagaaagaatgaagaagcggcaccgggaaccgagcagaaggaaaatgacaactctcattacttgacaaaattatttacaagggaagaagaaaagttttcaagaatgaaaatttgtatcgtgcagcagcaagatacaatcgaccgggtgtgtgaacgatatgacattacatcccagcagctcatccgaacgaatgctttatcgtttgatgacgagcttgaggaaggtcagcttctgtatatacctgaatataataacagccatgtgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcggggagacagacggagaattcttattatttaatgccttggcttcagtacgatcaggaggaagaacaggatcaaaaacatgtttacctttttaaagaggtcgcgaagctccattctgcgactgtgcgggacatccaaatccggactgaagatatcagcggcttttatgaagcaacgaaaagagattgggaaaatgataagcttgtctatgaacaattcgccgaccgggcggaaaaagagtggtacctttcaccttttgaactgcaggccgttacgtatcttacagaaacggtttccgccgtcaattttgctctggaacgtctggaagaatggtttgacgcggcaaaggatcatgacaagacgagagcggtgatcaaccacggcagtttatcgagccgccactttctgtataatgatgcgggatcgggctttttcacgaatttcgagaaagctgcgctgggccctccgcaaaatgacctgctcggcttttactccagaatgttcagaagctatccgaaagcatgtccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaacgttgagccttttctcatgaaggttcatcagattgagcgggagaaaaaaataaaagcggaaaacgagtcctcttcataacgggactcgtttttttatatccattccaaatgcagggcgcacgctaaaaacagcaggatggcaagcagcaggacatcaaaagtcgtcggaaagaaaatcgtcctgatcccctgaaagatcgtaatcggaataatgacttgcacggatacaaggcggacctgtctggcccactgggggagcgaataagaattgaatttttttctcacgggcaattcctcctcacattcgcctttctatgtatcgtatgtaaggggaagagcggggtgcatgcccatttatgtatgacggcagcggtttttggaaaagatgattgacgaatcaaaaacacttttactataataaagaacataataaataagatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatattttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgacctcggccgtgaaaagtttttagaagaaacgtggaagtggaaagaagagtatgctgatttcatccgcagccaatgggccaagatgggactcggactcgattattcacgtgaacgttttactcttgatgaagggctgaacaaagccgtgcgtgaagtcttcgtcaagttgtacgagaaaggcttgatttacagaggcgaatatatcatcaactgggaccctgccacaaaaacggctttatccgatattgaagtgatttacaaagacgtacagggcgcgttttatcatttgcgctacccgttagcagacggttcaggctcaattgaaatcgcgaccacccgtccggaaacgatgcttggcgacacggctgtcgcggttcatcctgaagatgagcgctacaagcacttaatcggcaaaacggtgattctgccgattacaaaccgcgaaattccgattgtcggcgatgattatgttgatatggaattcgggtcaggcgccgttaaaatcacgcctgcccatgacccgaatgactttgaactcggaaaccgccacaatttagagcggattctcgtcatgaatgaagacggaacaatgaatgaaaaagcgctgcaatataacggcatggatcggtttgaatgccgcaaaaaactcgtcaaagatcttcaggaatccggcgttctctttaaaatcgaagaccatatgcattccgtcggccacagtgagagaagcggcgccgttgttgagccgtacctgtccacacaatggtttgtcaaaatgcagccgctggccgatgctgcggttgaccttcaggcaaaagaagagaaggttcacttcgttcctgaccgtttcgagaaaacgtacctgcactggatggaaaacatccgtgattggtgtatttcccgtcagctgtggtggggccaccgcatcccggcttggtatcataaagaaacaaaagaagtgtacgtcggccttgaggcgcctgaggacagcgaaaattgggagcaggattcagacgtgcttgatacatggttcagctccgcgctttggccgttttctacaatgggctggcctgatgaaaacgctgaagactttaagcggtattactcaaccgatgtacttgtaacgggatatgacatcattttcttctgggtatcccggatgattttccaaggtcttgagtttaccggcgagcgtccgttcaaagacgtgctgattcacggcttaatccgtgacgagcagggcagaaaaatgagtaaatcccttgggaacggcgtggacccgatggatgtcatcgacaagtacggagcggattccctgcgctacttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagacgtgacacagcttgcggatcgttatgaattcggtgaagtcggacgccacctgtacaactttatctgggacgatgtgtgcgactggtatatcgaaatggcgaagcttccgctgtacggggaagatgaagcggcgaagaaaacaacccggtctgttctggcatacgtgcttgaccagacgatgcgtcttcttcacccgtttatgccattcttaacggaagaaatctggcagcaccttcctcatgaaggcgagtcaatcacgatcagctcttggccggttccggtgccggaacatacggataaagaggcagcggcggatatgaaactgctcgttgaattaatccgttctgtccgcaatatccggagcgaagtcaacacgccgatgagcaagcaggttgaactttacattaaaacatctaccgaagacattgccggccgccttgagaagaaccgttcttacgttgaacgctttacgaatccgagcacgctgaaaatcgggacggatatcgctgcggcagacaaagcgatgacagctgtcgtcaccggagcggaagtcattctgccgcttgaagggctgattaacattgatgaggagatcgcccgtctgcaaaaagaattcgacaagctgacaaaagaagtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcaaccgtttcttttatccgttccgtccttcaagaagccggttatacggtcggcacgttcacatcgccttacatgattacgtttaatgagcgaatcagcgtcaacggcacgccgattaccgatgaggaatggagaacgctcgttaatgacataaaaccgatagtcgatgagcttgataagaccgatgccggaacggtgacggaatttgaaatcattacagcgtgtgcatttttatattttgcgaagcgggctgatatcgattttgtcatttttgaagcggggctcggcggcacatttgattcaaccaatattgtgaaaccgcttctgtcggtcattacaagtatcggacatgaccatatggccattttaggcaataccatcgaggagatcgccgggcagaaagccggtattattaaaaattccattccggtcattacgggcgtcaatcagccggaagcactcggcgttattgaagcggaagccgaaaaaaagcaggctccgtatcagtcactatataaaacgtgcagactgtttaatgaagcggcgcttccgtccggcgaaagcttttcgctggaaacagaaacgaaatgctatgaaaacattcaaacgtcgctgatcggcattcaccaaaggcagaatgcggcattggcgatattggccgctgaatggctgaaccgcctggaggccgcagtcatttcagaagaagcgatgcgaaacggcctgggaaaatcttcctggccgggccggtttgaacgtcttcaaagccgccctttagtgtttgcggacggcgcccataacgaagagggtgttgaaacgctgacagaaacgatccggcagcgctttgccggtaaaaacgtccatgtcgtattcagcgcattaaaagacaaaccgtatcaggaaatgattaaaaagcttgaaaccgaagcggattccattcactttgtatcatttgactttccgcgtgcttcaagcgccgaagccctttacaatgcaagcagtcttgcatctaagagcttcgatgagaacccggacagtgtgaaagaatggatagaacaaaaagacggggcggatgatgtcatcatcattaccggctccttatattttatttcagagatgagaaagcggcttatctgacagcctctcggatgcccggcagaccattttccggttttgccgggtgtttttatgctgaaaatatattttcagccatttcagtcatggtgtttttctttgctataatctgagccagattgatagtaaaggtgtggtctgagtgcttttaattctgttttttctcggcttgattttcggttcttttttttatacagcagcgtgccgtatcccgctgcgaatctcggttatttcgccgcgttcatcctgttcgttttgccgcttgccgctctcctggggggagcttgtgcccgtcgtctcctatattctgcaaagaggcagatgcagaaactgccgtgcgaagctgtcggttatgtatccggcggcggaatgctggacggcgtgtttattcacggctgcaggcattcatttcggtttctcaaaagaactgttagtcgcgctgttatttctgtctctcctcatgattgttactatgacggatctgcaatatatgctgattcctgacaaagttctgctgttttttcttccgcttttcatcgccggccgaatgttttctccgctggattcatggtatgcagggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagcggtatacggtatgtgcgctgcagcccggggcagtcttggtaaaaagcagccatttccgtttgcgccggccatctcagccgggagcgctttgagttatttatacggtgatgagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaggtacggccaagacgaatgcaagggggaagagacgttgaaaaaaaggaagagcaaaaagcacagcaaagctaaaaacaatgcccttaaagtaaccattaacggacaagaagaaacgatgtatggacaagaagatgtgaatgaaggcggggagaagaccgtcacattttccaattgggaagaaacaaaaaaggcggaacaggagaccgccgcttcccatgaagatccgaaagaagaagatttcaattgggatcatgagaagaattctgaggtatttgaagatgacccgaaagtcgttccgccataccagaagaaaaaaacaggccctcattttccgaaaaaaaagcagccgtcttctccagttaaaaaagcggtcacgacaattgccgttgcggctgttttaggcaccgggctcggccttgtcgccttaaatatgtcgggaagtaaagaagcctccgctccggcatcagctgacaaaggttcacaagggcagacggtgaaagcgggagatgtttctaacgacaaatctgaaacagccggcacaggagatgcggaatcttcagcgggaaactataaaacatatgcggtgcaggccggaaaattttcatcagaaaaaggagcgcaaacgcttgttgaccagctgactgaaaaaggatactcggccgtctctctggcaaaagaagacggatacacatacgtgatcgccgggcttgcagcggaaaaaagcttatcacagcaattgggtcagacactgatagaccatgattttgaggcttggggcggaaaagagctcagctttgcggtcgattcagggctggaagactcttttaaacaggcatctgagctctccgccaaagcgattaccggcaaaaatctttcaaaaacggaagtggctgaagcggcaaaagcggcagacggcgcagacgccgctgacaaaaagcagaaagaggccgtgcttcaagcgctgaaagaactggaaacgtcgggttcggaatccggctggaaagcccaaaaagagcttttaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaaccatgacaaaacgcttaatactcgcatcacaatctccgcgaagaaaagaactccttaatcttcttcagattccttacagcattattgcgagccgcacagaagaaaaattaaatcgaaacctttcgccggaagaaaacgtccaatgtttggccgagcaaaaagctagtgctgtattggccgaaaatcccgatgcagtcgttatcggggctgacacgatggtgtgcatagacggcgagtgcctcggcaaaccgcgtgacagggaagaagcggcacagatgctgcggaggctttccggccgaagccatcaagtcattacggcggtcagcattcagacgcgtgaccggaaagaaacattctgtgacacaacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgcctgttaaaaggcgcctctgcccaggagctttccagcattccgggaatcggaacggtgaaggccgttcagattcttgccgcaattgagctggggagccgcattcataagacatccgccggggagcattgcgtcatccgctctccggaagacggggcgaagtatgtgatggaggatatgcgctttttaacccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcataatcatccttcaggagatcctacaccgagcagggaagatatagaggtaaccaggcggctttttgagtgcggaaatttaatcggcatcgagctgctggatcatttggtcattggtgataaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggtaaaggaatcgtagtgagagagccgtctgtcgttgctctgcaaacggatacgaagtcaatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccgtacgttatggtgtgtgtgccgtcaggtattacggccgttgaagaacgggcggtcatcgacgcgacaagacaagcgggcgcacgtgacgcttatccgattgaagaaccgtttgcggcagcaatcggtgcgaatcttccggtatgggagccgacgggcagcatggtcgttgatatcggcggcggaacaactgaagtggcgatcatttctttaggcggcattgtcacgtcccagtcaatccgcgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaatccgaggccgcgaccttctgacaggtctgccgaaaacgatcgaaatcacgggaacggaaattgcaaatgcactgcgtgatacagttctctcaatcgttgatgcggtgaagagcacgcttgaaaaaacaccgcctgagctggccgctgacattatggacagaggtattgtattaacagggggaggcgccctgctccgcaatctcgacaaagtcatcagtgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcacaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagaccctgaaaatgaccatccttgaaccggatgaaaaacgtgaagtgaaaaaaggcgacctcgtggaaacctccggaacgggcggcgtatttcctcaagggctgacggtcggcgaagtgaccgatgtagaatcagatgcttacggcctgacgaaaatcgcttatgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtcggcttatatcaaccaaaagcatgcggtgatctacggtttcattttcggatttctttatgacatcaattatacgggtgttttaggcgtttatatgtttggttttgccggattatgctatctggcggccaaagcgtttaaagtgctgcagacaaacgccctgatggtcattctggtcgcggtgctgagcgtatgtgtgcttgaattttacgtctacggcattcagacgttaatccgcagcggcactatgacgtttaacgattttgtcattcagcggttcttgccgaccgctttgctgaatatcgcgggagccgttatattagtcctgcccttcaggctgttttatataagtctgaagaaagaattaagagatgagtaaaaaggattttatctttttttgacgaaaagagtgttgttgaggtgaacattgatgaagaccaaaaagcagcaatatgtaacaataaaaggaacaaaaaacggcttaacattgcatctggatgatgcgtgttcttttgatgagctcctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttcggtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatccgaaatgatgccgacacaattgaggatcaatcacgtgttaaatcgctccccagaccacattcagaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtagacacagatatcggactgcgcaaccttgatgtcgtaatgggtcttgaaaacagaattatttacgacttagtagatgtaattgaaggccgatgcaagacgcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggcgggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgtatcagaaatcacctggtgaaaaacggtgacacgatggatgtggatgaagttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaattaagtcatttttcggcgtgcgttcataatatataccagaatacaaagatctgatgaagcccagcttatcaggtcttttttgttttttaagagcgcatatttgcaatggacaagacataggatgtacaaacccaacgattgcaaaggatgatggcgatgagtcacagagctgatgaaattagaaaaagactggccaaaagaagaaaacagcggcctgaatcaaaacggactttcgttcaaaacgctcaaacgcagaattttcccgcgtggcagacggtcaaggagcaggaaaagcacaagcttcttccggactacgaatatcaaacggaacacccgcccgaatttaacgggcggcatccattgatcagcgctcattctattattttaaaatgcctgctggccgcctgtctcgtactgatctccgctattgcctataaaactgacaaacagccgctgagtcagatcaaaccggcaatcgcacaaacctttcaaaaagaatttcagtttgctgccgtaagcaattggttcgtatcttccttcggaaacccgctcgcttttcttacgccgggaacgaaaaagaaggacggtcaggtggcggtcagtcaggatatggccgttcctgccgcggggaaaatccagcaggactttcaaaataacggagagggcgtcgtcgtcgaaaccgccagtgaagccattgacagcgtaaaagaaggctacattatggaagtgagcaaagataaaaaaacagggctgacggtgaaggtgcagcacgccgacaatacaagcagcatttacggccggctgaaagatgttaacgtttcattgtacgactttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattattatggggctcggtcttatgacggggcacatcaaagcgctgctgtgtcttttgctggtcgtatccgttcatgagctggggcatgctgctctggctgtgtttttttcgtggcgcattaaacgaatctttctgctccctttcggcgggacggttgaggtggaggagcacggaaaccggccgcttaaagaggaattcgcggtcattttggcgggcccgcttcagcatgtgtggcttcaggcggcagcctggctctttttcatgtcaggctttgcaagtgagcagacatttgagatgtttaccttttataatctctccattcttttcatcaatcttttgccgatctggccgcttgacggcggcaagttcgtgtttttatacttctctaaacaaatggcttttcaaaaagcgcatctcctcagcctgcagacatcggccgtttccgcgcttttgctctgctgctggattgtgctggccgtcccccttcaggtcagcgcatgggtgctgttcgtctttctcgccgcttctttatgggatgaataccggaagcggcattatattcagctgaggtttcttttggagagatactacggcaaaaaccgcgatgtcgccatgctgcatcctttgacggtcgcggccgatgccaaagtaaagcatgtcatggccgaattcaaacggggatgcaagcaccccattatcattgaaaaagccggcgaaaagctcagccagctcgatgaaaatgaagtgcttcatgcgtattttgccgataaacggacagattcctctatggaagacctgctgctgccttactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcattttgtcctttgaaatgacgggacatgccgattttgctgaacatggacgagatctcgtttgcgccggggtcacggctgtcgttttcggagcggtcaatgcggttatcgcgctggcttctctcgaaccgattcttgatataggcgaggacgggggttatttctactttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcatgagtgaaccccgccttgaatgaggacatcagcttctcatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgaactgatccaattaatgggccatttccgtcatgattggatgaataagctgcagctgataaaaggaaacttaagtttgcagaagtatgacagggtcgttgaaataatcgacgaaatggtcatagatgcaaagcacgagtcaaagctctcaaacctgaaaaccccgcacttggcgtttgactttctgacatttaattggaagtcccgttatatgaggctcgaatacgaagtgctcggagaaattaaagatttatcggcatatgatcaaaagctgtcgaacctgatgagaaaactgtttcatctgttcggtctggcggtaagcaatgaaagtgaaaatcatctgaccgtatcgctgcagacggatcaccctgacagacagcttattgtatatctcgattttcatggaacgattgcaaatgcagatgtgtttgatgaatttcgcaaatcccggtatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcgccatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcgaccccggccaacccggcgccgcagctgtcagaacacggagagcccggaaaagagcgctatatcgtgcttgaactgaaagtgcttgcagacgtaggtctcgtcggcttcccgagcgtcggaaaatctacgcttctgtctgtcgtttcatcagcaaagccgaaaatcgccgattatcattttacgacgcttgttccgaatctgggcatggtggaaacggatgacggaagaagcttcgtcatggcggacctgcccggtttgattgaaggagcgcacgaaggagtcggcttaggccaccaatttctccgccatatcgaacggacgcgcgtcatcgttcacgtcattgacatgtcagcgatggaaggccgtgatccgtatgaggattatgtgaccattaatcaggagctcagtgaatataatctgcggctgacggagcgtccgcaaattatcgttgcgaataaaatggacatgcccgaagcggctgaaaatctaaaagcgtttaaagaaaagcttcaggatgaccatcctgtcttcccgatcagcgcggtgacgagagaaggactccgcgatcttctgtttgaagtcgccaaccagctggaaacaacgcctgaattcccgctgtatgatgaagaagaactggcggaaaaccgtgtaatgtacacgatggaagatgaagaaattccatttgacattacccgtgatccggacggcgcgtttgtgctttcaggtgacagtctggaacgtctctttaaaatgactgacttctcccgtgacgaatccgtcaagcgttttgcaagacagatgcgcggtatgggcgttgatgaagcgctcagagaacgcggtgctaaagacggcgatatcatccggctgctggaatttgaatttgaatttattgattaaaaagacggagagcttgcaatgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagaaagttgatttaagcagaagcgctttttacaaataccgagatgcggttttccctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggaaggctcggttaacttaacgattgactacttgattcatgagcagcctcttgcgatcgtgggggaaatgacgctgccgattcaccagcatctgctcgttcacccttcgagagaaaatgagtggaaaaagcttgagaaaatttattctcattcccatgcgattgcgcaatgccacaaatttcttcaccggcatttttcgtccgttccttatgagtatgcgaagtcaacaggtgcggctgccaagtatgtcagtgagcattcggaccttccgatcggcgtgattgcaaatgaaatggcggccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggcgcgctgcacagggtgctgtccgctttttcatggagaaacctgaatttatcaaagatcgaatcgcgcccgaccaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagctccccttcagggggctttttttttaatcttttattaaaatacccgcgtcgtccagcgcttggcaggcttggtcaatccgctcttttgtcggggcgcttaatgtatggagatgcacgcctccggtcagctgtgaaaggtaagcggcatttgtcgagttaatgtgatccatgaattgtttgacttctttccgtgtgctgactcttatggcggcggttaaatcgccgtatacggggtgttcaataatgacgtcctttatggtgacgccttcatcgacaatgagttcaagctcttcttccgtccgctccgggccgtgcagacaggcgacaatccgttcggcgtttttttcgccgccggcattcatgctgatgtataaatagccttggctcgtcgcgataatcggttcgctttttgctttcaagagcgatatgtcctgcacgatcacctgtcttgaaacatttgcttttttggccaattcgcctcctgttaatggcaagccggcttctttcagccaatgaagcagcatgtcgcgtcttttcgccccagtaagcttcgttccttctgtcaaattgctgattctcctttcttttgctcccacagcgccgtaaatgtatgtatcagcatatcgagctgttcacatgttgtttcgtttccgaatgagatccggaaaaactgccgtgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgtcagtttcttcctctgaaaatgaaatggggaggccttgacgccgaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccggattccagctgacacccggccgaatgtaaacagccccggtgcctttcgggccgtatactttatgaccggagacggaaagggcgtcgattcccgcctgatccgcatcaatcggcagtttgccgaaactttgaacacaatcgcaatgcagtaaaatgtttctctggtgaagaaaagcggccagacgattcacaggctggatgaggccggtttctgaattggcgtgctgtatggaaacgagccccgtgtcaggacggatatgagccgccagtatgtcctcggttataaggccgttttcgtcgggatatatgatggtgacatcaattccccggtcagctaaaaacgccgcggcattatggatcgagtggtgttccattgcggtcgtaataaaatgttttttatgatcgggcagaccgtacagcaatgattggacggccaagatgttcgattccgttccgccgcttgtaaagtgaatgccgtctgccgctccgccgatcaattttcctgcagaatgtctgcaatattcaagcacgtccgccgctcttcctccggcgtcatgaaggctgctagcattgccgtatacctctgtgctgagatgctgaaagactttcgcggcttctttgcttaaaggcgttcccgccgcgtaatcaagataaatcatacagcccgtctcctatccgtttatgttaaaaaaagcttgagtttattttatcgttgtgtaaatataggtgtcaagacaggtgtaaatataatgggagggtgatgtatgtctgaaaaaacaattatcgtcattggtacggggacggcggcccttgcctgtgcttcctcatttcctccgtcataccaagtaaccgtcatcacaaagagaaacgtaacgaacagcaattcgtattatgctcaaggcgggattgctgtttcatacgcaaaagatgactcgatagaatcccatgtgaacgatacactgtatgcgggatgcggacacaatgacgtgacagccgtgcggcatttgctgcaaagcggacagagcatgataaacagtctgatagaaggccatttcccttttgatacgaagtcggacggaacgttttgtctcggcagggaaggcgctcattccaaaaggaggattctgcacgccgggggagatgcgaccggacggatgctggttgagtttctggttcggcagctgagggacggcattcggatcattgaacacgagacggttgttgatctgctgattgaacacgggcgatgcgcaggcgttgccgtaaaggatgcttcaggcgccgtttcttacagaagagcggattgtgtagtgcttgcttcaggcggctgcggcagtctgtaccaatatcacacaaatgattccgccataacgggagacgggatcgctcttgccttccgcgcgggagctgagatcacggatatggagttcacccagttccacccgaccctccttgtgaaaaacgggactgtttacggtctgatttctgaagcagtgagaggagaaggcggatatttagcggatcgcttcgggcgcaggatcatggctggcagacacgcgcttgaagatttggcgccccgggatgtggtttcacgggcgatttatgaagaaatgatgaaagaaaatcctgtttttataaattgcagccgaatagccgattttaacaaacgttttccgaccataacagaaatttgtcaaacagccggcgttgatcttgaaagcgggatccccatagcacccggaatgcattttttaatgggcggagtaaaagccgatacatgggggaaaacgtccgtgcctgatttgtacgccataggcgagaccgcctgcacaggcttgcacggggcgaaccgccttgcgagcaactcactgctggaagcgctggcaagcgggcaacgatgtgctgaacatatcattcaaacaccgttaaacggaagatataaaaaaaccccgaagaaaactgatgtcatcttacaagtgccggacacaacgcttcatgtgcttcaagccaaaatgacaaccggagtgggcatcgtcagggaaaaagaaaacctgcaggcgctggcatcctggcttaacaacgtatctgtgcgtcatataaatgtgaaggatatcacaatggaacaagccgagctatcctgcctatggaagactgcgcaatttgttgtcacctcagcccttattcgggaagaaagcagaggcgctcattttcgcactgattttcccgggacggagaaagattggcacggaaaacaaatcattcattcaacatctggaacggttatcagaaaaaacgaaaggattggggaactatggacattctgcagctgaaacaaatgctgactcatttttttcaggaagatatcggaacgggtgatgcgacgtcacaagcgattttttctgatcagcaatgtaaagcgcggatcatcgcaaaaacagacggcgtgtttgccggagaagacgttatccgtgaaggatggaagcttttacacgatgatatccgcatccgccctctgaaaaaagacggagaacggatgaaaaaaggagacgtgctcgctgaaatggaaggccgggcggcagctcttcttacgggagagcgggtcattctgaatctcatacaaagaatgtcaggcattgcgacaatgacggacgaggctaaaaggcgtcttgatgatccgtccatcaagctttgtgatacgagaaaaacgacaccggggctcagaatgctggaaaaatacgccgttcgggtcggaggcggctttaatcatcgcttcggcttatatgacggcatcatgattaaagataatcatattgccgcctgcggatcgataaaggcggccgtggagcgggcaagaaaaacggcggggcagatgcttgcggtggaagtcgagatcgaatccgaacagcagctgctcgaggcaattgaagcgggcgcagacattattatgtttgacaactgtccgcctgagtccgtccggcgttttgcaggcatgacaccgggccatatcaaaacggaagcatccggaggcataacgctcgacacattgcccgcttataaagggacgggcgtccaatatatttcactcggatttctgactcattcagtaaaaagcgccgacatcagcatggatgttgaggctgcggaacagggggatttttaagatgtctatttttgacgtgttaactgcatcagccgaaatgatgccgagccattataaagacatgagcaccggagaaatggaaaagcgtgtcgccgccataaaacgggatttcggaaagcgcctgttcattccggggcatcactatcaaaaagacgaagtgatacaattcgccgatacggcaggtgactccctgcagcttgctcaagtggctgaaataaataaagaggcggaatatattgtgttttgcggcgtgcattttatggcggaaaccgctgatatgctgactgatgataaccaaaccgtcatattgcccgacatgcgcgccggatgctcgatggctgatatggcagatattcagcagacggacaaagcatggcaagagcttcaagaactgtacggtaacaccatcattccgttaacatatgttaactcgacggcggaaattaaagcattcgtcggtcggcacggtggagcgaccgtcacctcttcgaatgcccggagtgtgctgaaatgggcttttaaacaaaaagaaagaattttatttttgccggatcagcatttaggcagaaatacagcctatgacctcggcattccgctgacagaaatggctgtatgggacccggggcagaatcgattgcttactgaccatccggaaaacattaaagtcatcctttggaaaggacattgctccgtacacgaaaagtttacagcggaaaatatttctcagctgcggcagcgggattccggcatccgcattatcgttcatccggaatgttcgcgggaagtggtctcgctcagtgacgacagcgggtctaccaaatatattattgatacgattgaacaggctgaaccgggaagcaagtgggcgatcggcacggaaatgaatcttgttcagcgcctcattcactcgcacccggataaacagattgaatcattgaatcccgatatgtgtccgtgtctgacaatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacccaaggccggcttcggaacgtctgcgcataagcatgagcatccatatgccaaagaaaaaccgaaatcagttgtggacattgaagacaccataccggaagaaccgaagccgtcaattccgtatgtgccgccaatccctgaaaagcatgaaaatgtgctgccggaagctgatatgaaccaatattatccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccgaaggcgcctgaagccggaaagatggaagaagaaaacgccgcttatcatctgccgaacatgccaaacattccgaatgtcccgtttccgaatatgccggccgttgaaccgccttttatgcattacccgatgccgtgcatgccttgtccttgtccggttccggtgacaccgatgctgccgggttcgggactatgccatccgtgcttcccggtaggcggaggtttcggcggttttggaggaggttatggaggctttccggtaatgccgatgccgttaccgtacggattccatcatcacggattccatcatccgggatttgggccgcaagcgggttacggtgaatatgaaaaccaggcccatgaaaatgcagagcattatgatggtgcatccggtttcggcggtgctccgtacggtcaaatgccgtattacggcggatattcgtcacattacgcaaacgcgcctcatcatgatgggaaatttaaggatgatgattgcggctgccatgattcacatcaccaccaccatcatcaccacggttcacatcaccatcacgcaaatatgcctgtgcagccgtatccgaatatgggtgcaaacgccggatattttatgccttacggcggagcaaatcctaatgccgcaccgaatcagccgagtccaaatcaagtattcggacggccggaggaagaagaagattaatgtttcgggacgatgtatgtcgttcctttttttatgtccaactgaggaatggacataactgacaagcttaaacccgccgtcggccgcacatcctaaacatgagcggaaaacgctcaaacagcgatgaatccacggggggtttttccattgggtaaaaaactgatgacgatcgcaggcgttttagccgtgacggcaagcttaacggcatgcggagcaaataatgccatgaatgacggacgctacaatcagtcaacacgtccggtcggatattattcgaatgataatgataacggcagacgccagtacggaatggaccatcaaggacccgtttctgaaatgatggaaaaccgaaacggccgtcataatacgacaaacgtgtctgaccagtatgcgcctaatgacggggttccgttaacgacggacggcacatataacggccgaaatgtcaatacgccgccggcagctatgtcttataatgggtatgacaacgccgaaaacatcaggctggcggcaaaagttgcaaaccgcgtgaaaaaagtaaaaggcgtacaggatagtcaggtcatcgtgactgacacgagagtcgtcattgccgtcagaacaaatcatccttttacgaaaaatgatgataaacatgtcaaacatgcggccaaaaaatttgcggacggccgtacaattcaagtgtttaccgacaacgctacttttacaaagctgcaagacatgaacagaaacagccgttaaacgggactgccggatgatttcatccggcagtatttttatggataaagcttcatcatttctttacatattcttaaaacgctctttatgttgcggtgttaacataaaagtaataaaacgtaacggaggggccggaatgaaaaaaacggagcatgacaaaagccgcggagaaaaaactgtgtatctgaccgtaaggggataccggctcaaactgacgtccggacaaatgaaactgatttcagccggccgggcataatcatcggggcagccttcataatagaggctgcttttattcggctgaaacagacaaatgaaagaaaacggttaagcgccggcatctttggtcaaactagcatcaagagtttgattgaataaagaggtgttattggtgaaacgaatttgcggtgctcgtctattgtttatgcttatcttatcggctgcagtcctgatttgcggaggaaaaggcgcatacggggcggaggttgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgttcttttccgtaagcatgttgatgacatttctccgctcagtaaggttaacggttatatcggcgtcacggacggaggcgtcatctccacttttcacggccgtcccggatcgctggccgagccgattcaatctttcttccagattgatatagaaaggctggaaagccgattgcaaaagcacttggaacacggcataccgtacaggacaaaagcggagtttgagagcgtgatcgatcatattaagacttacagcggctgactttgacgcaagacatgtgacacatgtcttttttttctgaatggaagatgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtcttcactccgaatccgtttatttataaggtaagcaatcaagagaccatttttacgtatcatcatataaaagaagacgccttttctttgtacggtttttcaacccgggaagaaaaagcgcttttcacaaagctgctgaacgtcaccggcatcgggccgaaaggggccctcgccatcctcggttccggtgaccccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagctcttagggttctcggctacgccgaaaaagaaattaaaaaagtgcttcctcacttaaaagaggaaacggcgctttcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacactggaccacgttcttttatacgggcctccgggtctcgggaaaacaacgcttgcgtctatcgtggccaatgagatgggggtggagatgcggacgacgtcaggtcccgccatcgaaagaccgggagatttggcagccattttgacggcgctcgaaccaggggatgtgctgtttattgacgaaattcacaggctgaaccgctcaattgaggaagtgctgtacccggcgatggaggatttctgtcttgatatcgtcattggaaaaggcccgtccgcccgctccgtccgtctcgaccttcccccttttacgcttgtaggagcgacgacaagggtcggattattgaccgcaccgctcagagaccggttcggggtgctgtcgcgccttgaatactatacgcaggaagagctgacagatatcgtgtcaagaacggctgacgtttttgaagtggatatcgaagaagctccggctctggagatcgccagacggtcaaggggaacgccgcgggttgcaaaccggcttctcagaagggtgagggattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggcggtcccgtcggccttgatacgatttccgcgacaatcggcgaagaaccgcatacaatagaggatgtgtacgaaccgtatctgctgcagatcggatttctccagaggacgccgaggggacgggtcgtgactccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaataaaggtgaaatgatgaaagtcgatttatttgattttgaactgcctgaacgcctcattgcccaagtgccgctgaaagagcgtgacgcatcgcggctgatggtgctcgacaaacagacgggcgggctgacggacagttcatttaaagagattgtaagcttttttaatgaaggggattgtctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaagggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcatcgtgtcggtcgggacgacatcaacgcgcaccctggaaaccattgccggcgagcatgacggcgtatttaccgcttcaagcggctggacgtccatcttcatttatccgggatatgaatttaaagcgattgacggcatgatcaccaattttcatctgccgaaatcttcccttatcatgctcgtttctgcgcttgccggcagagagcatgttctttccgcctaccgtcatgcggtagaggaggaataccgtttcttcagctttggcgacgccatgctgattatctaatttgaatgacaggaggcctcatacaaagtggctgaacaaccgatacgttatgaatttataaaggaatgcaaacaaacgggagcgcggctgggcagagttcatacgccccacggctcctttgagacgcctgtatttatgccggtcggcacgcttgctacggtaaagacgatgtctccggatgagctgaaatctatggatgcgggcattattttaagcaatacgtaccatttatggctccgcccgggacacgacattgtaaaagaagcgggcgggcttcataagtttatgaactgggaccgcgcgattttaacagattccggcggttttcaggtcttttcattgagcaagtttcgtaatatagaagaagaaggtgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctgttcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaaccccgcttttaccgaaggacaagccgagatatttaatgggtgtgggttcaccggatgccttaattgacggcgccatccgcggcgtggatatgtttgactgcgtactgccgacccggattgcccgaaacggcacggtgtttacgaatgaagggcgtctgaatatgaaaaacgccaaatatgagcgtgatttccgtccgattgacgaagagtgcagctgccatacatgccaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcttgaaaggagggaaacagatgggtactttaggcacaatcgttcctattattttaatgtttgcagtgctttatttcctgctcatccgtccgcagcaaaagcagcagaaggccgtacgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaacagcaagatgattaatgaaaaacagacggcggttaacgctccgatcatccagcctttttccttcgctttgccgcccgatataaaacctcccgcaaataaagaaagaaaagaaagcgcggtgatcagccagctgaaagatgattcttccattgaggtgactgtcagtaaaagcgaaatcgccaaactcgtaagaagcatcaccgcaaaaatagccactaagccgtacaaaacgcctcttcccacttgtttcgtttcttccatttttatctcctctccgctctgcggcctgatatatgacaagccggagcccgtctttttctaaatgtattctctgaatgttcgaattagacgtaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacaattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtatcgtatgccattttggagtcttcgggcaaactgtcaatcgtcaaaaagaaaaacaataaggataagcagatggaaacatcgcttatcgttgacggggtcattcagaacgagcatctggacagaatcgggaaagataaacactggcttgaaaaaaatttagcaaaaagaggatatcgcgatctttcggttatatcattctgcacgtttacggacggcgctttttttattgatctcaaagatgaaaaaggggagccataaatcggcttcaccgcgtcacgaacttgccgatgaccggaatccggatcagctcttcccttttaatcagcctgaataacagaagcagcgcaatgtacaaaatcgcggtcattgcaatccagcctgtgagattaacagcctctgatcctgaaaaatgaacggtgtgcttgatgatgcggctgacataaccgcaaatgaatatgacggcaaaacagagcgcgtattcttttattttaatgctgatcggaagcaccttgcttacggtggccgcatgcagcagggtgacaaggaccatccccgttacaatcgcaagtgcggcgcccatgatgcctaaggaaggcctggtcgccaaaacaaaaattaggccggttttgacagcggcgccgataaaactgttcatcatggcggccccggctaaattgagagcctgcagcaccgcctgaagaggcccctgaaaatagtaaagcagaaaaaacggcgccatcactttaacaaataccgccgcattagttgatccgtacatgacggacatcagttcatcagcgaaagagaataaaataaccaccgaaatgcctccgcttaaaagacacagcctcatcgcctgttccagacggtattcgacaacttgcagctttttttgctccattccttcactgatcgcaggaacaagcgccgttgacagagaataggttataaagctgggcagcgtcaaaaccgtcatggcaaatccggtcagctccccgtactggctggtggcggcagcggtggccactcctgcaatcgcaaggctctgcgcgacgacaataggttcaaaaaaccaagataaatttccgatgaagcggcttccggttgtcgggagcgacacgctcatcagctggcggaaggtttcttttccatttgcaatcgacttgaaaaattgttttctgattctgattgttttatttgctttaaaacaaatgaataaataaataagagaggcaagctccccgatgacagacgaaatcatggctcctgctgcggcatattcaatcccgtacggcagaaacaccgtcgtgcagactgcgacaagtgaaatccgcacgatctgctcaagcacttgggaaaacgccagcgggttcatattctgcctgccctgaaagtaaccgcgcagcacgctggatatcgcgataatcggcacgacgggcgtaatcgccagaagcgggtaaaccgtgcgctgatccgtcagcatcgtttctgacataatcggcgcaaagcataaaaacagcggcgtgaagatgagacttaatatcccggtgacggtaagcgccatcactaaaatgtgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcaatgagaataagagtgcctcttaaaaaagtctgttttgccattttataaacccctgccttctcaaactacctggaatcatatacaataaagatatgcgccgatgtcgtccgagcatgacaagtcttcgagaaaaatagaaaaaggagcgagcgcccagtggagaaacatcccgccgaaatgtacaaagatcatttgcggcctttcttgtacagtaaacttgaagagttcaaaatcctcggatacgatgatgttgagcacgagagtttatggtcatacttaatacataaaaagtggaaacagaaaaaggaattgccgctgcatgaattggccggtaatattttatcagttaaaattggcgattttatgaactatgcaaccgttgaagcttttaagtcgtctaattggctggaaagcgatgagggtcaggaagctttggatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaacattcagattgaaggaaataaccgcatacgcgttcagctggcgggcgtcacgaatcagaacagggcgcgcgaaattctgtcaacggaagcgcagctctcgttcagggatacgaatgataaagagctgttaaacggctctgatctcgtggaaaacggcgcgaagcaaacctttgatccgacgacgaacgaaccgattgtcagcgttaagctgaaggatgcggataagttcggagaagtgacgaaaaaagtcaagaaaatggcccctaataatcagcttgtgatctggcttgattaccaaaagggcgattcatttaaaaaagaagtcggcaaaaaacatccgaaatatgtatccgctccgaatgtgagccaggaattaaacacgaaggatgtcacgattgaaggtcagttcaccgttcaaaaagcgaaggacttggccaatattttaaacgcgggtgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtcattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaactgaaactcggcaaatccgtccgctcagctttccgttcagggaacagacggtcatttgcgacgatctttgatgcgaacatcacaacgatcatcgcagcggtcgtgctctttattttcgggacaagctctgtaaaagggtttgcgacgatgctgattttgtcaatactgacaagctttattacagctgtcttcctttcaagattcctgctcgcccttcttgtggaaagcagatggcttgaccggaaaaaaagctggttcggcgtcaagaaaaaacatattatggacattcaaaaaacagatgaaaatactgaaccgcatacggcattccagaaatgggatttcacgagcaaacgaaaatatttctttattttctcaagcgctgtaaccattgcgggaattatcatcttactggtctttaaactcaacctgggaatcgattttgcaagcggtgcgcggattgacgtgcagagcaatcatgcattgacggcgcagcaggttgaaaaagactttgactctctcggcatggatccggaaaacatcgtgctctcgggtaaagagaaccatgttgccgcggcccggtttgtcggagagccatccaaagaaaaaatcgctgaaatcaaaacgtactttaaggacaaatacggatctgaaccgaacgtcagcacggtatcgccgacagtcggaaaagaactggcccgtaatgctttatatgccgtggcaattgcatcaatcggcatcattatttacgtgtcaatccgtttcgagtacagaatggcaatcgccgcgattgtatccctgctgtatgacgctttctttatcgtcgcgtttttcagcattacaaggctggaggttgacgtaacctttatcgccgctattctcaccataatcggttactcgataaatgatacgatcgttacatttgaccggatacgcgagcagatgaaaaaacgcaagccgaagtcatttgccgatctggaacatatcgtgaatctgagcttgcagcaaacctttacacgttcgatcaatacggtcttgaccgttgtgattgttgtcgtcgtgctgctcattttgggctcatcgtcaattacaaacttctccgtcgctttattggtcggtttattgacgggcgtttattcctctctttacatcgccgcgcagctgtggcttgtatggaaaggaaaagaatttaaagggaaaaaatcaatcgaagagtaaaaggaaacaggctgtcttccggaaggcagcctgtttttttttaggccgcattgaacttaaaacctgcatttgctataatgacatacgcttacataatcaatcatcattgtaaaaacatgtaggggggttcttatgaacgttcgtgagtcggagcttccgggcatcggccagaaagtagaagtcattacgaaaaatcacgataaaatcagtattattcttcatgatgacggcagaaaagagctctattacttcgatgagaatgattatgacgaatgcttggcatccgttgaatttaacgacgaagaggcgaggcagatttccgctattttaggcgggatgacgtataagccgaaagcgctggaatctgtggaagtcgcgcttgatgacctcgtcattgagtggtttaaagccgaatctcatgcaccggctgtcagccgcacaatcggagatttggagatcaagaaacattacaacgtccagattattgcgatcgtgaagaaaaaccggcaaaaacagctgagccccggcattgataccgtaattgaagaaggggacaccctcgttatatcgggagaaagaagcggactgaaaaagctggtccgcgagcaattaacggcccggatttcctgagaccggggtttactcccgggaaaataggggaaaagataagaatcaataattgggggcagacgcatgaataaacaatggactattatattcgctttactatttactctgattgtcgccatctttgctgtcattaacgtgcgggcggttgaggttgattatctgttcggaaccgctgaatggccgctgattttagtcattttaggctctgtgttaatgggagcgctgatcgtgttttcagccggtatatttcaagtgatgaaattgaagcgcgaaattaaaatgctgcggaaagaaaacagatccgcaggtgaattgacggctgattcggacggcaaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgttttacagaaggctacggcccgaatgaacaagctttccgttccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttaccggaagctatgctggacttggcggcaatcggtacggttgcagatctggtgcctcttcatgatgaaaacagattaattgcgtcactcggaattgaaaggcttcgtacgacaaatcggccgggcctcaaagctctgattaaactttccggcggagatatcggacaagctgatgaggaaacgatcggatttcaggtcgcaccgaggctcaatgccgtcggaagaatagaacaggccgatcctgccgtacacctgctgatgactgaagatcagtttgaagcggaggaactggcttcggatattgaccggctgaataaagagcggcagaaaatggtgaaaaccatgaccgaagaggctgttgaaatggttcagcagcaaggcggaaacccgtctgccattgtagtggcaaaagccggctggaatccgggcgtcgtcggtattgtcgcatcgaagctggctgaacgtttttaccggcccgctgttgtgctcgggatagatgaggagcagggaatcgccaaagggtcggcgcgaagcatcagaggcttcaacctttttacgagcctttcacagtgcagagacattcttcctcatttcggcgggcatccgatggcggccggaatgacgctgaaggctgaagatgtggcggaattaagggacaggctgaatcaaatggctgaagaaacccttacggaagaggattttattcccgttcaggaggttgatcttgtctgcggcgttgaagacataaccgttgaaagcattacagaattgaatatgctgtcgccgttcggcatgcttaaccctaaaccgcatgtgatggtgaaaaatgccgtgcttgatgatgtgcgcctgatcggagcgaataaaaaccacgtgaaaatgacggtgaaaagtgattccgccgtccttgactgcgtcggctttaacaaaggagagctggaagccggagttgttcccggatcaacgatttccattgtcggcgagatgtccattaatgaatggaacaacagaaagaagccccagctgatgattaaagatgctgcggtgccggaatggcagctttttgatatccggggcaagcggacgtgggaagatacggtcaccgcactgccgaaggaaaaacgggtgctcatcagctttaacgaaaaaaccgctcagaagctccgtgaaaaagagctgacgggcgagcttgccgagatcacttcggaatccgaggcggaagctctccagcttgacggaaaatatgccgtttttctggatgtgccgccgtcagcggatcgcctgcagcatttgcttgacggaaagaagccggaacggatttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgaacggtgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaggcttatgaaagtacgaggaggacatagaacagatggatcttaaaaaatacgtaacaattgtgcccgattacccgaaagaaggcgtacaatttaaagatattacgacattgatggacaaaggcgacgtataccgttacgccactgaccaaattgttgaatatgcaaaagaaaaagaaattgatttagttgtcgggcctgaagcgcgcggctttattatcggctgtccggttgcatacgcactcggagtcggctttgcgccggttcggaaagaaggaaaacttccgcgtgaggtcattaaagtcgattacggtttggagtacggaaaagacgtactgacgattcataaagatgcgatcctgccgggacagcgtgtgctgattactgatgacttgcttgcaacaggcggcacgatcgaagcaacgattaagctggtcgaagaactgggcggcgtcgtagccggtattgcgttcttaatcgagctttcttaccttgacggcagagacaagcttgacgattatgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcggggatcctcgtcgatctggaaatggacccttccacaattgcgggcggatttctgcatgatgtggtggaggacacggatgtcaccctcgacgacctgaaggaagcattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgctggagattttcgctccgctggcccatcggctcgggatttctaagatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgttgaagaagtgaatattaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtactcggcattattcatacgtgctggaagccgatgccgggcagattcaaagattatattgcgatgcctaagccgaatatgtatcagtctctgcatacgaccgtaatcgggcctaaaggcgatccgctggaagtgcagatcagaacgtttgagatgcatgagatcgctgaatacggggtggccgcacactgggcttataaagaaggcaaggctgcaaacgaagaagcgacatttgagaaaaaactgtcctggttccgtgaaattctggaattccaaaacgagtctaccgatgcggaagaatttatggaatcgctgaaaatcgatctgttttctgacatggtatacgtatttacgccaaaaggcgatgtcattgaactgccgtcaggctctgtgccgattgatttttcctacaggatccactcagagatcggaaacaaaacaatcggggcgaaagtgaacggaaaaatggtgacgcttgaccataagctccggacgggcgacatcgtcgagattctgacgtccaagcattcttacggtccgagccaagactgggtcaaactggcgcagacgtcccaggcgaaacacaaaatacgccaattctttaagaaacagcgccgtgaagaaaatgtcgaaaaaggccgtgagcttgtcgagaaagaaattaaaaatcttgattttgaagtgaaagatgttttaacgctcgaaaatcttcaaaaagttgccgacaagtttaatttctcaaatgaagaggatatgtacgcggcggtcggatataacggcattaccgctcttcaggtggccaacaggctcaccgaaaaagaacggaagctgcgtgaccaggaagagcaggaaaaaatcgttcaggaagtcacttccgagccgaaacattatcctcaagggagaaaacgggaagcgggtgtgcgcgtaaaaggcattgacaaccttctcgtccgcttgtcgaaatgctgcaacccggtgccgggcgaccatatcgtcggttttattacaaaagggcgcggtgtatccgttcaccgggacgactgtccgaacgtcaaaacgaatgaagcgcaggaacgtctgattcccgttgaatgggagcatgaatcacaggttcaaagacgcaaagaatataacgttgagattgagattttggggtatgaccgtctcgggcttttaaatgaggtgctccaagccgtaaatgaaacgaaaaccaacatctcctctgtttccggcaaatccgaccgcaataaagtcgctacgattcatatggcgatttttattcaaaacattaaccatctgcacaaagtggtcgagcggattaagcagatcagagacatctattcagtccggcgggtaatgaactaaaaggagcttgctatgaaattagttgttcagcgtgtaacagaagcgagtgtgacggttgacggcgctgtcgccggccggatcggacccggtattatggcgcttgtcggcatcactcatgaagatacagaagaagatgccgcttacttggcggataaaatcgtgaatcttcggatatttgatgatgaaagcggcaagatgaatttatcgcttttggatacgggcggggagattttatccgtttcccagtttacgctttacggcgaaacaaagaaagggagacgcccgaattttatgaatgcggctaaaccggatcaggctgtgctcctttatgaaaagtggaacgaactccttcgggaaaaaggagtcaaagtggaaaccggaatattcggagccatgatggatgttcagctgacgaattccgggccgattacattgattatggattctaaacaataaaaaagctgccgttcggcagcttttttttatgattgaaaataatgttccaatccgctttcaattccgtctgtcactttttcctgataagagccgctatgtatgattgtttcttcttgcggttgactgagatagccgagctcatacagcatggcaggccgtttattttccctcaggacgtaataatcgccaaacagaacgccgcgatcaggaataggggaacgcttcactacttcagaatggacgtctgaggcaagctggcggtccttagacggactgtaataataagccgtgcttccccgcgttgacgtatcggcataactgtcatagtgaatgctgataaaggcatccgcattccggtaatgagaggttgaaaccctggcctgcaggctgataaatgtatcatcctgtctggtgatatacacgtttgcaccggccgctctcaattttccggctaacagcttagcggttttaatcgttacgtttttttcaaactttccggagtagccgatcgttccgctgtcttttcctccgtgtccgggatcaacgacgatcgttttgtttttaagtgagccgctgccgcctgacgtgttgggagaaggtgcttcgcctgtttcctcaccgctttttgacgtttgtacgacccagtctgccacatatgcggtttgtccgttttcaagccggacttcataccatttgccgcttgagccgacaatcgggtaggctgcgcctttatctgctctttttacgatagaagcggaagtcgaggccgagctccttaagttggtgccgccgtaaacaatatacgcttttttcgaggagcctgagcccgcagaaccgtctcccgagccggatgcgctgcccgatgagtcagaatcctttatgatgtagtggcttgctgcccagcctttttgaccgtttgcttcaattttcagccagccgtggtcttcacttaagatggaaacctttgttccgcgtgataatttagtcataatcgctgaatcatgtgacgctgcacttctgacattcaatgaagaaacgccgaccgtcccgctttttgacccgcttcgggccgaagttgctttcgtatccgatccgccgctgtccgcggtgacgtattcggaagaaacccacccggttgtgccttgataagaaatgttcacccatccgctgttcttgtccagcacggatgcatgcgcgccttgcggaagtttgccgatgacttcatacgatgtccccgggccttttctgatgcggaggtcaggatcggtggaagtgaccgttccgctttttgcggatgaattgtctgctcccccggctgtttttgatatcagccaggaaacgacccatccggttttaccggggctcagctgaagctgtacccagtctccctcttctttaacgatcgggtatctttcccctttttttacttcagcctttattccgtagctcaggccgggaccgcctctgacattgatcttgtctgtcgcgatgaccgcttctccctctgcggcgattgcggtgtgaaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatgggacgcgcgctgcacgatgcggaaggaaatctgcacttcagtgatcagagcgatagagaaaaggcgggttttcttgaagagacggcgacggagttcggtctcttatcgaaagaagcggtcgcaaggaaaaacagacggaataaaacttgacaggggagtgcaatcccattattataatagaaattgatgtacataactcatgataacgattttgaaccgataatggagaagagtaggtcagaatgcatggaaaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattattcgcaagaggcgtcggtgagtctacagatatcgtgcagaaagaaatgtacacgtttgaagaccgcaaagggagaagcttgacgcttcggccggaaggaacagccgccgcagtccgcgcgttcaatgaaaataaattatttgcgaacccggtgcagccgacgaagctttattatgtcggaccgatgttccgttacgaacgtccgcagacagggcgtttccgccaattttatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcggagaattttgctcagactgccaatcgcgtctgcacacaaacccgctcagaattcttgactgcaagaaagacagagagcatgaactgatgaaaacggctccgtccattcttgattacttaaatgaagaatcagccgcttattttgagaaagtaaaacaatacttaaacggtctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgactgctggcagccattgacgctgagaaaacagaccttcccgtcaatcaggggatcgactgctacatcgtgacgctcggagaaaaagcgaaggattattccgtttccctcgtgtacaaactgagagaagcgggcatctcaagtgaaatcgattatgaaaataaaaagatgaagggccaattcaaaacggctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgtgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgaggtttctgaagacgtccggttaaaacaccgctatttggatttgcgccgcccggcgatgtttcaaacattgcaaatgcggcatcaagtcacaaaatccatccgccatttcttggatgaaaacggatttcttgatattgaaacaccgattttaacaaaaagttctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatattgaaatgtcctttatgagtcaagaggacatcatggctctggcggaagagatgatggcgaaagtcatgctcgaaacaaaaggcgttgaagtatcgcttccgcttccgcgaatgacatatgaagaagcgatgaacagctacggttccgacaaacccgatacccgcttcggcatgctgctgacggacgtgtcagacatagtgagagatactgaatttaaggtgttctcatcagccgtggcaaacggcggcgttgtaaaagcgatcaatgtcaaaggcgctgccggcgactattccagaaaagatgtcgatgcgctcggcgtttttgccggaaattacggcgcgaaaggtctcgcttgggtgaaagtagaagctgacggcgtaaaaggcccgattgcgaaattctttgatgaagagaagcaggcaaaactggctgaagcgcttgatgcttctgaaggcgatctgctcctgttcggcgctgataagtttgaggttgtggctcaatccctcggcgcgcttcgcttaaagctcggcaaagaacgcggcctgattgacgaaagcctcttcaacttcctgtgggttgtggactggccgttattggagcatgacgaggaagaaggccgtttctatgcggctcaccatccgtttacaatgcctgtccgtgaagatcttgacctgattgaaacggcgcctgaagatatgaaagcgcaggcttacgacctcgtcttaaacggctatgaactcggcggaggctcaatccgtatttttgaaaaagacgttcaggaaaaaatgttcgggcttctcggctttacaaaagaagaagcggaggaggagttcggataccttcttgaagcctttgaatacggtgctcctccgcacggcggaatcgcgctcggcttagaccggttggttatgcttcttgcaggccgcactaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcggcagtttgtttcttgaaaatcaaaatctgctgtgatatgattttgacaagttaaataaagtcctgatgtgttagttgtacacctagttttgaccgaacatttttttgatttgggagcccgcatttttaaatggcgtacatgcctcttttcattcgctaaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgacattacaaacgtaaaccgccagctgcatgcgctattgtcgacggtgggacagccgaaaacagaattgatgaaagagcggatcgctgatattaatcctgattgtgacgtcgtcgccttaaaaatgttttatacagaagagacgtatgagcagttctttgagtatccgcttgattacgtcattgacgcgtcggatacgattcattataaaattcatctgatgaaagaatgtctgaaacggaatgttccgctgatttcaagcatgggagcggcgaataaaacagacccgacacgctttcagattgctgatatctcaaaaacccatactgatccgattgccaaagtcgtccgcacaaggcttcgtaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgtcatggagctcttaaaggacatcgacattaaacgggttaaagataagtaaaaagaaaaacagccttcttcaggaaaggctgtttttttatttgaatccgccgtttacacgaaagatcttgtccggttattttttctgcttcatcagtttttcatacacttgctttatggcggcttcaaatttccccgtttgtttcggtttatagtattgcttgttttttaacggatcgggcaaatattgctgttcgacccatccgttctcgaaatcgtggggatattgatagccgatcccgcgtccgagctcttgggcccctttatagtgggcgtcttttaaatgtttcggcacatcgccgattttacccgtcctgatgtctttgagcgcctcatcaacggctgaaatggcggagtttgatttcggcgagaggcataattcgattaccgcattggccagcggaattctcgcttccggaaagccgatccgttctgcggtctgaatcgcgctcagcacccgggggcctgcctgcgggcttgcgaggccgatatcttcataggcgatcacgagaagccttcttgatatgctttcaaggtctccggcttcgatcagacgggccagataatgaagggcggcgtttgcgtccgagccccggatcgatttttggaacgcggataagacgtcataatgcgcatcgccgtttttatcatgggtatagctttttttctgcagacattcttccgccgtttcccgtgtaatccggatcgtgccgtcgcttgattcctttgtggagagcacggcaagctccagtgcgttcaaagcggagcggacgtctcctccgcacccttgtgcgaaatgatccatcgcgtcgtcgtccaccgaaacgctgtaggaaccgagtccccggtgttcatctgtgagcgctcttttcaatgcctgcttgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagtctgtgcacttcatcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgcttcgcacgcaccattctgccgatgattttatcttctttgaccaaatgttcctgaccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctcagaaacgccggactcgtaaaaagcatcagaggcgcttacgggggttacgtgctcgggggtcagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtacagacaatggaacggatttatttagatcatgccgcgacttcccccatggatgaacgtgtgctcgaagaaatgaagccccatttcttcggcagtttcggcaacccgtcaagcattcattcattcgggagagaatcccggaaatgggtcgatgaagcgagagcggacatcgcgcgcgaaatcagtgcgaaagaacaggaaattattttcacaagcggcggtacggaggctgataatttagccattttcggaacggctgccgcccggaagaatgaaggaaagcatatcattacgaccgctgttgagcatcatgctgtattgcacgcctgcgaaaagctggaagaagacggctttgaggtgacatacctcatgcccggcccttcaggacggatcagtgcaaatcaggtgaaagaagcgctccgtgatgatacaatccttgttaccgtcatgtatggcaataacgaagtcggaaccattcagccgattgacgaaatcggagagctgttaagcgggcatcaggcctattttcacacagatgccgtccaggcattcggttatatgccgattgatgtgaaaaaaagcagaattgacatgctgtctgtttccggtcacaagcttaacgggcctaaagggacaggctttttatatgtaaatcaagaggtgaagctgtcaccgattcttcttgggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacatcatcatgagcacgctggaagaagccggcgttacagcggaggtgaacggagatgccgagaaatgcctgcctcatattttaaacctttactttcccggtgtgccggtggaagcgctgctggtcaatcttgacatggaaggcattgccgtatccagcggatctgcttgtacagcgggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttacgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcaggtacagtgcgcatgctccgcggtctggatgaaaacaaggaccagacttattttctgaatcagctcaatcaggaacagctcagtaaagtcatgttcccgatcggtgatctgcaaaaaagccgcgtgcgggaaattgccaaagaagcagaacttgcgacagctgcgaaaaaagacagcacgggaatctgctttatcggcgaacgcaacttcaaaacgtttctcagccaatatctccccgctcagccgggcgatatgatgacaatggacggagaaataaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattccgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaaatcatttttgacgggcaggtacgcgccgttacgccgggacaagccgtcgttttttatgacgaagaagagtgcctcggcggcggaacgatagatgacgtttataaagacggaacaaaactgtggtacgtataacacatgtaaaaaacctcaactcgcatgttggggttttttagcgaaaggaagttaaaaatggattataataaaatcgggattgacgccatgcaggagggcgattttgaaaaagcggcagaggcttttacgaaagcgattgaggaaaacggccaagacccggtgccgtacatcaacttcgcaaatctgctttcttctgtgaacgaactcgaacgggcgcttgcattctataacagagcgcttgaattggacaattcggcggcagccgcttattacggtgcgggaaacgtatatgtgatgaaagaatcgttttccgaagcgaaggatatgtttgaaaaagcgcttcgttccggaatggaaaacggagatttgttttatatgctggggaccgttctcgttaaattagagcggccgaagcttgcactgccgtatttgcagcgtgccgttgaattaaacgaaaatgacacggaagcgcgcttccagttcggaatgtgtctcgcaaatgaagaaatgctggatgaagctcttgcgcagtttgagacggtgatcgagcaggatccaggccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcataatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaactgccacgcatcctaagttcggcctgcaatttcaggctgaacactttaaaaaagaaattccgaccacaaaagaaggaatcattcactatttatcaagtgatctgtttgaaggaatcggaaaaaaaacggcggaagaaatcgtcaaaaagcttggagacggcgcgctcaataaaattctgtcggatgcgtcggtgctttatgatgtgccgaaaatgtcgaaaaagaaagcggataagcttgccggagagctgcagcggcatcagggtcttgagcagattatgatctctctgaaccaatacggtttcgggccccagctatccatgaaaatatatcaggcctacgaaacggaaaccttggagaaaattcaggaaaatccttatcagcttgtaaaagacgttgagggcatcggctttgtgaaagctgacgagctgggcggaaaaatgggtctgtcaggaaaccacccggagcggatcaaagcggcaatcttatatacgattgaatcgacctgtctttcagagggccatacgtacatagagacaaagcagctgattatcaatacgcaaacgctcctgaatcagtcagctgaaggcggccgcgtcacggaaatggatgcggctgacggcatcatcgccctcggggagagtaaggatatcgtcatcgaaggagagcgctgctattttccgtccttgttttacgcggaacaaaacgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccgggggacctggaacggggaaaacgaccgttattaaaggaatcgtggaattatacagtgaactgcacggcgtatcccttgaccccggtgattataaaaaagacgaggcgtttccggtgctgcttgccgcgccgaccggaagagccgcaaaacggatgagcgaatctacgggtctgccggctgttacgattcacaggctgctcggctggaatggcgctgaaggctttacctacaacgaagatcagccgattgaagggaaactgatcattatagacgaagcgagtatgcttgatatctggctcgcgagccatttgtttaaggcgcttcctaagcacattcagctcattgttgtcggtgatgaagaccagcttccttcagtaggaccggggcaggtgctcagagatcttttggcttctgaagtgctgccgaccgtgcgcctgacagatatttaccgtcaggctgaaggatcatccattgtggaacttgcccatgatatgaaaaaaggactgcttccaaaggggctgaccgcgccgacaaaggaccgctcatttatccgctgtaattcttcacagattaaagaagtcgtggatcaggtcgtctcgaacgcgttaaaaaaggggtatacctccagagatattcaagtgcttgccccgatgtacaggggaaaagcgggaattaacgagctgaatatgcttcttcaggacatcatgaatccgccgaaagaaaaaaggcgggagctgaaattcggagatgtcgtctacaggacgggcgataaaatattgcagcttgtcaaccagccggaaaacaatgtgtttaacggcgatatcggcgaaatcgtgtccattttttatgccaaagaaaatacggaaaaagaagacatggtcgtcgtctcgtttgacggcaacgaaatcacctttacgaaaaaggatttcagccagtttacccacgcttactgctgttccattcataagtcgcaggggagcgaattcccgattgtcgtcctgcctgtcgtcaaaggctactatcgaatgctcaggagaaatctgctttataccgccattacaagagcgaaaaaattcctgattctttgcggagaagaagaagcgcttgaatggggcgttaaaaacaatgatgccaccgtcagacagacgtcgcttaaaaacaggctcacagagcagactgaagagatggatgcagaactggccgccctgcaaaaagagctgccgttcagtgtatatgatgcgaacatcggaatggaaggcatcacgccttttgactttatggaagaaaaagcgtaaataaaacccggcacatgttcatgcgccgggttttcgcctgtggaagtcatttcaaagtatgctgcccggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcacaaccgtcatctttttttaggggcaagtgatataaaagagatggatcaagaagccgtagctgccggtcatgctcatttgcagcctttgccgaagagctgtttcacctttgaacagattaaaatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatatgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtggccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggagctggagccgttatgtatcgtatggcttctcagtccgatatgctgaataaaaaaggtatgaaacggatgagaagacgagtcatgaaaatgttttaagcggaaaaaaggatacttctccggaagtatcctttttacgtttgtctcgcttccagccgtctggcagcgagagacaggctgtaattgaccgcgaaatacatcagggccgccagcagaaagatcgggaaaaaataccccccgtcagcgctttgtccgtttaaaatctgcgcgttatgaatcagttcgggcagagcgatgacgaccgcaagtgacgtatcctttaataaggagataaactggctcacaatcggaggaaccatacgccttatcgcctgcggcatgacgacgagaaaaagagtctgcgtgtacgtcagtcctgaagaacgcgccgcttcaatctgtcctttgtcaacggattgcaaaccgcttctgatgatttctgacagcatggccgattcaaaaatcgtcagcgccgtgatggcggccgcggtaatttccagtttgatcccgatttccggaagggcaaaaaacgtaaagaaaatgattaataacagcggcaggttgcggatggtttccacaatggccgctataatgcccgagacgataggaatgttcgcatagcgcaaagtgccggcggcaagcccgaacataaaactcaggacaatggagatcagcgcaacataaagtgtgaccaaaaagccgtcccataaaaacagcagatggtcaggtgtataggcgccgctaaaatccatgttattcactctccttctctaataactttttccgagacgtctttccaaatagtgaaccccgatgctgagcgggatcgttaatatcaaataaaaaagcgcgacgaaaatatagacatcaaacacgacaagagtgctcgaggacacgagatccgcctgatacatcaaatcgagtcccgccaccactccgagtattgatgagtttttgacaaggttgagaaattggtttccgagcgggggaatgacgatttttacggcctgaggaagaatgatatatctcatcgcctgactgtaggtgaagcctgacgatctggccgcttccatctgccctttggggacagtctgaattccggctctgatggcttctgcgataaaggcggacgtgtaaatcgtaagcgcaatcgttcccgcctgaaagccgtccagtctcagcccggcgttcggaagtccgaaataaaaaacgaatgtgatgaggagaagcgggatgttacggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcatgctcatcccgcggtccgtcctattttgccggttcttcttttatccattttttatagattttttcgtacctgccgtcggctttcatttttttcaaagaggcgttgatttctttgacaaggccggattggccttttttgacggcgattccgtaaggttcatcggtaaaggtttcgcccgtcagctgatattgtttattttcatcggccatgccgtataaaatcgcattatcggttgtgagcgcatctccctgtcccgctttaagcgcagtgaacgcttcggcgtaattttcaaattccagcactgaggcgtcaggcgctttttctctgatgttctgtgaggaagtggagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatggcgtcgatatcgccgttttgcagcatcggaatcctcgtttttgacgtcacttctttaaattccgctttcttctcatcccccagaatatcttttgcgagctgttttgagatatcaatatcgaagccttcaatatcaccagagcttgggtttttcagcccgaataacctcgtatcggttttgacgccgaagatgattttgtctctgtctttaatagaggctaacgtgtcttttcccgttccttttgaatccccggacgtttctttccctccgcaggctgccagcataaagacggccagcagtgatatcaatccgaatgacaaccattttgttgcgcgtgacataagcgctcctccgtttcttttcagtgatttaaaatacggcttaagaataaacgcgccctctcttcacgggggctttcgtaaaattcagccggtgcagcttcttctaagatggatccgccgtcgataaacacgatgcgatccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagccccctggcgatggcgacacgctgctgctggccgccggaaagctgtgaaggataagcgtccgctttgtccggtataccgacttttttcaaatagtataaggccgtttcctttgcttcttcttttgattgcttgagcactttgatcggtgcgagcatgatgttttgcagaacggttttgtgcgggtacagatgaaaatgctgaaacaccatgccgatattccggcggacctgatttatatccgttttcttgtcacggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagttttgaaatcctttaacacattacgatggttatacagacttttatgaatattatttagattatttcgtaatttctgataattatttccgtcaagaggtctgcgtcataaggcgtagtttatgaaacgggaataattccggctttctgtcaaaagataaagcaagaggtgaaacgtcatgcttcaaaaaccgctgcagctcttaatgtggacggctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctacttctgatttattgcctgtttttcggcggaatcggctggggggtttataaaggggttcctgttttaattgaacagctgcaggatctgtctgagagcattcccggtcttgccgaaaactacaacagcatgctgaggcatctgcataatcacacggatcattggcctgacggcatgcaccatcggatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatataggcgtcatgaaaaagacggtctggtatttgacgccgaagtcctggagaaaaagggggagtgaatttctgcgggatgtggacgactctctcggtgattacatccgcggtcagcttctcgtttgttttttgctcgggttaatagccggtgtttcattttggctgttcgggcttccttacccgctgattttgggccttgccatcgggattacgaatgtcatcccgtatttcggtccgtttatcggcgctgtgccggcgctgctcctttcgctggcgatttcctccaaggctgtgatcatcgtaatcgtcacgatttttattcttcaatttatagaaggaaacattttgagcccgctcattgtcgggcgaagtctcagaatgcaccccgtcgtgatcatgcttgcgcttcttgccggaggagagctcgcgggcattcccggcatgattctcgctgttccggcggcagccgttttaaaagtgacggccattcactttttgcggatcaggacggaacattgacattcgggttctgcttgtctataatttcgagtagaatacatacgaatctcgagtgacggataagagtacgccgaagccctgtttaagagagaagctccgatacgctgaaaggagcttcagcagaagatcggtcgaagctaatcctgagtgcagttaaaggctgccgcaatcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtgcgtcaaatgtttttagatttctttaaagaaaaaggtcatgccgttgaaccgagcgcctcattggttccgcatgaagatccgtctttactgtggatcaacagcggcgttgcgacgctgaaaaagtactttgacggccgcgttgtgccggagaatccgagaattgtaaacgcgcaaaaatcaatccgcacaaatgatattgaaaatgtggggaaaacggcgcgccaccacacgttctttgagatgctcggaaacttttccatcggtgattattttaaagaagaagccatcacgtgggcatgggagtttttaacgagcgaaaagtggatcggctttgatccggagctgctgtctgtaacagttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggtaatgacccgtcagattctgaattgtatccgggcggcgaaaatgaccgctatcttgaagtatggaacctggtattctcagagttcaaccacaacccggacggcacgtacacaccgcttccgaagaaaaacattgatacgggcatggggcttgaacggatggtctccgtgattcaggacgtcccgacaaactttgacactgatttgtttatgccgattattgaagcaacagagcgcatttccggagatgcttacggaaaggacgcagtgaaggatacggcctttaaagtgatcgccgatcatatcagaacggtcgcatttgcggtaagcgacggagctctgccgtcaaatgaagggcgcgggtatgtactgagacgtctcttgcgccgggcggtgcgatacgcgaaaaccatcggtatcagccgtccgtttatgtacgagctggttccgactgttgcaggaattatggacgctttctatccggaggtgaaagaaaagcaagagtttatcgccaaagtcatcaaaacggaggaagagcgcttccacgaaacattaaacgaaggtctggccattttatctgacgtgataaagaaagagaaggaaaaaggcagcggcatcatctccggaaaagacgtattcaaactgtacgatacgtacggattcccggttgaattgacggaggaatacgcggaagatgaacaaatgaaggttgaccataaaggctttgaagccgaaatggaaaaacagcgtgaacgggcgagaaatgcgcgccaagatgtaggaagcatgcaggtgcagggcggcgcattgcgcgacattaccgcagaaagcacatttgtcggctacagtgccgtaaaagctgaagcgaaggtgatcgaacttcttcatgacgggcaattaatcagcgaggcgcatgaaggggataccgtccaaattcttcttgacaaaacgcctttctatgctgaaagcggcggacagatcggtgacagaggagtgctgagaagcgagcaggctgtcgtaaccattaaagacgtgaaaaaagctccgaacggccagcatgtacacgaaggcacggtggatagcggcacgattcaaaaaggcgcaagcgtgacggctgaagttgaagatcaaatgagaagcggtgtggtgaaaaaccatacagcaacccaccttctgcaccaggcgctgaaagacgttctcggcacacatgtcaaccaagcgggttcactcgttaccgaaaatcgtctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatatcgtccgcgtcgtacaagtcggagattacagcctggagctttgcggcggatgccatgtcacgaatacggctgaaatcggcctgtttaaaatcgtatccgaatcagggatcggcgcaggtacgcgaagaatcgaagccgtaacaggaaaaggcgcttatcaggaaatgaacagccagctcagccttctgcagcacgctgcggatgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtctaaagtaaaagacatcggcggcgtaaaagtgctggctgaaaaagtaaatgcgaaagacatgaaccaccttcgcactatggtggatgatctgaaagcgaagctcggttctgcggtcatcattctcggcgccgtgcaaaacgagaaagtcaacctttcagcaggcgtaacaaaagacctgattgaaaaaggccttcacgccggcaaaatggtcaaacaagcggctgaagtctgcggaggcggaggcggaggccgtccggacatggcgcaggccggcggaaagcagcctgaaaaattggaagaggcgctcgcatctgcggaagattggataaaatccgttttataatcctttcaactagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgattacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcagggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaagaaatggaacacggcgaaaaacatattacaattgtcgatgatcaaggcaacgaacagctttgcgaagtgctgttcacatttgaaaacgacacattcaacaaatcttacgtactttattatccgattgatgctcaagacgatgatgaaattgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaaaattcatttccgcgtaaaaacaaaaaaacaacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcaaaactggatgacaaaacattcatcggcaaactgaaaaaacagtttcctgatacaataacggacgcactttcaaacaagaagctcaagcatccgctcgaaggctatctgtatccggccacatatccgtttaatgatccggatgcatcgcttgacacgattttgacggcaatggttcaggaaacaaatacccgtatcgaaacgtataaatctgaactggaaaaaaagaaactttccgtccataacgcgctgacgatggcatcgcttattgaagaagaagccaccgccaaagccgaccgtcacaaaatcgccagcgttttttacaacaggcttgcagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaaccaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagtctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccgggttcgcgtaatgcacggggatgcgctggaactttctgagtctgtccgtgtcacggctccttatgatgccatttttatcgacgcggccaaaggccagtacacgaacttttttgagctctatgaaccgatgcttgcgccggatggagtcatttttacagacaatgttctgtttaaaggactggtggcacaaaatcactcggacattgagccgaaaagaagacggaagcttgttgaaaaaattgatcaatataaccaatggctgatgaaccggcctgactatcaaacggtcatactgccggtcggagacggcatcgccatcagtaaaaagaagaggtgaatgatcatgaaaaaacctgaacttttggtgactccgacttctgtacaggatattcttccgctcattcaagcgggcgcaacggccctgttagtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgatccggccgttttaatggcggcgcgtgaagcggctcccgatcttaaactgcactggagcacggaaacaacgggtaccaactactattcctgcaattactggggacgcaaaggcgcacggcgggcagtgctggctaaggaattaaatatggacagcatcattgacataaaagaaaacgccgaagttgaaattgaaattcaaatccacggcatgacgtgcatgttccaatcaaagcgttctttagtgggccattacttcgaataccagggaaaagtcatggacatcgaacagaagaaaaaagaagcgggaatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatctgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaatcgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggacattgaaatcgaaacctttatccacggcgccatgtgtatcgcttattcaggacgatgcgtgctgagcaatcacatgacagcccgggattccaaccgcggcggctgctgtcagtcctgccgctgggattatgacctgtatcagacagacggtgcaaacgcggtcgcgctttatgacgaagaagacgctccgtttgcgatgagcccgaaagatttaaaattgattgaatccattccgcaaatgattgagatgggtatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtatgacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttagatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcattattctggaaggcattctcgttctcgaagataaaagacttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcggacaaaaccacgtcgcaattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgtaaagaagtagtagagcgcattaaaatcgcaagaagcttcggagatctgtcagagaactctgagtatgattccgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgcccgacggtgaagaagaatcttacacgattgtcggaagcgctgaagctgatccgtttgaaggaaaaatctcaaacgactcgccaatcgcaaaaagcctgctcggcagaaaagtggacgaagaagtgacagttcagacgccgggcggagaaatgctcgtgaaaattgtgaaaatttcataagatccgtttaacaatgaaacacctcgtccaaaatgtggatgaggtgttttttatgatcgtatcaaaaaggctgaaaacggccgtgatttgttttctgctcgtgtttttctttctgcttgcaaggctggctgaaattcagctgttttttacagaatctttttcaaaatccaatattaatctgattcaggaaagcgtcaagcagcggacggaagaagtccttatttcagacggccgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctgacggaagcaaaaaaaccggtgatcctgaacagcagaaaaataaaacatttgacgaaacaatccgtggcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaaaatcgggacaagcgggatggagcggacatttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtgtttaaaacggtgatcgccgcagccgcaatagaacaaaacgaagtgaagccgggcacatcctttaactgcaatctcaacctgtacggagagccgggggatgataaaggcacgctcagttttggagaaagctttgcccaaagctgcaattatacgtttacaagtcttgcggaaaaattgatcaaaaaagatgattccgttattgaaaacatggcggagaaactaggtctcacacagcgggcgggctgggaaggcaagctgtaccgggaagacggattcaggcagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgagaaaaaacaagtcaaaatcgcggacaaaattgaatacaaaaacaaaacgacgatggcgtcattcaaagatcagccgttaaaaggggaaaacatcgacaaatatacggcgcagcagcttcaaaaaattctcagagaagtcgtcacctcaccgaaaggaaccggccgaaggtttcaggatctgccgtatgagatagcaggcaaatcgggaacggcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaacaaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgcagtcagcctcttcatcaacagtccgtcgagcgacgtgagcgaaaaagcggacacgagccagaagcaggaaacacctgcatcaggcaagacgaagcagacatcggatgaagacataaaagacagcaaaaaagatacggcatcagacgatgacaaaaaagataaacaggataaggacacatctgattcatcttcagactctgacagcaaaaaagacgatgattcatcgaaaagtgatgacagcagcaaaaaagactctgattcaagcgatccttttaaaggcgcaaaaataacagagggcggctcatcaagcgatgttgagaaaacaattgttaacccaaaatggaaagcggtcggaacaaagcagacgggagaacatgcggcgacgtatgactcaagctctgaagactggtccgaaatgcttgacgccatctcttacgcaacaggcgtgtcaaaagatcacatgacagtgctgtggctcggaaacaatggaagcccgcaagatgcgaagggtaaagttttagacaaaacgaacggcaaaaagtatcaggtcaccatcacttggaaagacaaaaaaggctggaagccgacaaaagtagaaacgttaaaataaccgcaaaaaagcagctgattattcagctgcttttttctgtcatacgtcagctgaaaaatgcaccgacgcgctgtaaaggattctgccgtcaacggccgtcacctgatgggatacagaacggacgcgaagcataatcgcctggttgttttcaacctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattccattatttgaagattgggcagcgacttatgatgccacagtgcacggggcagacaaacaatacgctgatgtttttaaagggtatgacaatattcttgacagcatcgtcgcactttcgggttctaacgttttagagttcggaccgggcacagggaatttaacggcgaaattagccgccgcgaacaaaaaggtgtttggtgtagaaccgtctccgtcaatgagaaaactggcggctgacaagctttctgacaaagccgtattcagtgacggagattttctggagtttcccgttccgccttttcaaatagataccatcgtcagctcgtacgcctttcatcatttaaccgatgaagaaaagcaagcggctgtaaagcaatatggcacaatccttcagaagcatgataaaatagtgtttgccgataccgtctttaaagatcatgaagcttatgatgaaacaattaaaaaagcaatccgaaacggctatcatcaattagcggacgatttaaagacggaacattatccgacacttgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacgacgggcagctatgaaggcgtcgaagttatcttgctgaaatcggggatcggaaaagtcaacgccgcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtggatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccaccagttcaaaacgccttttgttgtcatcagagctttatctgatattgccggaaaagaatctgacgtttcatttgataaatttttagaacaggctgccgttcattcaactgagcttgtcctgaatgtcatcaaacgaattcactaagcgggggattctcgttctcctccgcttttccaggaggaggacacatattgaacgtgataacagatattacagaactgatcggaaatacaccgctgctccgtctcaagcattttgatataccggagggaacagcggtttatgctaaacttgagatgatgaatccgggcggaagcattaaagacaggctgggcgggatgctcattgaagatgcgcttcgcacgggaaaggtgaaaccgggaggcgttatcatcgaagcgactgccggaaacaccgggatcggactcgctctgtgcgccataaagcatcagcttcgcgccgttttttgcgtcccggagcatttcagcagagaaaagcagcaaattatgaaagctctcggatcggacatcgtgcatacgccgagagaagaaggtatgcagggagccattcgaaaagcgcttgaactggagaaagagattaataattcttatgccgttctgcaatttaaaaaccgagtaaatccattgacttactataaaacgatcggacctgaaatatggaacgcgctcggcggggatatccacacctttgtcgcgggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatcccggattatatggacgagaaccattttgacgccatttacacagtggaagacgatacggcgttttcacttgtcagagaagcggccgagaaagaaggcctcttaatcggaagctcttcaggggcggctctttatgcagcgcttgaagaagcgaaaaaagcgcccgccggatcaaatatcgtcactattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcatacgggttatgaatattcaagaacggccaatccgacgcggacggcgcttgaaagcttaattgcagagcttgaaggcggcgcggcgggatatgcgttcggctcaggcatggctgcgattactgccgtcatgatgctgtttgacagtggcgatcatgttattttgacggatgatgtatacggcggcacttaccgggtgatgacaggtgtgctgaaccgcttcggtattgaagcggactttgttgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacgttttacacgccgtatttccagcagccgctcagcttcggcgcggacatcgtgctgcacagcgcgacaaaatatctcggcggccacagcgatgtcgtcggcggcttagtcgtcacggctgataaagagctcggtgaaaagcttcattatgtgcaaaactcaacaggcggcgttttaggaccgcaggattcatggcttttaatgagaggcattaaaacactgggactcagaatggatgccatcaatcacagcgccgggaaaatcgccgagctgcttgaagcgcatgatgccgttcagacgctctactatccgggatcagcgaaacatccgggccatgagctgacaaaagcgcaaagctccggtttcggcggaatgatttcctttgatatcggcagcagtgaacgcgtcgacgcgtttttagaaaaattgaacctgtttacaatcgcggaaagcttaggagcggttgaaagcttaatctccgtgccgtccagaatgacgcacgcttcgatcccgcgcgaccgccgtcttgcgcttggcattaccgacgggctcgtacggatctcagtcggtattgaggatactgaggatttaacggcggatgtgaaacaggcgcttgattcacttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatatcggcgcggttcttcccggacaagggctgactgcgggccagaaaatgctgatgtttgtaacggattgtgcatttttagcgggcgcttatttctgcgttgaccgttcacttatttataaaaagaggctggaagaggccgaagaataaaaaaaagccattgtcttttgacaatggctttttcatttcttattcagacggggtttcgcgtaattcttttcccattccttttaaaaactgcagcccgaagccgagcgcgcggttaatatcaggatcaccgacggctttcatcagttcaaacatactgactttcctgtcctcttttaaaaatctttgcgcctgatccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagccattcagctctgccataatggacatcgttttcgcgacggcttcttcattttctgcgagaagcgtcttcaattcttccagtttttcagctttcagctgttcctctgttttcgtttctttttgaatttcagtaattgggcttgccattatgtttcctcctttccttaatcagttaggtgcacatagcccggacggttccattttcgctgagcttccacaccgttttgcggatgacgttttttgttccgcggattcgttttcggaagcggcggtgtatcacaggagccgagcacttccatgcggacttttgtctgtttataggcaggtgtatgtgtccgtgaatcatacgcaggcccggtcaggaaattaatcgcagaatctttatctgtagagttcatcggcagataaagctcatttgcgcggacacggtctgtcacaagcgcattcaatttaaccgccccaaaaggagagacgagccggatcattgttccgtcgcaaattccgcgttcagccgcgagctccggcgatacttcaacaaatacatccggcactttagactgaatgcccttcgatttgtttgtcatgtttccttcgtggaaatgttcaagcatccgtccgttgttaatatgcaggtcatattcttcagggaatacggcaggctccacccaatcgctcagcgcaaaacgggcttttttgtccgggaagttaaagccgtcttcataaagaagcggagtgctctctcccgtaaagcttccccacaggaagctgttccagccgctaagaacgtcgtagcttgcttttccgaacagcggagaaaggctcgccatttctgagaaaatgtcgcttggatgcgtgtaattccaatcagcgcctaaacgattggcgacttcctgaataatccaccagtcgggtttggcatcgccgagtgtcggaagcgcctgatacaatctttgtacacgacgctctgtgtttgtaaatgttccgtctttttcaagagatggaactgcaggcaggatgacatccgcgtattgcgccgttcttgaaaggaaaatatcctgtacaacaaagaaatcaaggctggataaaatgtcatgaacatggttggcgtttgaatcgacgagcgccatatcttcaccgacgagatacatggctttcatgtttccttcttcaatcgcatggagcatttcaatattatcaagacccggcttgccgtcgatttcaacaccgtaagctttttcgaatttagcgcgtgcctcatcatcggtaatatgctgataccccggaagccagcctggaagagttcccatatcgcaagcgccttgaacgttgttatgtccccgcagcggataagctccggcgcccggacggcggtagtttcctgtggcaagcagcaggttggaaatcgccgctgatgtatcagagccgcctgtattctgggtaacgcccatgccccaaagaacacaagtgccgtctgcatcacgaatcatttcggcaatgcggatgatcgtatcctgagaaagtccggtgatgcgctccgcatattctaatgtatactttttcagcgtttctttataatcttcaaagtagttgacattctcatcaataaacgcttgatcgtgccagccttggtcaatcatatattttgtcactgccatgagccagacttggtcagtcccttgtttcgggctgataaagaggtcggaccgttcagccatttcatttctgcgcagatcggcaacaattaatttttgtccgtgcagcttatgtgcacgtttcacgcgtgtggccagaaccggatgtccttctgccggattggcgccgacgatgagcacgaggcccgcttttgcgatatctttaattgtcccggcgtcaccgcccataccgactgtgcggaataagccgtccgttgccggtgactggcagtagcgtgaacagttatccacgttgttggtttcaaatacttgacgcgctaatttttgaataacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaatccgttcttccgaatttacgaagtcccagccgaatttccctttcacacaagtggaaatcgcattaaccggagcatcggaaacaggctgaattttaaggatgtcacggccttttgtccatacttcaaaagagcatccgacgccgcagaacgtgcagactgtttttgtttttttcgtccgtttatcgcgcatagccgcttccacttctgacacggcgaagatgcttgtatagtcgggttcaacatttttcactaaatcaatcatcggttccatgacatcttcttttattcctgtcataaatccggcttggccgagcattgatttttccatcagtgcgttacaagggcagacagtgacacattggccgcagctgacgcaggatgattcattaatggggacgccttcatcccaaatgacccgcgggcggtcgcgctcccaatcaattgaaagggtctcattcacctgaaggttttgacacacttccacacattggccgcaggcaatgcattggttcggatcatagcggtaaaacgggtgagacatatcaaccgcgcactttgaatcatctttcggcgtatacggatatttctgatgctcaattcccatcatttccgctgtattatgcagtgtgcagttgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgctgcaatttcccgtttacttcaacaatacaggtgtcacatgtttgaatcggatctacttccggtacatggcatatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaaagccatgcacatagataacggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaggtgaaatgtcacaaaggggaaccgggaatgtctttcataggctaaaatcggaggggacaatatgtctaaaaaaattcatgaatttaacgatattatccggaaattgcgcaaagaattatttggaaaggggccggaacgaattcacaccgtttttgtggataacatggcggtatcaacgctttacggcaatctaagcgcaagtgagcagtttatcgcacgcacgcctgaaggaagagaaatggttcatgcggcgcggaccagcttaattcaggaactgtattcaaaacaaacgcctgacggaatggaagagctcatcggagcaaagctcgtgcatctgttttcagacatcaagatcgaagagaatattgcggtgtctgtatttgtctttgaccgaacaattgaagagcgccgtgaagaaatcaaaagctgaaaaaaattcaattgacacgaaattgtcacatttgatatgatatgaactgcctgcagtggcttaaggacgaattttatggaatgtgtgcatgatctgtacattttctatagctgatattttcattctgcttgatattgttgtatgggtatgcatacaagttaggcagcattcaaacccgttttagacgggctgtttgaatgctgccttttttgttaggcgtctttggaaactgcggggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcctgtcgagtttaatcggggcgtccgtgtttcccatcggattggtgctcgtcgttcttgccggcgcggagctgattacgggtaatatgatgtcggtatctatggcgcttttttccagaagaatatccgccggtgcattagtgaaaaattgggtgatcgtgacgttgatgaatcttgtcggcgcactgtttgtcgcttactttttcggacatgttgtcggattaaccgaaacaggaccttacttggaaaaaacgattgcggtcgcacaaggcaagttggatatgccgtttggaaaagttattgtttcggcgatcggctgtaactggcttgtctgtttggccgtctggctttctttcggcgcagaagacggagccggaaaaatcgcgggtatatggtttccgattatggcgtttgtcgcgattggttttcagcacgttgtagccaatatgtttatcatcccggctgcgatttttgcaggttctttttcgtggggtgatctgattggcaatctcattccggcctttatcgggaatgtaatcggcggggcagtgtttgtcggccttatttattttattgcatattcaaaaaaagatcagaaaaagcaagggatgaaaagagtttcctgaggtaagaaagatgccggaaaacacggacaattgaagcggaatgccagcacattttccgtccaaatcttgaaaaaaatgtttacaaaatggaagttgatggatatacttacaaagtaagaaaaaagcaaagggaggttgaatcacatgacgactttaaacggcaatcaaaatttacaattgaaccgattcagcctgtggaagagttcgtgtccttccttaacctctgcccgtcaagcacgttaatttcggagtatcaggacattcgcagctccccgcagggaaagaagcacgtcttcttttgtctgcggatttagtctgcccgcagcgcatatgaagtttgctgcgggttattttcgcttgtgcggatattgaaagggggtgagcgataatgaccattaatcttttctttttaacactgaccatttcaaagcgttttaaaagtgcggaagagtatgaacgagaacagcaggtcgaagagttttataatgaagcgaaagaacgccagctgaaacacttttatatgaactgaacggacacgaagggccaaaacggaggagaaggaggagatcatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacaggattccatccatcgggcacgggtatgcgtcaatgccccattcatttaaacacggttacggcaacccgtatcgccggcagagaatggcggcgctttcccggcagacaagatatatagcaccgtattattggtactagagcaggcggaaaacctacgttttccgtcttttttttatgaaaacaaatataaatttcaaataaatcgaaacgttcatgaagagaagtgcgtctagttagtacctcgtactaatacgaggtaatattatttctgaataataaatcacaggaatggaaaagcgggtgttatacaatgttgcaacatacatcttcagcattaaaacgaatgcgcgcgaaatactttgctgcatcagaaccggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggctcggaaacattcagcaggggaggcctgaaagcttaccgttccgcgatcgcagctttcataaagttttctcattacatactgctgaaacagtcagcgattacaggacagcatgtaaagaagtgtaccgcgttcttcaaattgacgggtgtttctatatggttttgaaaccttcgcggatgagtgagaaggatgtgattgaggtgctctatgatcagcatttcagagacatttcagttgtcagcagagattcattccattttattactgccattaaatagaatatttcttgggaaataaaaagagctgcttaagtcactgcagctctttttgtgaaattgggcatatttccttatttttggttatttcacatctattttatattaaaaaaagtttttttcttatacaatggtaatcagatgaccgtacattttaaatgttttgaacaaacggaatgaatattcattccgcatctggaaagggggatgaaatgacagcttcaaacaaggttgaactcattatgaaagcgtcgcttactttgtttacagatagaggatttgacgcaacgacgattccgatgattgccgctcaggccgatgtcggaaccggcacaatctaccgttactttgacagtaaagagacacttgtgaacgtactgtatcaggaaagtgcgcagcgttttatgaaaaaagtcaaaacggactttcagggtatctctgtaagagaagggtttcatcacctgttttattgtctgattgattttacgaaggaaagtgagtatgcattgttttttcttgaaacgaataaggacgcctactttctgaatgaaacaagccgtaagcttcttgatgaaataacacagatgcttgacgtcttttttcagcgcggcaagtctgaaggtgtgctccgcaatctgccgtccaatgtgctgatggcgctgctgctcggggcatatctcaaactctatcagcttatccggacgggaagcgtcgaaataacaaaaccgtttctgaaagaactggaacaatgttcttgggatgccatcagaactcattaattattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgtttcgaatttccgagctctgtcggggtcttcgtctcaggccgcgagctcgcggcagaagtctgtgatgaaaagcgatttgataaaaatctcagcaaagccttgctgaaagtccgtgagtttggcggtgacggactatttacgagctggactcacgaaaagaattggcagaaagcgcatcggattttattgccgagcttcagccagaaggcgatgaaaggctatcattcaatgatgcttgatattgccatgcagctcgtgcagaagtggagcagattaaatccgaatgaagaaattgacgttgccgaagatatgacgcgcctgacgctggatacaatcggcctgtgcggatttcattaccgctttaacagcttttaccgcgacacacagcatccttttatcacaagtatgcttcgcgcgctgcaggaggcaatgcgccaatcacagagacacagcctgcaggacaagctgatgatcaaaacgagacatcagttccagcaggatattgaagtgatgaatgaactcgtagaccggatcatcgctgagcggagggaaaatccggatgagaatctgtctgaccttttagcattgatgcttgaagcgaaagatcctgtaacgggtgaaaggctggatgatgaaaatatccgctatcaaatcattacctttttgatcgcggggcatgaaaccacaagcggactgctttcattcgcgatttactgcctgctgaaaaataaagataaattgaaaaaagccgttcaggaagccgagcgggtgctgacgggagagacacatgaatataagcagattcagcagctgacatatatccgcatggtgttaaacgagactttgcggctgtatccgactgccccggcattttccctgtacgcgaaagaagatacggttctcggcgggaaatatccgattgcgaaaggacagccggtgacgattctgactccgcagcttcaccgggataaaagcgcgtggggagaagatgccgagctattccgtccggaaaggttcagcgatcccgcggcaattccggctgatgcgtataagccgttcggaaacggacagcgcgcatgcatcgggatgcagtttgccctgcaggaagcgacaatggtgctcggccttgtccttaaacactttgaactgattgatcatactgattatgagcttacgattaaagaagctttaaccattaagcccggtgattttaaaatccgtgtaaaaaacaaggacgtgtctaatcagcattccgcacaaaaccataaagctgaaggcggcggtcacaaagaagaaacgaaagaaatcccgtcccacggaacgccgcttctcattctttacggatcaaatttaggaactgcggaaggaatcgcggaagagctggctgacatcggcagaagcaaaggattttcaactgaaaccggcccgctcgatgattatgccgggaaactgcctgtaaaaggcgcagtcgttattgtgacggcttcttataacggggcgccgcctgataatgcggcgggttttgtgaaatggatggaaacccttgaagatcaggaattaaagggtgtttcttacgctgtcttcggctgcggagaccgcaactggaccgccacttaccagaggatcccccgcctgatagacaaagtgcttgaagaaaaaggggcaaaacggctgacttctatcggggagggcgacaatgccgatgattttgagtacagtcaggaagcctgggaagactcattctggaaggacatcatgaaggcttttcatatagaggccgctccaaaacaggcaaacaaatcacagttatcaatcgaatacgtaagtgaagcagccgagacgccgattgccaaaacgtacaaagcatttgaggcggaagtcatcacaaacaaagagcttcataccgaaagcagcaagcgttcagtccggcatattgagctgcgtctcccgaagaccgaaacgtatcgggaaggagaccatctcggggtgcttccgcaaaacagcggggaactgatcagccgtgtcattcgccgattcggtcttgatccgaaccagcactttaagatcaagggccggcagctgcctcatctgccgatggaccggccggttaatgcgccggagcttttggcgtcatatgtagagctgcaggaaccggcaacgagagcccagcttcgcgaacttgccgcccataccgtgtgcccgccgcaccaaaaagaattggagcatctttattctgacgatgcggcatataaagaaaacgtgctgaaaaaacgaatgaccatgctggacctgctggaagattatccggcttgtgaactgccgtttgagcgctttttagaacttctgccgtccttaaaggcgcgctattattcaatctcaagctcaccgaaggcaaacaaaagggagctcagtatcacggtcggcgttgtgacggctccggcgtggagcggccggggagaatacaggggcgtggcttcgaactatttagccggattacaaaatggcgattctgccgtctgtttcatccgctcgccgcagtcgggtttcgcattgcccgaaaatacgaaaacgcctctcattatgatcggagcaggcaccggaattgcaccgttcaggggatttatccaggcgcgggctgcagaaaaaatgtccggtaacagcctgggcgaagctcatttatacttcggctgcagacaccctgaagaagacgatctgtacaaagatgaattcgaccatgcggagaaaaacggccttgtcaccgtgcatcgggcgtattccagattagatcaggactgtaaagtttacgtacaggatgtcctgcttcgcgaggctgcacagattattgggcttcttgaccaaggcggccatctctatatatgcggagacggaagcaaaatggctccggctgtcgaaaatgtactgcttcaggcgtatgaaaaggtgcataacactgattcaaaagtttcctcgaattggcttgaacagctgcaggcggaaggaagatatgcgaaagatgtttgggcaggtgtgtaacagaagcgtaaggcaattgaagattgtgttttaattgaagaaagccggcacgatatttgaaatctactgaatcaaaaggaatagttatagggagtatcgtgccggccttatctttagtatcggacaaaagacacaaatctttaatgtttttattgatttacatgcaggcggctatgtcccttttttctgaattccgccagaaataaaaccggataagacagcaatagcaaaaccgaaataaatgaaatgataccgatccaatgaaaatgcgtccaaaagaaaccgccgcaagacccggccgcgcttgacccgatatagtatgcaagcagatataatgaagaagcttgcgcgcgctgatcaccggctgctcggccgacccaggcgcttgcaattgaatgtgcgccgaaaaagccgaaggtaaacacggcaatgcccgcaattttaagggcaagctggggcaaaagtgtcaccgctgcgccggcaagcataacaaaaatcgcaatcttaatcatttttgcacttccgaaaagatctgcttttttccccatatagacagagctgaacgttcccgcgagatagacaataaaaataaaaccgattacagtctgtgacaaatgataaggagccgccattaaatgaaagccgatataattatataatgtcacaaaactccccattaatataaatcccagagatattaacaaaagcagccgtttgcggtgtagaaccgctccgtattccttacatgccgcttttacgcccgcatgccgctgagatgaatggcgcggagccggaagaaaacgccaaaacaaatagcttaatataatagaaagaatgccgataatggcaagcgccggccgccagccgaatacatcagtcagaagccctgttaacagcctgccgctcattcccccgatgcttgtgccgctgatatacaggcccatcattttcccgaggcccttcggatcaaactcctcgcctacatatgtcatagcgacagcaggaacgcctgccagaaaaataccgagcagccccctcatcgccaaaagcgccggaaaagccggactgaacgctgttaatagacctaaaacagaagtggctgttaacgacagcaccattaatttttttctgccgaatccgtcagacaacgaagcagcggccaataatgaaaatgccaaaacggctgttgagatggataaagttaagctggcagccgcagcggaaatatgaaactcttccgaaaacaaaggcataagcggctgtgtcgtgtaaagcgtggcaaatgtcacaaagccgctgataaacagtgccaagctggcctttctgtaagcctttgtatgaggctgaataaacgtcatgaatgtccctcttttctcactgttggttatatatgtatcgtacgcttttcatttcaatgtgtctaatttataataactatagaattaatgcgtgtaggttatgaagaaaggggagaaggagaaaatggagcttcatcaaattgacaacttcattgcggcggcaactcatcagcatttcacaaatgcggcaaaagaaagaatgatttctcagccggcattaagccgatcgattatcaggctcgaagaagaattaggcgcgccgttattttacagagagacaaaagccgtccggctgacaaggtacggagagcagttcttaataaaagcaaaacaagcgagacgagctttaaatgaaggcgttgaacaagtgaaaaaaaatatgagcctggagcacggcgaaatatctgtatcttttcttcatacgctcgggttgcgcttgatgcctcagctgattgccgaatttaaaaagctatacccaaacgtgaccttccggctgtatcaaggcgcaaatgaaacgcttcgcaaaatggtggaaacgggagatgcggatatctgtctcagctccccgccgcttcccagcgagcttttacaatggacggtgctggagaaagagcctctttatgcggtgcttcctgagaaccacccgcttgcaggaaataaaagcattcaaatgaaagagatgcaggacgaggattttgtcggatttaaaccgggatacgggctgagatatatgtttgatctgatgtgccgggatttgaatatacacccgcatctcgcatttgaaggagaggaagtgtcaaccatattagggctgaccgccgcgggtctgggggctgcagtgctgccgaaaaccgcggagcattcatactttccggtcgtttttctcccggttgcagattaccaatgcgaacgcaccatagcgttagcccagttaaaaaaccatgctctctctcccgctgctgagcgttttaaacagtttgcacttgattattacaaagcacgcaactgagcggtcattttattaaaatcgaagttgaaaataaagcagaaagaaatacagaaaacggaggaaaaccatggcgaaaaaaacagtgaaaacaaatgctgtccgtatcattgagcagcaaaacattccctatgagctattaggttacaaaacagaaggggaacagcccgcagacggtctttccgtttcacaaaaaatcggatactctgccgaatatgtttataaaaccttagtggcatctgcaggaactgatcgttattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttccgacttttattgatagatccgctgaaacactggcgtttatgattgtcagtgcggggaaaatcggaatgcagctgaaagtagcgcctcatgatttagccgaagcaagcggggcggtatttacagacattgtataaatgtccggtggatctaatggaatacacgtttcaagggagaatgataatgaaaaaaagatatgaaaacttgaatggcgtgaagaatgaacatggattcatggacatgtggaaatggatgaaagaacgaagagaaaaaagtaaagatttaaacgagaatattccgaaagcggtcacaagggatgtccgtgatgttgccgtcaatcggacggaaaccgccataacatggatcggccattcttcatttctgatccaaatacaggggcttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggattgaaaaagctgttcatcaaaaaaggccgcaaaaaggttcatgaaatgaattggtgggatcgttttgagatgcggggggtgaatatatcatttgttccggcccagcactggacacggagaacgctttgggataccgatacctctcattggggaggctgggtcatagaaagcgaaaacggcgagtccatctattttgcaggagatacaggctattttgaaggctttaaagaaatcggagagaggtttcgtattaaggcggctctgatgccgatcggagcatacgaacccgaatggtttatgaaagtgtcacatatcaatccggaagacgccgtgaaagcgtttttggagctgaaggctgacagtttcattcccatgcattacggggcattccggcttgctgatgatacaggcccggaagcattaagcagactgcacggcgagtgggcccggcttgcattacctcctgaaaacctgagagcattggcgcttggcgaaacattttggctgtaacagcaggttttcgctgccgacaccaatcgtttaaaaacggttggtgttttgttgtcaaccaaaggtgaacagcctcagtataaaacatgatttttccggaatctgcggtaaaaaacaaaactttttactcttttgtttcactatacaatgaaaacggtttcgtatgcgcggtatatttaacctatcacaattgctccagcagaaacggacaggaaggatagaaaaacagatgaaatacatgaattcaagacagaaaaagattttgtatctgttgttatctgaacctgatgactacttagttgtgcaagatttcgcagacagggtccgctgttctgaaaaaacgatcaggaatgatttgaaaacgattgaagatttcctgaatgaacatgctcaagctcagctgatccgcaaaccgggattaggcgtctatttacatatatctgaacaggaaaggtcacggttaagccggcatatttataatgagcactttacatgcaggcacaagaccgatgaagaaagaatacttcacatcgcttatgatttattaatgaattcaaagcccgtttccgcaaaagaaattgccgcacagcattttgtaaacagagcttccattaaaaaggatatcagtgcggttgaagagtggctgaagcgatttgatctcacactggtttctaaacagcggctcggcttaaagattgaaggggacgaaaaaaacaaaagaaaagcattggcgcgaatttcagatttgattgataatgcggagtttacaagccaatttataaaaagtaagtttttaagtcatgaagcggactttgtgagaaaagaaatcaagttattacaaaaaaaccattctatctattttacggatgaaacatttgaaagtttgctgctgcatacattgctgaccatccgccgtatcaaaatgaaacagccggtcgccatctctgcaaggcagctggaggcggtaaaaaagaagaaagaatatgaatggacactggcttgtttaaaacggcttgagccggtatttgccatccggtttcccgaggaagaagccgtctatttaactttacatataataggcgggaaagtgcgctatccattgcagcaagaaaagaagcttgatcttgaagattctgagctttccaaagtcgtcaggcatttgatcaatcgcgtttcagaactgaaaatgctggattttcacaaagaccaggaattgatcaacggattgaacattcatctcgatccggtgttgaagcggctgagctatgatctctctgtttcaaaccccatgcttcacgacatcaaaaaaatgtatccttatttgtttcatcttatcattgacgttttagaagacatcaatcaaacatttgatctttatattcctgaagaagaggcggcctatttgacgctgcattttcaggcagcgatcgaacggctgcgccgaagcagtcataaccctaaaaggacgatcatcgtctgccatatgggcattggcatgtcgcaattgctgcagactaaaattgaacgcaaatttcaccacattacgataaaagactgtatcgcaaaagcggagctgacagagtatatcaaaaagcataaagatatagatttcgtcatttctacgatagggcttggaaatgtaacgatccctcatatcgtcgtatcaccgcttttggaacctgctgatgaaaagaagctcagcgcatttatgcaacagcttgatacatcacaccgccgggagcaaaaaacgtttaaaatgctgaatgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagcccattgagtgggggacggaaaaggtgtcgcttgtatttatgcttgccgtcaaacacgaagatcaaaacaaggtaaagcaattattcagtgagctttcctatcttagcgagcagccggcatttattcaaaaactgacggaagaaaaaaatgtgatgacgtttttatcgtatttaaactattaaaagcaggggatggctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccagggcggaatcggggtggaaaataggctgaccgaagaggaaatccgggaagcagacgcaatcattatcgcggcggaccgttcggtgaacaaagaccgattcgcgggaaaaaagctgctggccgtcggggttcaggaaggcatccgaaaaccggaagaattaattcaaaaagcgcttagcggtgaagtgccggtctatcaatctgcttcaaaagctgaaaccgcaagtcagcaaggcaaaaaacaaaacccgatttaccgtcatttaatgaacggcgtttcttttatggttcctttcattgtcgtcggcggattattgatagcggttgcattgacgcttggaggagaaaaaacaccaaagggcttagtcattccggatgcgtctttttggaaaacgattgaacagatcggcagcgcttctttttcattcatgatcccgattttagccgggtacatcgcgttcagcatcgccgataagccgggtcttgtccccggaatgatcggcggatatattgcggcatccggcagcttttacgacagtgcgagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtatttctgatcggcgcccccgtcgctcatattttcgcatcattaacggtttggcttgcgggaatgaaaggctcgagctcaattctcctggcattgattttaggagcgatgatctcttttgatatgggaggacccgtaaacaaggtggcctttctattcggatcggcaatgatcggagaaggaaattatgaaattatgggcccgattgccgtttccatttgtataccgccgatagggcttgggattgcgacgtttttaggaaaaagaaaattcgccgccgcagaaagagaaatgggaaaagcgtcatttacgatgggccttttcggtatcacggaaggagccattccatttgcggcccaagacccccttcgtgtgatcccgagtattatggcgggttctatgaccggctcggtgatagcgatgatcggccatgtgggggacagagtggcacacggcggccccatcgttgctgtacttggagcagtagatcatgtattgatgtttttcatcgctgtaacagcaggctctcttgtcaccgctctgttggttaatgtactgaagaaagatatggcgaaatcccccgcgcccggtgaggtgctgccatctgccgcaccaaatgaagctgcagcggcaaaagaaacaaaggaaccatctcaggctgacagccgaaaagccgggatgaccgaaatcaaaaaactgactgacattatcagcacggacttgattgaaccgcatttatccggcgaaacgagggatgacattatcgatgaaatgatcgagaaattgtcccgtaaaggtatgcttctgtctgacagcggatttaaacaggccattttgagccgtgaacagcagggaaccacggcgataggtatgaatatcgccattccgcacggaaagtctgatgccgtcagaacgccgggtgtcgcattcggaataagacgttcgggtgttgactggaacagccttgatggttctgatgcaaaactgatttttatgattgccgtaccgaaggaaagcggcggaaatcagcatctgaaaatattgcagatgttatcccgaaaactgatggatgacagctatcgggaaaggctgctctccgttcagacaaaagaagaggcgtatgagcttctggaagaaatcgaataaagcgggggatgatcatgtctactgaaccgatatttttcaatccggttttcaaagaaagaatttggggaggcgccgccctgcgtgatttccactataatattccgtccgagcggacaggggagtgctgggcctttgccgctcatcaaaatggacagagcacagttcgaaacggcatgtataaaggatgtacgctcggtgaattgtgggagcatcacagagatttattcggaaaccttgaaggagaccgttttcctcttcttacaaaaattttggatgcggaccaagatctgtccgttcaggtgcatccgaatgatgactttgccaaaatgcatgaaaacggggaacttggaaaaaccgaatgctggtatatcattgattgtgaaaaagatgcggagatcattttcggccacaacgcaacaacaaaagaagaactgatatccatgattgagcgcggagaatgggacggacttctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgacagacgttccatctgtccgtgaacggccgaccgttcaatataaacaaacagatgatctgctggcagctgttttaatagaatgtccttatttttcagtcgaaaagtgggatgtaaaaggtgaagcaaatttattccagaatcatcccttccttcttgtcagcgtgatcgaaggagacggaataataattgcaggcgggcatgaacatccctttagaaaaggagatcacattctcctgccttccggtttgggagaatataaactggcgggccatgcaaagtgtattgtgtctcatctgtaatcttcaaaacccttctctggcagcagagaagggtttttcatcacttttacaaaaaggccgaaatttccgtggtccgttcctgaatttaatctctcaatttgtatacctcccgagccattgattcaagtatgtacatagcggggatttgggtggtgatattcgcattttcaacccattcttccgtcacgtaatatgaaatattcacatcggacattttggcaatggttgaatgtttatgatttgtaatactgatgacccggcttccttcttgtttcagctgattcagatgagtcaccgtagaatctccttcacctgaaaccgataatgcgatcgtgatgctgttatggcggaaatgggaatgggccggaaagtaaggatctttaatatacattgaaagtttccctaagcacgaaaaatatctggctccgtattcggcgagaattcctgaactacccactccgataaaaatgacgctttctgcatcggctgcaagggctgctgcttccttcagcttttcttccatccctccgcttactgttctttcaaaaaactcggcaacggaatgatggggactctttaaaatcgtttttttatttgcctccgcatacattttcagcttcaccttaaactccgaaaacccttcacagtttatttttttgcagaaacgtaaaatagaagccgtagatacatgggtttcatttgacaattcacggattcgcatatagacgactttctcgctgttttgggagatgtagttgtataaagaagtttcaagctcgttaaatgaagcaatcatttcgtgtgtgaacatgcagggggattctcctttttatgagaatggtgaatgtacatctcatcgtaacatatcatttttaaaagaaacatagtgttatttttatgtgacaaatcactttttgtgtcattcaaaacaagacgtcagccaatgatttacggcgcaaaacaactgcggatataattcgttcatacgcttatgcatgatctcttcaagggtcgctgacaaaagcggccgaaaaaaggaggacaatatgagtatcaaactgatagcggttgatatggacggaacgtttttgaatgatgaaatggcatataacaaagagcgttttatgaatcagtatcgtgaattaaaagcgcggggaattaaatttgccgtagcaagcggaaaccaatatgcgcagcttacatccttctttccggaaatcaaaggtgaaatcgctttcgttgccgagaatggcgctttcgtcgtgaatgccggagaagaattattcgcgggtaacatgtctgaagacactataaaagcagtaatccgtgctttagagcagtatgaggtgaaaaacgtcattgtctgcggaaaaaaaagcgcgtatattcatgaaaatgccagtgaagatgaatatctgcatgccagtaagtattattatgtgttaaaaagggtgccgcattttgaaaacatcgatgatgacattttaaaattttccatcagttttcccgccgaacattgttccgcacttctgaggcatttaaaagacgctatcgggtctttcgtcacgcctgtatcaagcgggcacggtgacatagatctgatcataccggggcttcataaagcaagcgggattaggcttctccagaaacaatgggggataaatgatgaagaatgtgcggccttcggagacagcggcaatgatttggagatggtgtctgccgtgaaatacggagtcgctatggataatgcgcaggaaagcattaaacaggccgcggcgcatatcgcgcaatcaaacaatgaggaaggggtcttaaacgcgattgattccattctcaaatgtgaaaaaccctttgtctgaaaaagacattttaactgcggaggtgctgaacgatgattaaattagtgattacggatttagacggcacatttttaaataatcaaggcgattttgacagaacgttatttgaaaagacaaaacgagtaatggaggaacagcatgtcgctttcgccatctgcaccgggaaacagtgtgaaagggtggaagccttattcggagaagacgcgaaagatttttggattttaggagacagtgccgcacgtatgaaaaagaacggcaaattcgtatatgaatctttgatcagcaataaagccggactgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactgagataaaagacgattttatcaagattacggttcatgaccccgacgccaactgtccggaaacgagagaaaagctgcatgaattttttcaccaattatatatcgtagcatcagaagatacctggatggacatatcaaatatcggaatacataaaggatcaacagtacaagaactgcagggattattaggggtttcggctgatgaaacaatggcattcggagacggccgcaatgacaaagaattgatggaagcggcatcctacagctttgcggttaagaacgccattgacgaaataaaagatgcggcgcactttgtcatcaaatcaaatgacgaaagcagcgtcatgcacacgattatgagaatattagcgctgcaaaaacaatgagaaagcagatcggctaaagccaatgcggcagggcttactaggaaaagaaaaagcgggctatcctccgactttaaatcactactcattttccgaaaatatgttaaaaatgaataaatatctatatttgacccaattgtattggtataatatgtataaaatgaatgaaacggcgtaatatcaagatgaaataaatcacttcatatcatttgatatcagacaaaaagtaggaacttcctcgttttaaaattgggaggtgtttgtattagcccgctgttgagtcccgcgtatatcattctcatttttcttccggcagcttcttttctgttagggattttaggatatttcatcttcaaaaaagtatggatgatggttgttattgtattcattttgtccttgatatttatgtttattgtaataggtgccgaaccgacatttttcatttgggtggctatgatgacggggagctgttttatctccggttcaatcactaagacggtatggacttttgtaaagcgaaaatattagacacagaagaatcctgtttgaacagctatccttttttgccgattgaagaaaaggaagtatagagtgatctgttatgttcttatattttgtctgttattgtattgtctgtgtatcgttttgttcttttttaactaaacggagcactataattgaactgcagatacatagaaatacaaaaaaggataaggaggatttttatgtttcaaaccttagaccattttttgaaatcttgggaattcgaagccgatgcgacacaaaaactgctgaatcatctgactgatgaatcacttaaacaagaaatcacttcacaacattggactttaggccgtattgcatggcatactgtcgcggccattcatatcattacctcgaacacagatttaacgttccacgctccggctgaagattatcctgttcctgcatcggcgcggtttattgctgagagttatcatcaagccagtaatgcatttgtgcaggcgttaaaaacgcaatggactgacgatacacttcaagaatgtgtcaactttattggtcagcaattgccgaatggttcacttttgatgtttttaattcaacatcaaaaccatcatcgaggacaaatgactgtccttatgagacaagcaggtttacctgttccgggtatttatggtccggcaaaagaggaatggacaacatttggtttggaagctccgaaataggatgttgttgtaagggctcgaacgaatagatgataccaatcaatgttggtatcttttttgttttagtcttcgtgacatgcagacgaatcaacagttcaaaaggtgtaaagtgagttcaataactgcaggaaggcgattatgatgataactaaaatgactcaattcaatatgaaagacttcaataaaccaaacgaacctttcgttgtttcagggagaatcatcccttcatttgaaaacaatgtttggacatatacagaggagaaatttgctgaaccttatgtcaaaaaatatgacgatgaagacattgatgtcagttatattgaagaagaggataaagttgtctttttttattacgcagagaacgactgtgtcggccgtagtaagcttcgttctaattggaatggatacgcactgattgaagacattgccgttgcaaaagattttagaaaaaatggtgtcgggacggctttattacataaagcgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatatacagtatttgatgtttcgtcatttagcgggtgtgtgccgcaaagtattcaaaacatcggcttgaggatttataataaggtatatcaatcaatgcagggggagttatgtatgaagtgcaaaaaaatgaacagggtacaattaaaagagggaagcgtatcaatggccctataaactgcgtctgccctcattaatggagggaaatttgtgaatacgccttattcacagtcagctttacggcacaaccaagtgttcatttggctttgtgttttgtcatttttcagcgtattaaatgaaatggttttgaacgtctcgctacctgatatcgctaacgattttcataaactgccagcgagtgcaaactgggtgaacacggcttttatgttaacattttccatcggaactgctctgtatgggaagttatcagatcagctgggcatcaaaaaactgctcctatttggaattatggtaaatggcttcggatcgatcattggatttgtcggacactctttctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgtcggaccagctattggcggaatgatcgctcattatattcactggtcatatttgctgcttattccgacagcaacagttatcaccgttccattcctgatgaaactgctggaaaaggaagaaagaatcagcgggcgctttgatatgacggggattatattaatgtctgcaggcaccgtattttttctgctgtttacaacgtcatatagaatgtcttttctgatcatcagtattctggctttcctgatatttgtgaaacatattaggaaaactcaagatccctttgttgaccctgcactggggaaaaatgttttgtttatgacgggcgtccttagcggaggcctgatattcggcactgctgcaggatttgtgtctatggttccttatatgatgaaagatgttcaccatttaagtactgcggcaattggaagcgggattatgttccccgggacgatgagcgtcatcatcttcggttacattggaggattgcttgttgatcggaaaggttctttgtgtgtgctgaccattgggattgtattgatgtcttccagctttttaatcgctgcctttttcatagatgcggcaccttggcttatgaccgtcataatcgtttttgtgtttggggggctctccttcacaaaaacggttatatctacaattgtgtctggcagtttgaaacaaaaggaagccggcgccggaatgagtctgcttaattttacgagctttttatcagagggaacgggtatttcgattgcaggcggtttattatcgatcagcttgctgaatcaaaggctgctgcctgttaacgatgatcattccgcttatttgtacagtaatatgctcattctttttacaggaatcgttgttatgagctggctggtaaccatgaatgtctataaacgttcgcgaagaaatgactaaaaagggaaaaggatcaaacttgataaaagttttgatcctttttttaaggagcttccttattacggaaccttttgccgatcaatgaaaggggagttaaagtgaattacatttataagaaaaaggaaaagaaaaatggaaaattgtatcatttcaatcagagataaatgggagaatgcacttattgagtctgaacaaaaaaataatcgtaatcaattaccgcaacgagaaaacaaccaagttttcactgccaatcgagacttttgaaaaagtgtatgaggatattaaaataggccggagagaaagttaatcactgtttgaaaatgactatgaagttcgtaagcggtatggttttaaccgcatctggattcccctggcaaagtaaaggtctttagggatttatgtcaaaataatagtaagtaccttatgcaacagggagtttggttgcttcataaggagggggaagtatgaaaaataagattcacatattgggagcctctggtgtcggaacgtcaacattgggtgttgcattatcaaagcatttgccgcatacgcatcttgatactgatgattactattggacagataaattcactaaaaaaagagaaatcgctgaaagaagaaagttacttaaaaaagacttgacaataaatgagaaatggattctttctggcgcagtgtgccgctggggcgatgatctaaaaagttattttgaccttgtcatcttcttatggattccgcaggatatacggcttgagagattaaggcatagggaatttcagcgttatggaaacgaagtgttagccggcggcagtaaatatgaacaatcaaaaacatttttagagtgggcttctttatatgatcatgccggaatggaagttagaagcaaagctttacacgaacattggatgtcggatttatcttgtccattgttaaaaattgaaggagattactcagtcaatgaaagagttgatcgtgtcttggattatctgaattctaattaaactaacggatggagataactgcaaattgaaagacagttccggccattttaacggagctgtttttttataccgccttcagtttgtctgttgtgaagtgatttattctcggaaagaagcagcggaattaatagagaactcacttcgggaaaccgtgaaggcaggaatcaaaacgggagacttggcggtcaatcatcaacgtcagactttgcagaagaattgcagaaatgatcggatgttaaggcggaaaataagaagtgagaagcagatcatcaaaacgcaatacacctcaatttatattttcagtaagatcggctctgctcattaaaaaactcaattcgaagattagcggcatcaatattgccgcagatcgggttagtgacataaagaggaagggataagaccccttccttaaaacctttaattcctctaatttcattgtcagatatattccttttttgaaatgggtatccaaatttcacttttaaaagatggcgatgttacatccttatgctcgttccacaggatttctgggccttcaatttgttcataatgtgacgatggaaaccattcggaataaatccgcccccatacttcctgcagtgcatccggaaatgatccggctgcttcgaatacagcccatgttgaggcagggacttcaagctgtgataggtgatttgggcaatgtttcgttgtggctgcgccaatatagtgatcaagctctccgttttcctctgtcctgccttcagaaaagttcgtggatgcactgatgagtcctgcaggcgctgtattagaaagctcttttagttgtttgattgctgcttcatctaaactttcccacatcgatgcaatgtcaggattcacgcctttgaacaaaatagggactctttttttaatgccgacgatgcgaaatgcctctttttcttcaatgcgatagttcatttcatttcctcctttgattgataactggaaggtcattcgcggataagctttaagtgaatggccattatgtttaacttctgatgggtttatgccatgcagattttgaaatgctcgtgcaaaagaatctggtgagtgataaccgtattttattgcaagatcaatcacctttacgcggctgtctttaagttcaaaagctgcaagagtaagacgtctgcggcgaatatattccgataatgaaatacctgtaaggaaggaaaacatccttttaaaatgatattcagagcagaaagcaagccttgctgcttctttgaaatcaatagcgttcgtgaggttttcttcaatatacgttaatgcgctgttcatccttttaagcgaatccatttatttgacctcctttaacaaaagaataacaggagcgaaatgtatctgcccgacatttcgtgcacagttttgcaggataacttatatgtaataaattaagttactcacctgtatttgtacagataaagaaaacacctaataactgcttgggtttcataagatgaaagaaagttatcattgttttatattgaaaagaaaatagaaaaagacggagttttcttgcgggaggggtttactatcaatcaattgaaagctgcatacgcggaggcagttaaaaaattttagttgatgtcgagaacgatgttcatcttcactgcttgttcaattagaggaagtgattcttccttaagggagatcactttttttattcgactaaagcagcagtttagcggaagaaggagaaaaatcagttgacttacttgaatactgaataggtgtaaaaagtggttattcatacggattgaaaaagaagaacacgcagcagactcacttgctcttgtttggggcaagtgttgacaaccctattagctggtttaattaaagaaggggtataaaacctgtatcaatgatgttactagatatctgcgacacaggttttatatttagctaaaatattcttatatattccacattgcatttttttattatgcaatagttcactctatttctgctttcaatttttcgaaccactctaaattaaccaagtgatgtgaacgggaattttcattcatacggcgaaagtaattgattgtgccgggaatttcttgagtgatggacaggtattcatcaaggagctcgattcgagttttagtctgatcgatttgtgattggatcagttccagtaatttatttttgtcgaattcatcggcaaagagtaacgccccataaaattgcaggttcacatattccgatttggtgccgtatttgatcattaatttttcaaattctgcccttcccgaatctgtgacgttaaagttacggatttcacgcccgctggttgagggtttctgctgaatctgttcaatcaaacacttttcttcaagttgctgcagattgtaataaaatgaacctttcgtgaagttaacaatgtatttgtaatgacgtttttccattaaggccagaagttcatagccgtgagctccggggttttggatgagcaagccaaggataagtaagggaatcatggtttcatcaccttcgccatccgcgcctcaaattccgcgtacgtgattttacccgaagccaaatccatactatgaaggtaaatctgttctgttttagaatagtcacccttcactttcagtgattgctcctctcccgaaatgggtttcaggatatggtgctttttcgaaaaagcctcgaaatagcggtaaccgaatttgcgttgtgaagctgcgtctaaatgaatgccatcaggattcgcagtcaaacctgccgcagtaacaaaataacaattctgttgttcattagcaaaacgcagcaattgttcattaacctgtcgaaattcagacgcgtgctgtccaaaaccggtcttcccaagaaagtcaccaagccctccaataatcaacggtacatcatcaagtttcaactcgtttcttagcgtctcaatgataagagttaatttctcgtaataagtttcatgcagcgaacgataactgtcactctcaccttggtgccaaaggattccgcaaatttgactggaacggagggcgaagcgggcttcggacaaagcatgctgaaaaaggatgccttccggatgccagtcattcaatgaactgccgccttccgcacaagggatcaagccaatttcttcatcgggatgagctttcgaccaagcatctgcaaaagatgccgccaagccaacgccggaaaccggacggtcgtaattaatcggctctgtcatcatctgccactgtccattgcgcagcattttaattttttcattatagatagggtctacttcattcaaaaatccacggcccgccatattcgactgccccaacattaaaaaagactttatcatctgatttttcacttctttacatcaatattttagtctaattagactatagtcaattcagcttgtcttgtaaagttctaataaggttttacttttattagtagtatgtatgaaaagcaaactaacattgaaaatttggtggatgtatttgagaaatagcaagttcttttgctttagatcttgataaacaatgaaaaacaacaaaaaccctgtcatgtaagggttcctatgaggttcaaaatcatttttcatagaaaatacattcaatgatgggggtgagcccaaatgaaatggattgttaaaaagggagggctgtgttgaaggggttaaatatcaataaaaaaattattgaaaaggttaacgattgtaccaattctattcatttgttatgttttacttttaaatcctgaagttatacttgaagaggaatgtcctaaaatgcagaaaaagccggagtgtcagatccggcttttcgctcactttcccttcttcttccgcttctccttttccgcccggtaaaactcatgaaacatcttcatcaatgcgcgtttttcaatccgcgacacataactccttgaaatgccgagctcctttgcgatctcgcgctgcgttttttctttttttaaatcaagcccgaagcggccgacgatgacttctttttcgcggtcgtctaaaatatcgatatattttttgaccttttcaagttccatgttgagctgaatggtgtcgatcacatcttcgctttccgacttgaggacatcgatcaggcttatttcattcccttctttatcctggccgatcggatcatgaagggagacgtcttttttcgtttttttcaatgcgcgcagatgcattaaaatctcattttcaatacatcgtgcagcatatgtggcaagcttcgtgccttttccggctgagtagctttcaattcctttgatcagcccgattgtaccgatggagatcagatcttctgcgtcctctcccgtattttcgaattttttcacaatatgggcgactaaacggagattgtgttcgatcagcatgttgcgggcgtgttcatcgccttcagccataaggtctaagtattttttctcctcactatttgagagcggttgtggaaaggcattatttttcacgtatgatactaaaaacacgagttctttcacaataaacccgagcgctgcaaaaacacctgtcaccatcctcacctccacaaagttatgtaggcaaaagcctatatgtaactgtatgtggcagtcacgctgtttgtgtctgtacagggaaattaatcaaaggcaggttttatttcttacagcctcttgatttttgctgattgagcctgtatattgttaaaaaaagtaagggtgaaaagaatataacgaaaagcgctgaagagacgagtagacagatatcattcatgacagagagctccgggagctgtgaaggagtatgaatggatgtgttgaaacaaacctcttagcttcgcatcggaatcatgaaaaacgaggatgatgcggcggatactcctgttaccgagtaagctttgtacccggcaagaggccggcaccaaaccgaattgaggtggcatagcgggctgtttcccgtcctcaagactttattgtcttgagggcgttttttatttctaagggagggataagatgaaaaacctgaagtcttggcggtacccgatgcttctgttaaccggaatcgggatagcaaatattggtgaatggatttattttttgtctcttaatcttattgttttaaaagaaacggggtctgcttttgcggtttccatcctttatttaatcaggcctgcggctgttttgatgacaaatgggtgggcgggcagcatcatcgacaggtgtaacaaacggaatatgatgatgtcgcttgatttcatccgtgctgcattcattgctgttctgccgctgatgtttactgtaaggtctttgttttccatttattgtatcgtgtttttgattcaaatggccaatgcgatgtttcgtccgtgttccatggcgtatgtgacgatgcttattccggctgaaaggagaaaacgattcaattcactaagggctttgtcggaatcaggggcttttctcctcgggccggctgcggccgggctgctttttatcgccggcacgccgatttttgcgatttgggtgaatgcgggggctttagtgctgtccggtttcatcacgatgatgctgccgagccttgaaattgagcctcacgtacattctcccagacagaagctttctttggcagtgtgcaaagaagattggaagctcgtctatcgcttcagccgaacggcgcgaaacgtcatgatcatttattttttattcagtctggtcatgaccgttatgccatccgcgcttgattcgcttgaagccgctttttcaaaagaagttcttcagctgactgatgccgattacggttttctcgtcagtgtctcaggggcaggcattattgcgggggcgcttgtcaatgtaatcttaaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatattggtaacggcggttttcggagcggcggctgtcagttcttccgtccgcgtcatcgccatcgcaggggctgctgttatgctggcgttggcagccgttttatgctcgttcttatttgcggcttcaaaaaggaggactcccgatgtgtttcaagcggatcaatttaaagaaacataaagagacggccgtttcatttcgtgaggatgagtatctcaggtggctgtcatcccaaatctaatgctcacccgacaattttaagctgcttcttcataacgggcagccgatcggacagcttgaagcttccatcaacttttaccgcagccaaaaaatcggttatgtgcacctttactgagcagcaaagagaacgcggaacgaagctgcatcaatttagaattaaacggaaaagttctcagaatgagaggagccgtaccgccggaatagggagcggtacgcgcttcattttttcgttgtttttaaaaggccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcgtatgttactcagcccgcagacggtattcatggcaagcgacggtataatcggaatgagccgcccgaaaagcaccgccgtaaacgcgtgctgatgaaatgaaccttcatattgagccgcggccgggtaagccaccagtttttttctggcccagtctctgaatccgtaccggacgagaaaaaacaatgccattgttccgagcattgcgcctgacaatgtaatccacactccgtttacaatcccgaaaaccgctccgtttaaggccgcgataatggcgaatggaacgatcggaaaaaatacgtcagctgcgaccagaaggatactcataagcacggcgtacatgccgcccgcgcgaatcatgctgagccagacgtctttttgcataaagccgatcatcacgacagcaatgatgacggcaagactgaatcccttttttatcatctgtacgttcacctcttttcaattagtatacagcacaaatctatctccttctattaaaataagctgtccgataagcgtacttgtttatcagcatttgccgtttgatgagaaacgactggcagccgggtttggacaaaaacaggcgggaagcgggtgatgtgcatcatttgatgcagagaatgattttatacaaaaggggacacgttaacagtagtgtttactggaggtgtaaacgttgagatgctttcatctgatcatcatgatatgcgtcctcacgggtctcactgccgtgtccgccgatgcgaaatctttaaaaagaagtgacatggagaagacgggaaacgtgtactgggatataaggtctgaaaaaaagaagctatctttaaccttcgatgacggcccccatcctgtctatacggaggctgtgttagacgtgctgaaacagcacaatgttaaagcaacctttttttgtatcgggagccgtatagacaaataccccgtaacggcaaaacgcatcgttgaagaagggcatgaaatcggcaaccatacgatgaaccatgtttattttcaccgtttaaaacgcaaagacattttacaagagcttcacagctccgcgcatcatatcagatcgctgcagccggaaggggacaagttattccgcccgccgggagggtcgctgaatcatacggctttcaaaagcctcttaaaagagggctatcatatcatcatgtggtcatggaaccaagatccgagggactggaaaaggcccggaaaaggaaaaatcgtcaggcacgttgtttcacatgccagagatggagatatcgttcttctgcatgacggcggaggaaaccggcgccagacggttgaggctttgaaagaaatcattccccagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataacctgtctgttatcaggatgcgctgcgggcaaagagaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgctttcaaagcgacgtgctggagcgtaagccccaatatttatttatcatgttcggaacaaatgatgcgggcattttgacgggagatcagccgcgagtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaacatggcataattcctataacggcgttacgaggcaggttgcagctgagttgaaagtgccgctggtggataactggaaacactttatacgcgcggacggaggcaaagatacagaccgggcgctgatccaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatcttttggaggcgattgctatgaaccgcggtttccctccgcaatatcctgtatgcccgcctcctcgggtgaatgcggggtactggtacgcattttttgttgtgctgctcgtcgtcattctcgttctgggcggtctgtattggttcaatatatagcagccgtcctcttaaacacctctattttaggggtgttttttgttgaaagtggtagtaatgcgcataaccgaagtgatataatatcagtcatctgagtaaaaaaaggaaattcgcccgggaattttttctgtttaagaagaaacggaaataatgtgtccgagcgatcttcttttgatttcgttttcaattaactcgataaattcacggctcaaattcatttcattggctttgaaataagattctattagtaattcatcagagagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacttgttagtatcttgtttataatctggataaatccggatgtaataagagtggataatgtgtgtaattttatccacaactggtgaagaaacccaatttttgtcgaaatttttttaccgagtccgactttgtttttaaatctgacaggtttcgacatatagatgatagaaagaaaaggaagggtgcgggttttgttaaaaaagttttttttacctgacgaatttgtgaaaaatatatttcatatcacaccggaaaagctcaaggaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatggggcgcgcctttaaaagagccgtcagcagcatggagctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattaggaatggaaaaggttgtttgcatcggctgcggagtaacgatccagaccgaggataaacaaggtctcggatacgcgccaaaggcatcgctcacgaaggagaatgtcatttgtcagcgctgcttcagactgaaaaattacaatgaaattcaagatgtttcattaacggatgatgactttttaaatatcttgcacacaatcggcgatactgactctctaattgtcaaagtcgttgatatttttgattttaacggaagctggataaacgggctgaaccgctttgtcggcggtaatccgatcattcttgtcggtaataaggccgatatcctgccgaaatccgtaaagcgggaacggctcgtccaatggatgaaacgcgaagcgaaagaatacggcttaaaaccccttgatgtctttttaatcagcgcttcccgcggacaagggatgaaggaagtcattgacgccattgaacattaccgcgaagggcgcgatgtgtatgtggtggggtgtaccaatgtcggcaaatccacatttatcaaccggattattaaagaggtctcaggggaagagaatattattaccacctctcaatttccgggcacgacgcttgatgcgattgaaatcccgcttgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtatgctatatgccgaatgaattgatgattcacagaacaaagcttgaaaatgctgatgccttatacgaaaagcatgcgggagaactgcttaccccgcccggaaaagatcatttggatgaatttccggagcttacggcccacacgtttacgattaaagaaggaaagacggatatcgttttttccggactcggctgggtcacggtgcagcaagcagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcatcatctcaaggacgccgttaacggaatcaaggcgcttggcatctgcggagtgaacgtcacagtcccgcataaagtcgcgatcatggagcatctggatgaaatacatgaaagcgcgaaagtactcggggccgtaaataccgtcaaaagagagggagacaggctcatcgggtataatactgacggagatgggttttataaatccttagtcaaagtattggacaaaccgatatcagagctctccatcctcatgattggggcgggaggggcggcaagagcgatttttacgacgatcgtccgcagagagccgaaacaatttgacgtttgcaaccgcacgccggaaaaagcggaaagtctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggctgcactgtctttcaagctgtggacggaacaagagcctgacagcggcttaatgagagcaattgttgaaggaaaactaggaggaacacaatgttaacaggaaaacaaaaacggtttttgcgttcaaaggcgcatcatttaacgcctatttttcaagtgggaaaaggcggagtcaacgaaaacatggtgaaacagattgcagaggctttagaagcaagagagctgattaaagtcagcgtgcttcaaaactgcgaagacgataaaaacgatgtcgcagaagcgcttgtgaaaggcagccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatcccgccgcataagcagaatgaagactttacagacagccggcaccgggtggagatgctgaagcttgccatcagctctaattccttctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaattggacgaactgctcacgctcattcaatttatcggagtgcggcgcccggggtatcatatcgagaccccgtaccctctgctttttgccgacgttccggaatttgacgtttcgtcaacgatgcttagagaacgtctcaaagcaaaaaagccgacgcaatacttaatgccggataaagtgaggcagtatatagaggagaatgatttatatgaatcgtgaggaagcacttgcctgcgtcaaagaacagctgaccgagcatcgctacatccacacaatcggcgtgacagatacggcggttattctcgcaggccgattcggagcagatccgaaaaaagcggaaatggcggctatttttcatgattatgcgaaattccggccgaaagaagaaatgaagcagatcatcgtgcggaaaaaaatgccggctgagctcttggattacaatgccgagctgtggcatgcccctgtgggagcgtatttggctgagaaagaagcggggatcactgatcccgagatcttggatgcaatccgctatcacacgtcagggcgtcccggaatgacccttttagacaaagtcatctacgttgcggattacattgaacccggccgccagtttcccggagtggaagaggtgcgccgtctggcggaaacagatctgaacgaagcgctcatacaagcgatgaaaaatacaatgatatttctgatgaaaaaaaaccagccggtctttccggagacgtttgcaacctataactggctggtgtctcaaaaacgacaggaggaatatggaaaatgaatcaagcttccgtattaaaaatcgcggcaaaagcatgcgacgataaacgtgcagaagatattttagcgctggacatggaaggaatctcacttgtagcggattactttttaatctgccacgggaattctgataaacaggttcaggccattgcgcgcgaaattaaagatcaggcagaagaaaacggcattgatgtcaaaaagatggaagggtttgatgaggcccgctgggttttagttgatctcggcgacgtcattgtccacgttttccataaagatgaaagaagctactataatcttgaaaagctatggggcgacgcgccgctcgcagagcttgaactcggcttgaactcatgatctaccaaggcttcgccggtgtatatgacgagttaatgtcccatgcgccgtatgatgaatgggcgggctggatcgaagcgtctcttccggaaaagggaagggtgcttgatcttgcctgcggaaccggagaaatatccatcaggcttgctgaaaaaggctgcgaagtcacggggattgatttgagtgaagatatgctgagctgtgcccagcagaaaaaaacaggaaagccgattctttttctccagcaggatatgagagagctttccggttttgaagaacagtttgatgccgtagtcatctgctgtgattccctaaattacttaaaaacgaaaaatgatgtcttaagcaccttcaaaagtgtttttcaagttttgaaggagggcggcctgcttctgtttgacgtccattccccgtataaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgctatgacgagacgcatgagcaaaaaacattttacattgaagaatataaacaaatgcttgcagagaccggatttgaattgaagaaagtgacggctgattttacagaccggcctccttcaacagagtctgaacgtcttttctttacggcaggcaaaccaaaaaccatcgtttaaacggaacgatggtttttaaaatgcattttttgcgattggcgcgataaagctctttatggcatactcagttacacgtgaaattgcttcttcactaacgatatatcttcatcgtatttgtcatgtgtacgctgaaagacacgattgaacatatcctgaacaccgctttcgagagccttcagtccttctccggtgacgccgccttttacgcatactttttcctgcaaggcgggaagcgtgtaatgccccgtttcaagaagctttccgagaccgacaagcatttctgtcgacataatcacggcttcttctttggtgatgtccgtttcttccactgccgcgtcaataaagcgctgaacgagataactcataaaagcgggcccgcagctgacaatgtctgacgccgctcttgtaatgccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggagattaaaatgtgatctttccgtaaatgcggtgtgagttttttcagcaaaggatatatatccagcggttttacacaaatgaatatgatttcattatcctgtacgagcttttcctgatcctcggtgacgtggatgccgctgaaacgttcttttagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggatgcggcggaacctgaaaattctgggcgcttgtcttgcggcaggggcagtttttatctgtatttggctgtttcgttctgaaaaggaagagccggtcaaacagcagtccgtgctcggtcaaacagcctccgcatccgtcgcggacaaaaaagacaccgcagacgataagattatgattgatgtgaaaggagcggtccgaaatcccggcgtgtatgaaatgaaagcgggagacagagtgacgcaagccattgaaaaagccggcggcctgaagaaaaaggcggatgaattgaatgttaatttagcagagcagctgcaggacgggacgattgtttatattccgagtgaaggcgaagaggggaatcatccgaaaacagcagttggtgaaaaggagaatgcagctgtcaatatcaatacggcatctctggacgaacttcaggcgatttccggggtggggcagaaaaaagcggaagccattatcgcctaccgagaagaaaacggacggtttcagactgctgaagatttgatgaatgtatcaggctttggagaaaagtcatttgagcggataaaaacttccattacggtaaagtgaattgacggttctgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagataagcggatgattgccggcggatacaacggctcaatcgccggcggcgtccattgcgctgatgaaggatgccttttaatagataatcattgccagaggaccatacatgcagagatgaatgcgattctgcaatgttctaagttcggtgttccgacggagggcgccgaaatttatgtgacacattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgaaatgatcatcgatctgaaaaaccgcgaaaaattgtcttttgtagcaggtctgattcagcaattatctgatgcgggagttaaggcagatgaactgaaaaaaattcatgaacaggccaatgagctgtttaccagttacgtataaatgaaatataaataccttcttctgcctctggcggcggtttctgcaactgcgggaattgccgccgctcatgtcttctgggttctgctcctttttcttctgtatcttctctttattatgataaaaacaaagcagcctgctccggttgttgtctgcctcgtttctttttgtgtttatttctttctttatacggtttgtgacgctgcgaatgtaacgcggtatcaggccggcagttatactgaacaggccgtcatcactaatattccgaaggttgacggagcgaaaatgtcagccgttatccgtacacatgacaaggaaaaatgggcggcttcgtacaaaatccggtctcttgaggaaaagagactcattgaacagcttgaaccggggatgcgctgcacgtttacaggctctctggaacagcctgcacatgcgacgattcccgggggttttgattataaggaatatctttactctcagcagattcactggttatttaccgtgacttctattcagcagtgtgaaaaatccaaacagccgctgtttaaactgctgagcatcagaaaaaatttgatttcgatcattcggaatcacgtgcctgaatcttccgccggaattgttgaagcgctgaccttaggtgaaagattttctatagaagacgatatactgagtgcatatcaaaatttgggagtcgttcatttaatggcgatttccggaatgcatgtcggtcttataacggcgggactattttatgctctgatcagaatcgggctgacaagagaaaaggcggggatattgctgctgctgtttttaccggtgtatacgctgctgagcggtgccgccccatccgtattgcgcgcatccctcatgctgggattttatatcgccggaactcttgttaaacgcggcattcattcctctgctgcattgtctctgtcttatctgctgctcctgctgtttaatccttacctcctttggcaggcgggcttccagctttcctttgcggtaagcgcctctttaattctgtcatcctccattttaaagaaagcagggaaaagcagacttgccgggcttgcgatggcctcattcatcgcagagctcagctcacttccgtttcttctctatcattttcagcaaatttcacttgccagttttccgatgaatatggtgatggtgccattttatacgttatttgtcattccggtttctgtcatcggtttccttcttcttttactttcaaggcagatgggagaatgtttgtttgatatgtttgaccttgtgatgaagcctgtgcatgatttcattacatatgcggcatccgttgatttatttactatgattgtgttaaagcctgactttctttcccttcttctgcttgcggtttccgtttttacgctttttgcggctttagaaaagggaggttttttaaaactcaggaaatcggctctttttttctgcgcggttttggcttatttaatatgccgtccgtatttcagcccatggggagaagcggatatgcttgatatcgggcagggagactcgctgtttataagcgcgccgcaccgcaaagggaccgtaatggttgatacagggggagtgattgcttatcccggagaatcatggaaagaaaaacgccacccgtattctatcggcgagaaggttttgattcagtttttaaacggaaaaggggtgaaaaagctggatgcgctgattttaacccatgcggatcaggatcacatcggggaagccggagtgttaatcaaaaatcatagagtcaaacggttaattgtccccgtgggattcgtaaaagaaccgaaggatcagaacatattaaatatggcgaaagaaaacaacattcccgttgccgaagcaaagcggggcgacaccattacagccggtgatcttcagtttcaggtgctgtctccggagtcgtctgacggaaagagtaaaaatgattcgtcactggtgctttggacggttttaggcggagtgagctggcttttgacgggagatttagaatcggacggcgaaacagaagtgctgaaaacgtatccgaaactgaaggctgatatattgaaggcgggtcatcacggcagcaaaagctcaacgagtgaagcctttttgaaacagcttcagccggaagcagcgctgatttcagcaggaaaagagaatcgataccatcatccgcacgaagaagtgctggatcgtttgaaggcgtactctgtcaatgtgcttcgcaccgatatcagcggaacgattcaatacagatttgaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtcctttttaaagcttcctctttactatttgccgaactcaatttaggatagaaggggatcaagaaagagaggaagtcatacgatcatggtatttgatgtttggaaagccctgaaaaaaggggatgtccgctccgtttattgcttatacggaaaagaaacgtatctgctccaagagactgtcagccggatcagacaagctgtcgttgatgaggagactaaagattttaacctgtctgtttttgatcttgaagaggatccgcttgaccaggccataaccgatgcggaaacgtttccgtttatgggagagaagcggctggttatcgtaaaaaatccgtcttttttaacaggggaaaaaaagaaagaaaaaatagagcataatacaagcgctttggagacttacctgaaggagcctgcgccttatacggtctttgtgattgtggctccgtatgaaaagctggacgaacggaaaaagctgacgaaagcgctgaagcaaaaagcccttatgattgaagctaaggagctgaatgcaaaggagacgactgattttacgattaatctggcgaaatccgaaaataaaacgatggatacagaagctgccgagcatttggttctgcttgcaaacggccatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacaaagtattttgcgggacaaggatacggccaaaagcaaatcgcttccaacttaaaggtgcaccccttccgggtaaagctggcgatggatcaggcgaggctattttctgaagaagagctgcggcgtattatagaaaggctcgcagtaatggattatgaaatgaaaacggggaaaaaggacaagcagctcttgctggagctctttctccttgagcttctccggactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggcaacactatgtaccacgatgattgaaggaggtctttcctgtgaaaaacaacgaactggatgtcaatcaatttctgatacggacggatttagcggtagaaacgaaacaggcggtaaaagacggacaagccggtcagacaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggggttcgggaacacgactctgacatgcaggaaaaagtaacggaagtgtttgccgaggaattttccgcctatctgtcggcattaaagattccaaaggatgcaagctgtttgatcgtcggtctcggcaactggaatgtgacgccggatgcgctcggccctctcgtgaccgaaaaccttcttgtgacaaggcatctgttcaggcttcagccggaaaacgtgcaggaagggtacaggccggtaagcgcgctcgctcccggtgtgatgggattaacgggaattgaaacgagcgatattattcaaggtgtgatcaaagaatcaaagccggattttgtgattgcggtagacgctcttgcggcaagagccgttgaaagggtgaacacgaccatccaattttctgatacgggcattcacccgggatcaggcgtcggcaataaaagaaaagaattaagcaagaaaacgctcggcatccccgtcatcgcaatcggggtaccgactgtcgttgatgcggttacgatcgcgagcgatacggtggattatatattaaagcatttcggcagagagatgaaagatgacagcccgtcaagatctctggtgcccgccggaatgaacttcggcaaaaagaaggtgctgacagacgaagaccttcccggagaaaaagaacgtcaatcctttctcggtattgtcggcacactggacgaaaacgaaaaacgccagctgattcacgaagtgctctctccgctcggccataatctgatggtcacaccgaaggagattgacacctttattgatgatatggcgaacgtgcttgcaaacgggttaaacaccgcccttcatgaaaaagtgtcacaagataacaaaggttcttataatcattaaaatggttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcggattctcttcacggaattgccggagaacttccgggtgacgcgtttgcacacctcctcggtatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggactgattatacgaatatgcctgctgaatccccgccgccgtcaaaggtgatggaaaaagaaaaagaagtgaacctggcagaaatcgaaaacaaaacgaaaaaagaagaaaaggcgccgccgaaacattcaacaggcagcaaaaaagtcgtttttatttaccacactcataataccgaatcctatcttcctctgttaaaaggggaaacaaatccggataacgcccgccattcgaaggccaatgtcacgcttgtcggagatatgttcggaaaagcgcttgaagcgcaaggtgtaggagcgaccgtagataaaaccgacattcaggcccgcctgaacaaagacggcttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagggtcgccatcgtcgtcggcaaaaaaagcgctaattttgaagaaaactataaactcgcaagtgaacttcataagctgatggagaaaaaatacccaggcttaagcgtcggtgttttatcaaaaggctctccgggagataatggagtgtacaaccaggatttaaacgaccggtcgcttctgctggaattcgggggcgtggataacaatctagaagaactgaggcgcgcatcagatgccgtggccgatgtgttcagcgaactgtactgggatgcagacaaggtcagctcgcaatcaggagagaagaaaaaacaatagaaatcaggtgattcgaatgatccgttttaccggcaaatgcctgctgatcgccattgtcatgtttttcggcgttttgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcggaaaccttcaacctgttttcaaaagcgggagaaaccctttcaaataccgtgacggactcggcgcaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatattccatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatcttccgagcgcagagccagaacgtgtgcgtcaagaggttgaggacgttatcggccttgacgcttcagacgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaagctctggaaaaacttgaattgaacgattcatctcttcaatacgaggcggagacgtcacaagccctcggcttcggtttccgctgcggttttttaggaatgcttcacatggaaatcattcaagagcggattgaacgggaatttaaaattgaccttattacgaccgcgccgagcgttatttatgacgtttatatgacggacggcgaaaagatcatcgtggataatccgtcaaacatgcctgatccgcaaaaaatagagcgggtggaagaaccttatgtcaaagcgacgatgatggttccgaacgattacgtcggagcggttatggagctttgtcaggggaaacggggcaactttatcgatatgcagtacttagacgccaaccgggtcagcattgtatatgagatgcctcttgcggaaatcgtatatgaattttttgatcagctgaaatccagcacgaaagggtacgcctctttcgattacgagctgatcggctacaaaccgtccaaactcgtcaaaatggacattatgctgaatgcagaaaaaattgatgcgctgtcgtttatcgtgcaccgcgattacgcatacgagcgcgggaaagtcatcgtcgaaaaattgaaagaattgatcccccgccagcaattcgaagtgcccgtgcaggcagcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcggtagaagtgccgcaggaagcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgatgagtacttaaactcactcgaaaaggaaatgataaatacaatagaacggacgggacgccctgatctccgcacgatttttatcgggggaggcacgccgacatcgctctcacccgcccagctggaaaaattgatggattccattcaccgcgtgctgaagccttctgacggactcatagaatttgccgcggaagcgaatccggatgatttgtccccggaaaaattaaaaatcatgaaaaatgccggtgtcaaccggctgagcttcggtgttcaaacctttgaagatgagcttttacaaaaaatcggcagagtgcataaacaaaaggacgtattcacttcctttgaacgtgcgagggctctcggctttgacaacatcagtctcgatttgatgttcggcctgccgggtcagacgctggccgatcttgacaattccgtcaaaacggctttgtctcttgatgcggagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccgtcaatatgaaatcagcaactttgcaaagcccggatacgagtcgcagcataatctgacgtattggagcaatgaagcgtatttcggttttggcgcaggcgctcacgggtatatcagcggcacgcgcaccgtcaacgccgggcctgtgaaacattacattcagctcatcgaagaaaaggggctgccttaccgtgacacgcacgaggtgacacgggaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatctgtgacacggaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacagatattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgttccgatccagccggataaggcggtcgccatcctcgtcacgaacacggggcatgtcgaaaaccgcaccatcaatttcccggctaaagtggatttggccgatattgaaaaactggtcaatatattaaacgatcgattagcgggcgtgccgatggacgaactgaatgagcgcattttcaaagaggttgtcacatatttaaggcagcatatcgccaactatgacagcatacttgaatcgctccgctccacattccatccggcggcccacgttgagaaattgtttttcggcggaaagatcaacatgctgaatcagccggagtttcacgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatactgttgatacgaagcagatcggatcaatcgccatcatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggtcgaagcagcagaacaagaagaagtgacagaacaggcagaacaagcggcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggctctcgacaactttgaacgggcgttacaggtagaagctgaaagcgagcagacaaaaagcttgctgcaaggtatggaaatggtccgccgccagctgatggacgcacttgaaaaagaaggcgttgaagccatcgaagctgtcggtcaggaatttgatccgaaccttcaccaagccgtcatgcaggtggaggatgaaaacttcggcagcaatattgttatcgaagaactgcaaaaaggctacaaactgaaggatcgcgtcatccgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcgaaacgccaatcaatcacaaatcctaacacaatcatgtctgtcaaacgccatatgggtactgactataaagtggaaatcgaaggaaaagattacacgcctcaagaagtgtcagctattatccttcagcatctgaaagcatacgctgaaagctacctcggcgaaacagtttcaaaagctgttatcacggttcctgcatacttcaacgatgcagagcgccaagcgacaaaagatgccggtaaaatcgccggtcttgaagtagagcgtattatcaacgaaccgactgcagcagcgcttgcatacggacttgataaaacagacgaagaccaaacgattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtatcatctacacaaatttctttaccgtttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggatcaacacgtatacctgccgtacaggaagcaatcaaaaaagaaacgggtaaagaagcgcataaaggcgtaaaccctgatgaagttgtagcactgggtgcagcgattcaaggcggcgtcatcacgggagacgtaaaagacgttgttcttcttgacgttacaccgctttctctcggtattgaaacaatgggcggcgtgttcacgaaactgatcgaccgcaacacgacaattccgacgagcaagtctcaagtattctcaactgcagctgacaaccaaacggctgttgacattcacgtgcttcaaggtgagcgcccgatgtctgcggacaacaaaacgctcggccgcttccagcttactgatatcccgcctgcaccgcgcggcgtaccgcaaatcgaagtttctttcgatattgacaaaaacggtatcgtaaacgtaagagcgaaagacttaggcacaggaaaagaacaaaacattacaatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaaaacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttatgaagaagcggcaaaagcgcagcaggctgaaggcgcagcaaacgctgaaggcaaaaaagcggacgacaacgttgtcgatgcggaatacgaagaagtaaaagacgacgaaacgaaaaaataagttctttcccgcatggctataggcggaagaacacacagcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatattctcaagcatcttcggaggcggcacgagacgccgtgacccgaatgcgccgcggcaaggcgcggatctgcagtatacaatgaccctgtcatttgaagacgcggctttcggaaaagaaacgatcattgaaattccgcgcgaagagaattgcgaaacatgtaaaggatcgggcgcaaagccgggaacaaagccggatacgtgctcgcactgcggaggttcaggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggtcaaggtgaacctggcgtaaacggagggcctgcgggagatctgtttgtcgtattccatgtgcgcgcccacgagttctttgaacgcgacggagacgatatttattgcgaaatgccgttaacgtttgcccaagcggcactcggagacgaagtggaagtgccgacgcttcacggaaaagtgaaattgaaaatacctgccggcacacaaaccggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgatcaacagtttcctcggcgaaacggtggacggcattaaagagacgattaataatctgcttttgtacgacattgatttaggcagaaacacaatcaccatttctgaagttaatgaagaagaatgggcgacagcttggaaaaagtattatcatccggtgaaaatttctgaaaaattcacgatcgtacccacatgggaaacgtacacacccgtgaataccgatgaactgattatcgaaatggatccgggcatggcattcggtacgggaacgcatccgacaaccgttctgtgcattcaggcgcttgagcgtatcgttcaaaaaggcgaccgtgtcattgatgtcggcaccggttcaggaattttaagcatcgcggccgccatgcttgaggccgaatcggttcatgcgtatgaccttgatccggtcgctgttgaaagcgcgcgtctgaatctaaaattgaacaaagtgagtgatacggccgaagtgaagcagaacaatttgttagacggcatcacgggcgaacatgatgtcattgtcgcaaatattctggcggaagtgattctccgctttacatcacaggcgtacgacctgctcaaagacggaggccattttattacttcaggcattatcggccagaaaaaacaggaagtaaaagaagcgttggaaaaagccggctttaccatcacagaaattctgtctatggaagattgggtcagcatcatcgcgaaaaaataacagttagtaggtgtcacagcgtatgcaacgatattttatcgagctcacgaagcaggagatggacgaaactcccgattttcaaattacgggggaagacgtccaccatatagcgaacgtcatgagaatgagtgcgggagaccggataatctgctgttcgaaagacggccatgaagcgttatgcctgctcaaagcggtttctaaagatcatatatcatgcagcattgctgaatggacgggtgaaaaccgtgaactgccgttaaaaatcaggattgccagcggccttccgaaaggcgataagcttgaatggattatccaaaaagggaccgagctgggggctagtatgttcatcccctttcagggcgccagatccgtcgttaagctagacgacaaaaaggcaaaaaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgccgcggagcttaaaagccttccgcaaggttcgtctctattaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaatcattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgccagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatactggcggctacggcgaagatatgaaagattataatttcgccaagcttctccgcgagcttgatacacgtgtagaaggactgaagcggatcagaatttcatctattgaagcaagccaaatcactgatgaagtgattgaagtgctggatgcgtctgataaaatcgtccgccaccttcatatcccgattcagtcaggatcaaacaccgttctgaaacggatgagacgcaaatatacgatggaatttttcgcggaccgtttaaataagctgaaagaagcgctgccgggtcttgccgtcacatctgatgtcatcgtcggtttcccgggtgaaacggaagaagaatttatggaaacataccggttcattaaagaacataagttttcagagcttcacgtattcccttacagcaaacgcaccggaacacctgcggccagaatggaagaccaggttgacgaaaacgtgaaaaacgaacgggtgcataagctgattgcgctgtctgaccagcttgcaaaagaatacgcctccgattatgaaggggaggttctggaaatcattccggaagaggcgtttaaagagtctgatgaggacggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccgaaacatgcgcatgtcttcataacagataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaatacctgctgatgcggacaggaagggaaagacgagcagcacgccgagaatattaaacactacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcataccgataaaaagagcggaccagctcgaatcattcacatggcgcaaaacctccgcccccgccttcatttctgtcagcggaacggcaagccggctgaagcatgtgatgcaaaaaaagatgatgccgagaccgaggaagcttataccgatctgcctgaacggatatttacggatgaggataaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggcttttctcaatttttgaatacgttaatgcgatcaggccctgcctgagcaggctcattccgagtaaaaaaaccaggataagtgcggtaaagagaatcagtattatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctgatcgtttagatttagtagataaagttcaaaaagagctggacattttagaaatttatttaccaaagcagctttctgaagaagagctgcagacaattgtaaatgaaaccatcgctgaagtcggtgcgagctccaaagcggacatgggcaaagtgatgagtgctattatgcctaaagtaaaaggtaaagctgacggcagcgtaattaacagacttgtcagcagtcaattatcttaattgacaagaaaaaagacatctttcctagagagatgtctttttttatacataaaaaaatgaaactaaagtacatttgttacgtatataaagaagaacgaaacgggaaggagggtatatttgccttgttccgaaaaaaaaccggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgtgcggatgtgcctgttaccgcttacgttaataaacgggcgctttctgccggagcgtatatagcgcttcaggcagatgaaatctatatggcgccgggcggaaaaatgggtgccgcagccatcatcgacggaaaaggaaacgcggcggacaaaaaggctcaatcactgtggcatgcagaaatggaggacgcagcggttaaaaacaaccgaaatccgaaatacgccctggccatggcagatcccgccatcaatgcaaaggaagcgggcgccccaaagggaaaactgctgacactgacagctgaaaaagccaaggaagtcggatattcggagggcacggtttcagacctcgatgctttatatacaaagatcggttttgacagagcggatgttcaccatgcaaaagaaggttttgtcggcaaattgggcagatggctgacaaatccgtttgttgtccccgtcttattaacgcttgctttgcttggtttgaccattgaattgttctcgccgggcctcggaataccgggtgccgtcggactgacggccatgctgctgtttttcaccgggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtaatggcggtttctctcttgatcgccattgctgtgtctattacagcctttatcatattaacaagggtgttggggaaacgaatgaaattctttaaaaaattaatattaactgattcaacaagcacagagagcggttatgtttcaaatcagaaccggacggagctgttgggaaaagtcggcattaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcaatagttgcagctgccataatcgtgttagccatattcttcacctttgtaccggtgatgctatggatttcggcgcttgcggcaggagtcagaatcagcattttcactttggtcggaatgaggctgcggcgcgtcataccaagccgcgttgtcaatccgttaattaaagcgcacaaagccggcctatccgcaacaacaaatcagctcgaaagccattatctggccggtggtaatgttgacagggtggtcaatgccctgattgcggcacagcgcgccaatattgagctgacatttgaacgctgcgcagccattgacctggccgggcgtgacgtattggaagccgtacagatgagcgtcaatccgaaggtcattgaaacaccgtttatcgcgggtgtcgccatggacggaattgaagtaaaagcaaaagccagaatcaccgtaagagccaatatcgagcgccttgtcggaggagcgggagaagagacggttgtcgcccgtgtcggagaagggattgtctcgacaatcggttcctcgggtaatcataaaaaagtgcttgaaaaccctgatatgatttcgcagaccgtacttggcaaagggctggattcaggcaccgcctttgaaattctttcgattgacatcgccgacgttgatatcggcaaaaacatcggagcgattcttcaaacggatcaagcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgctgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacggccgccgggtacacgccccgaaaatcaggcaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggcttgaacataagctgacatctcaacgcgcacgaaacgcgtctctgaagaaatcagccctcaaaataaataaagaaactgcggttcaaggcattatattcagtgaggttttgggtccgccccgtgcaaaaaaaccgcaccggaccatgcggagcatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcggattacgatggtcggcagacttcatatctacatagagaatcacagaggcctcctgctgttcagcgaagaagaagtcaggctgatgctcaagcaggggcaatgtatcatatcaggaaaaaacttggtcattaaggcaatccttcctgaagaaattcttttggaaggcacgatagatcacgtacgatatgtcgattcataaagccggggggaaataatgtgaaaaacaaatggctgtcatttttttcgggtaaagtccaaatggaagtcaaaggaaaagggattgaacggctgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaacctgggcttcactgcgggatttgtgatgtttttcgttatattgtttcttttgtccaacatgatttgggacattgatattaaaggggccaagcccgaaaccgagcatcagatggtaaagcaccttgaagaaatcggtgtgaaaaaaggacgtttgcaatttttaatgatgacgccggagaaaattcaaaaatcattaacaaacggcattgataatattacgtgggtcggtgtggaattgaacgggacagcccttcatatgaaagtggtcgaaaaaaacgaaccgacaaaagaaaagtacgtgagcccccgccatatcgttgccaaaaagaaggcggttatcaaaaggatgttcgtgcaaaaggggcagccgatggcttttgtgaacgatcatgttgacaaaggacagcttctcgtctcaggactgatcggaaatgaagaccggaaagtcgcctcaaaagcggaaatttacggagaaacatggtacaagtcagaagtaaccgtgcctcttgaaacatcatttacgctatatacgggtaaagtaaggacgaagcacaagctgtctttcggatcatggggcgtgcctttttggggctttgaatttaatgaggagccgctgaaacatccgaaaacagaggaagaaaagcacccgtttcaatttctggggatgaagcttccgatttcttacgttcaagaacagacaagagaaagtgaaacaaccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcctttttacatttaatggagaaggatctgggcattagcctcatcacgcgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccctcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggctttctgcccggagatttaaaggaaaaagtagatccttatctgcgcccgctgtatgacgcgctccatgatgtgctcggaagcgaccatacggagcgtcttatggaaagaggggttattgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggatatgctgaaggacataaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaaggaaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgttttcagtcagtgataagacgatttacgcgcccgccacagtggaagatcagcaggcgacggaatcgaaaaaacaggcggccgaagatgcggtggaagatcaatacaccctgaaaaaaggctataccgacaaccggcttgacctgatcacttccatttttgacagcatcggcgaagtgaaaaaagatgcggaaaaagacaaaaagtcaccttcggaaaaatcattggtcaaatcggtgaaaaacaagctgacacaggatgtcaatgaatccgtctcggaagatgccattaaatcgcttctccatgcaaacaatgaagatttctcatttgtgagggattccgtcattaccgcggtgaatacggtgatgagcagtgaaattccttctgaaaagcttgccgaagcgaaggataaggtcgcaaaagagctgaaaagcgcttctgtgccgtcaaaatatttagcggctgcgactgaaatcggaaaatacgcggtcattccgaattacgtatttgatccgaaagcgacggatgaaaaacgccaggaagcgtcagacagcgtccagccggtacagatcaaacagggacaggttctcgtggaagagaatgacctgatcgaccgggaagtatacaggaagcttgaactgacggggcttttgaataattccaacctgttaaagccgatcagcggtctgcttctgatgatcgggctgtttatcgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttaggaagcatcattctggcgatctgcggcagtatgatgtttaatcagggtgtgacgggaacatttaattacgtcatcggcatttactatttaatcagcagcatttcaggcattctgtttttggggaaacataatgcgagatcaaaaatattgcaggcgggactgttcgtctcatttattaatatgattatcgtgctgtcgcttttattaatacaaaatacggcgctgtcacctgttgaaatcggaacgctgatgctgatgggggtcgtctcgggacttgcttcatccgttttgattatcggtctgatgccgttttttgagacgggattcggcattctttcaacgatgaggctgattgaactgtctaatccgaatcatcccctacttcgaaagattttaacggaaacacccggtacatatcatcacagcgtcatggtggcaaatctgtcggaagcggcttgtgaagccgtaggggcaaacggtcttttagcacgggtcggagcgtattatcacgatctcggcaaaacgaaacgtccgcaatattttattgaaaatcagatgaatatggataatccgcatgacaagctgtctcctcagctcagcaaaaatatcattattgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgccaaaacgctatgtgcgactttaaaaggaattttccactcccggattgaatatccggaggctacgaagaaggtgaaataaatgggtttactcatagatattgttgatgaaacgaacagcgtctcagctgatgcgctccaagaagtggagaagctgctccaattcgcggcggaaaaagaaggcgttcaggatcaggctgaagtatcggtcacgattgtgacaaatgaagaaatcagagaaatcaacagagactaccggggaaaagacactccgactgacgtcatttcgtttgcgcttgaagaagaaggcgaagacgaggtggaaatcgtaggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttactgatcagtatcacccgctcgcaaaagcggcaaaggacgcggccgccggagccgtttgcgtctttgccgtgatatcgtgtatcattggtttactcatcttcctgccgaagatatgttagcagaagattcttacaattattttacattgccaaaaatgggcgtgaaaaaccgatcataattatgtaaaataaaagtgacagcggtatcatacaggataaaggtaagagaggaattaagtacacatgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgagggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaaatcaggatttgtatctatcatcggaagaccgaacgtaggcaagtctacctttttaaacagggtcatcggtcaaaagatcgccatcatgagcgacaaaccccagacgacaagaaataaagtccaaggggtgctgacaaccggcacgtcgcagactatttttattgatacaccgggcattcacaaaccgaagcacaagcttggcgactttatgatgaaagtggcgcagaatacgctgaaagaagttgacttggtgttatttatgatcaacgccgaagaagggtacggaaagggcgacgagtttatcattgaaaagctcggacagacgtccacgccggtctttctgatcgtaaacaaaattgataagatccaccctgaccagctgcttcttttaattgatgagtaccgtgcgcgctatccgtttaaagaaatcgtgccgatctcagctttggaagggaacaacgtcgaaacccttctcgcgcaggttgaagcgtatttaccggaagggcctcaattctatccgagcgatcaggtgactgaccatcccgagcggttcattatttctgaactgatcagggaaaaggtgctccatctgacaagggaagaagtgccgcacagcatcgctgtcgctatcgagtccattaaagggcaggaaaacggctccgtccatgtcgccgccaccattgtagttgagcgggattctcaaaaaggcatcgtcatcgggaaaaaaggagcgcttctgaaagaagtcggcaaaagagcgcgggctgatattgaagcgctgctgggttcacgcgtttacctcgaattatgggtgaaagtgcagaaggactggcggaataaaatgtctcagctgcgtgatttcggcttcaaagaggatgaatattaattcatctaaagcgcatgcctgatgtgtgggattacctcacagaaacagggcttcgttagcaaaatttgtttaacatgaaaaggaggacatcaggtcaagataagggtaagaatttggattggcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccgttgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcacattcatcgtgcagatgaaaatgctcggcgtcatggggctgtatccggagctgaatcattgtgtccactgcaaaagcggggaagggacgtttcatttttcgataagagataacggttttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacaggtcattgatctgtattacgaggaatattcaggactttatttaaagtcaaaacggtttttagaccagatggaaagcatgaagaaccttttggatgaaaacaaaagttgacattctgcccatctttttatatgatcatttattataaaatatgttgcagtgacagaaagaagtacttgcgtccaactcatacaagcgaccttaggacagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggagccgtggagagtggcttacgttgagccgtccagacggcctgcggacggacggtacggtgaaaacccgaacaggctctatcagcatcaccaattccaagtcattattaagccgtcgcctgataacattcaagagctttaccttgattcattgcgtgcgctcggcattgacccgcttgaacatgatatccgtttcgtagaagacaactgggaaaacccgtctttaggctgtgcaggtctcggctgggaagtatggcttgacgggatggaaattactcagtttacatatttccagcaggtgggcggaattgaatgtaagccggtgtccgttgagatcacatatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggcttgtgcatccggcctatgattatgtgctgaaatgctctcacacatttaatctgcttgatgcaaaaggcgcgatctctgtgacagagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccggctggcttgctgaaaaaaatatcgcccacggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgacctgtatataaaagatgtaaacggcacggaatatgtcttcgttcaaaaattccaggcgggacaagagacgaagacacttttaccgcagctggaaaatttgattgccggaatgcattttccgaaaaacatgcgctggggcacgcaggatctgcgctatatccgtccgatcaaatggattgccgccctctttggaaaagacgtcattccgtttgaaatcacaaatgtcaagacgggccggaacacgcagggacaccgctttctcggccaagaagtatctgttgatgcgccgtcatcatacgaaaagctgctgaaagaacaaagcgtcattgctgacccgaaagaacgcaaacaaatgatccaaagccagctggatgcgcttgcggccaagaagaaatggaacattccggtcgatgaggatctgctgaacgaagtcaaccatctggtggaatatccgacggcgctttacggatcttttgaatccgagtttctttctatccctgaagaagtgcttgtgacaacaatgaaagagcatcagcgctacttcccggtaaaagatgaaaacgggaatctgcttcctcattttattacggtgcgaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaattggaaaatatcgttttccatgaagagctcggctcccttggagataaagtaagaagagcggtcaccattgcgggcaaacttgccgtccgcctgaaagcggatgaacagacgcaaaaacttgtgaagcgcgccgcagagatttctaaatttgacctggttacacatatgatctatgagttcccagagcttcaaggcgtgatgggagaaaaatatgcgcgcatgctcggtgaagatgatgccgtcgctgccgctgtcaatgagcactatatgccgagagcggccgggggagaagtgccttcaacctttatcggcgcggtcgtggcgttagctgataaactggacacgattgcttccttcttcagcattgacgtaattccgacaggttctcaggatccgtacggattgcgccgtcaggcaagcggcattgtttccattctgatcgaccgcaactggggcatttcttttaaagaactgctgtcgttgacagaaacgaaaaaagagaacgagctccttgatttctttacacagcgtctgaaatacgtcttaaacgctgaagacatccgtcatgacgttattgatgccgttctggacagcacagagcttgagccgtatgcagccgttcataaggcaagagtgcttgagaagcacctcggcacacccggctttaaagaaacggctgaatcactcggccgggttatctccatcagtaaaaaaggcgagagccgcgatatcaagccggatctgtttgaaaatgaacaggagaaaaagctgtttgacgcttatgaaaaaacaaaagacagtgtcgcggaaagctttgcctccaaaaactatgaacaggcgcttgccgtgctcagcggattaaaagagccgatcgaagattactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgaaaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgatgattatgtaatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacggggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtttgaccgccaaatatgagcccggccgcgtccggcagcttgatgaagattatttcaaaaaggtcgaggcgatcgagtttgccgtcaaatatgacgatggcagggatccaagaggcattttaaaagccgatatcatcctgctcggagtatccagaacgtctaaaaccccattatcacaatatcttgcccataagcgtctgaaagtggccaatgtgccgatcgttcctgaggtcgacccgccggaagaactgttcagcgttgatccgaaaaaatgcatcggcttaaaaatcagccctgataaactgaaccatatacgtaaagaacggttaaaatctctcggcttaaatgacaaagccatttacgccaatatcaacagaattaaagaagagctggagtattttgagaaaattgtggaccggatcggctgccaagtcgttgacgtttcgaataaagcagtcgaagaaacagcgaacatcattcatcatctcaaaacaaagggccgataactcaggacgctttatcctgggtttttgggtatgcaaatagggaataaacaaaaaggatggcatcttcgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaattcagcgttcgggttattttcgtcgcatcatttgaacactaccagatttccagaagcaaagacgagaactgggtatacgttgatcctcataaagaagcggcagatttatatatcgcaaaccatgtgcgatcgggagacgtcgtagtcacgcaggatatcggtttagcatctcttttgctgaacagaaatattgccgtcttatcggaaaggggccgttcttatactgaagacacgattgacttcgctctgatgagccgtcatatgtcaggcaaaatgaggagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggagcgggcgggaacgttttctctttcttacggcagatggaaggctattcatttacggaagctgtttctcaccttgcggataaatatcagattgatttccctgatgatataacgattcactctgcatccaggcctgaatcttccggagagcagaagatggcggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaaatgatggaaaaagcgggtctgctgatcagaagagaagacggcagcgggtattttgaccgtttcagaaacagaattatgtttcccattcatgatcaccacggagccgtggcggctttttcaggaagggcgctcggaagccagcagccgaagtatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagagcatgtgaaaattctcagaagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcaatatttccgcaaagggaaaaacttatctgacgaaggagaccggctcgcttatatgaaagaagtgctgaaagaaatcagcgctctttccgggtcgcttgagcaggaaatgtatgtgaagcagctcgcctcagaattttctctttcggtagaatctttgacggaacagctttccatctacgccagacaaaatgcccccggcgacaaaaacgccgaaccgcagacaagacgggcccgggtgacgacaaaagcgaaacggcgccgtctccgtcccgcctatgagaacgcggaaagacttctgctcgctcatatgctgagagaccgaaacgtcatcaagaaagtgattgagcgtgtcggctttgaatttaacattgacggacatcgtgcgctggcagcatacctgtacgctgtttatgaagagggtgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcagatgcggagaggcagaaagacttcgtgaaagctgcgtctctggctcaagaaattgttgcattgaaccgatcattaaagtaacaacaaatagaggcttgcgttctgattggcaatgattccttgcggaggagcaaatagatcgcttaacctcatcatgaattgtcatttattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcatatggtggaaaccatcaacaaattaatccgggtgcagcgtcagcttcttcaggatcttggcagagagcccacaccggaagagattgctgaagacatggatcttacgcctgaaaaagtccgtgaaatattaaaaattgctcaagagccagtttctttagaaacgccgatcggtgaagaagacgactcacatctcggtgattttatcgaagaccaggaagcgacatctccgtcggatcatgcggcatatgagctattaaaagaacagctggaagatgtgctggatacgttgacagatcgtgaagaaaacgtgctgcgtctccgtttcggtctggatgacggacgcacaagaactttggaagaagtcggcaaagtgtttggagtaacgagagagcgtattcgccaaattgaagcaaaagcgcttcgcaaattgagacatccgagcagaagcaaacgtctgaaggattttctcgaatagaatggaacgggtctttttgatccgttcttttttgtgtataagatatatggataatatacctttattttactggataagcatatgttttgcaaatgagttcggaaaaaatgcggcatgtcctgggagggggaaaatgagataagtttatttatattctttattgtaagcgtatacaattcattatacaatagaataaagataattttgtgataaacaaaacagttatttttgctttttgtataaattgtgaaatcaatgaaattgctgagcaagaccatttactttttgtaaaaataagttagaattagaagtgtttacatagggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagcgaactgcatcacctgtcacggagaaaactatgaaggtgtgtcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatcgaaaagattgcagtctgtggcggaatatatccctccgggtgccctggttgctgatatcgggtcagaccacgcgtatcttccttgctatgccgttttgaatcatttggcaagccgcgcaatcgccggtgaaattacagacggaccgtttctatccgccaaacagcaggtggaaaaactggacttaagcactcttatctccgtaaggaaaggtgacgggctgagcgtccttgaaaaaggagaagccggcgccattacgatcgctggcatgggcggagcgctgatcgctcatattttggagtcgggaaaaacgaaattgacggggcgtgaacggctgattctgcagccgaatattcatgccgttcatataagagagtggctgtatcaggaaggttatgaactgcttgatgaagtgattctcgaagaagacggaaagtgttatgaaatcctcgttgcggaaactggcgaccgtgatgcgccgtatcgggacgtgccgatggctgccggaatgcttgcgggtccgtttttattaaaagagaggaatgaagtgtttcttcggaaatggagccaggaacttaagcatactgaacaaatttatgaacagatcagccgcagcgcaaagcatgaaaatcatgaaaaattagctgaattgaaagagcggatctctctgctgaaggaggtaatcggacatgcctaaacatgtgaacggacaggaaatcatccagctgtttgaacaattttcaccgaaggcttttgcggtggaaggagacaaaatcggcctgcagatcggtacattgaataagccggtgaaaaatgtcatggtgacactggatgttctggaacaaacggtagatgaagccattgagaaaaaagttgacttaattatcgcccaccatccgccgatttttcggccgcttaaacagatcaccactgatcagcctggcggaagactgattgagaaatgtataaagcatgatattgccgtatatgcggctcatacgaatcttgatgtagcggacggcggtgttaatgacctgcttgccgaagctctcggcctgacagacacagaggtgctcgtcccgacatactcggacccgctgaaaaagcttgccgtatatgttccgaaagactatgaagaagctgtaagaaccgcactcggtaacgccggagcgggacatatcggcaattacagccattgcgcgttctcctctgagggaatcggcagctttaagccgctggacggggcagacccgtttatcggacagacgggagagctggaactcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggcctcggccggatcggaaaacttcagcaggacatgacgcttgaagagtttgctctgtttgtgaaagaaaagtttgacgttaacggagtccggatggtcggagagcgaaacagcaaggtgaaaaaggtcgcggttcttggcggcgacggaaataaatatatctatcaggcaaagcggaaaggtgcagatgtttacgtgacgggcgacctttattttcatgtagcgcatgatgcgatgatgatgggattaaatgtcgtggacccggggcattatgctgaaaagatcatgagaaaaggcacggctgagaagcttacggcaatggccggagagaaaaactatgacgtgcgcattttcgcttccgaaacagatacaaacccatttaccttcttataaaaaaactgaggccccgggcctcagttttttatttttactttcggaagaatttttttgagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgagccagcctgttggagttattgcttttcggatcgccgacaacaatggttaagtccgctttttttgcctgctctgatacagcttcttgacgaacctgtgtggccaggcagatttcctgatggtattccacgtgcgggtacttttctttgactgattccataatatcgtggacgtcccactgggacattgtcgtttggtttgtaacgattaatttctcagcctgaatatcgagatttctgacgtcttcttctgtttcaacgagatgaacgatttcaggagcgacgccgacggctccttcaggctcggggtggccttttttgccgatgtatatgacatgatagccttcagcttttacttttcggattaagtcatgtgttttcgtgacgtccgggcatgtggcatcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgtgttggatgaggcgtctgatttgttttcatcttctgtttcatctgttttttcagcttcatcctttttatcctgttcgtctgtttcttttgtctcgtcagattcattctcatcatcgctgctgcttaattggctgtaaagcttcatcatggcgggcagactccgtactaaaggaccgtactgctgaatcatcggtgtaacctgctgcgccacgccgagcaccttctgaacgttgccgagcatgctcgacagggatgccggacttgccaggttctgtattccctgcagtcctgcacctgctcctccgctggccgccgccggtgccgacgcggcagcgcttcctcctcctgaaccgggtaaaaaacgggaaagcatcccttttaagccccctccgccgcccgtgcctgcgtttctcaggccggctccggcaatctgctgctgagggaaaagctgccggccctgctgcatcagctgccggcccggcaatgacggtcttcctcccatcatcatacgcggattcatcaacggccggccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcggctgatacctgccgtactgaaaaacgaaagcgtgatcgggcagtcccagacgggaacggggaaaacccacgcctatttattgccaattttgaatcggattgatccgggttctgatacggtgcaggctgttatcacggcgccgacgagagagcttgccaatcagattcatcaggaagcgctcaaaatcacacagggtgcggaagatgagccgatccggacaaaatgcttcatcggagggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagcagatctgatgcttgacatgggctttttagaagatgttgattatatcggatcgcggatgccggaagaacttcagatgcttgtgttctcagctacgattccggaaaagctgaagccgtttttgaaaaagtatatggaaaatccgaagtacgctcatgttgagccgaaaagaatcacagccgaaaagattgaacatgttttggttccttctaaacagcgtgataaagacaagctgctttttgatatgatgtctcatctgaatccttatctgggcattgtgtttgcaaatacgaaaaacacggctgaccatattgcgaaatacctgactgaaaagggcatgaggatcggtcttctgcatgggggattaacgccgcgtgagcgtaagaaggtaatgaaacagattaatgatctggaattcacttatgtcattgcgacagaccttgcggcaagaggaattgacattaaaggcgtaagccacgtcatcaactatgagcttccggacgatctggatttttatgttcaccgcgtcgggagaaccgcacgcgccggttcatcaggccaagcactgaccatttatgagctttctgacgaagatgcgctcgtaagactcgaaaagatgggtattgtgtttgactatgcggagcttgtaaacggcgaatggaagaaaggcgatgaccgccatcgccgcaaaaaacgcaaaaaatcggagaatgaggccgaccaaatggcgaagcgcctcgtgaaaaaaccgaaaaaagtgaagccgggctataaaaagaaaatgagctacgaaatggaaaagataaaaagaaagcagagaagaaacaaatctaataaaggaaagtaggggactcgggttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcgggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataaaaaaggagggggaattgccccctccttttttaccctgagaattggttgaaaagttcgtcaactttccgagctgtttcttttgaggttatcgtttctacttttttcagcaggcgaagccgctcctgttcatcaaaaatattgatgttttttccgtgcatcagagccgctacctcagccgcttgacttctcgtaatgctgattccgtattgcttggaatatttcagaagatcgtccgcagtgacttgattgagccgctgcaaaataattctttgtattaaaatcatcgatactttcacctctttagacataatgtattgagcaaatcattaaaatgttacggcttttaatggtaaaatgaagttgcttactgtttaaaatagttattacaggaaaggagattttatgaccccaaataaacagcataaaagagagtcatttttacactttatcttcagggtcattatgattctgatcggggcgggttcagccgctgtaagtattgaattgtttctggtccctaataattttatcgacggaggcattatcggtgtttcattaattttagaccacctctttatgtccaatcccctcctcaatttcgccttattcgttgtgttactcaacattccatttatgattttcggatataaatatatcggaaaaacatttctcatctctactgttatcggaattgtcggtttagcgctgattgaatcctccttgcaccatgtggaggccattacgacccagcctattttggcgacggtattcggcggacttttgctcggtttcggggtaggccttgtcatccgaaacggaggctcgatggacggtactgaaatactcggtatccttctcacaaaaaagctgcccttctcagtcggagaattcgttatgctcatcaatgtgtttatttttatttgggccggttttgtgttcggtccggagcaggcgatgtattctttcatgacttattatattgccatgaaaacgattgacgccgtcatccaggggcttgatgaaacaaaagcggtcattattgtggcagatcagtatgcggaaatttcagacgcaatcttgcatcggcttggaaggggaaccaccaagcttcagggaaaaggcggatatacggatgaatccaaagaagtcatttacgcggtcgtgacaaggcttgaagtgactaaattgaaatccattgtgtttgaaattgataaaaacgcctttattacgatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggtctgagttttgataccatataccgaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgctatatacaggaggtttttttcagcttttaacatgctgaaagctgtgtttgtttttattaatccaggcgacggcttcaagccaattatgcaccctgataatattggaatcgatggggagctgattatatggggagttaaaaaggataaccggaatgcctgcttcttttgcgatcattgtcgcgttgccgtggtgatcttcgaaaaataaatcaatgccgtgttttttgacggcttccactttgtgatggcctccgacaagctcaatgtgatcgtaatgaatgtcccggtttgcaaaccagtccagcgtaacatcttctaagtggccgcgtcttgccgtaatgtagataagacggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaatccgtaaaaaacgcggaaactaaaaaagctcctttcataaaagaaaaagggggaattgaaggtggcatacgattacgaaaatcgaaaaggcaacgactattacgtggatcatggatcggaaggaaccgatatcacgcgtgatgtttattcagaagaaacagcggccgaaatctcagagccatatcgtgcttctgaccgggcagcagaccgtgatgataatcgggacggagtaagtgaaggccgggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgcttggcatcttcattacaccgtttttttaacacaacgcaaaaaaaaagcttggcggaatatccgtcaagctttttgtgtttcttgttctgcttttgctttttctgcttcaagctttgcatagtgttcttctgccagcttgtcgatttcttttttgagctcttcgaccattgtttcttcagggactttgcggacgatttggcctttgcggaaaagaagtccttcgccgcgtgcgccggcaatcccgatatcagcttctcttgcttcgcccggtccgttaacggcacatccgagaaccgctactttaatcggcgctttgactttagaaatgtattcttccacttcatttgcgatgctgatgagatcaatttcgatccgtccgcatgtcgggcatgaaataagcgtagccgcgtttgaagcaagaccgaatgatttcagcagttctctggctacttttacttcttcaacaggatcggcgctcagagagatccggagcgtgttaccgattcctttgcttaaaatcgctccgagtccggccgcgctttttaccgttccggcaaacagcgtgcccgattctgtaattccgaggtgaagcggataatcaaatgcttttgacgctttttcgtatgcttctatggcgagattgacgtcagacgctttcatactgacgatgatgtcatgaaagtcaaggtcttccaggattttgatatgatgaagcgcactctcaaccattccgtcagcagtcggatagccgtatttttctaaaatgcgcttttccaaagatcccgcgtttacgccgatccggatcggaattcctttttctttcgccgcttttacgacggcttccactttttcgcgacggccgatgtttcccggattgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaatggcgtttgcttttacattcggattcagcgcttcaaaatcttgtgcaatatcatctggcgctttatgtgcgccgactatcgacatcaccgtatcgccttttttgaccgtaaccgttctgtatgaagcttcctgttgggctggctgtgccgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttatacatctgttttacttcgcggtatctcttttaagacgaggaaaaggatgataaagtttacaaaccaattcactaaaaattcactcggcaccgtaataacaagcgcgcgcatgatcgtaaagaatacggtcgaaagtgtaatggaataagccgaaagcttccagagctgctggtaattcaatgtctttctttgcgcatttttcaatatcaggccgatgacggcgagaaatgatacttcaatgaatttgcctgccgctgtcatgatgaacagcaaaacggacaggacggtgacgatcattgttttattttggtttaatgctgatatgatttctttttttgtgatatcggcaggcatcagcgaataattcatttctgtcgcttgtccgtctacagcaagcaccattttatttttcaaaatgccgatcgcattttgtttcgccgctatttgtttcgcgccgtaagcatctgtgggatcaaagacgatgacgaacccgttcgcttccgtttccttagaggcggacgctttcgtctgcaattctccgtttgaaatgctgaaatcagggaaatctttctttaacacggttttgaaaccgttcattgagtttacggtgccggagcaaaggtaataagcgcttggcagcgtaaaaaggacagacagcaaaaatacataaaggatcgcttttcctatcccctgaaaccgtgtttttgcaatatctgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacataataagataaagcgggaagcggtgatcgcccgcaaaacaaaggagggtgtttttgtcatgagtgttttgtattggctgattatcattgcggtcttcatcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgattatgtgtcaaatttacttggcgttaaaaggtacggaggaagcagggcggcaatctggggaagcacgatcggattattgatcgggcccttcgttattcccgtggcaggcattatattagggccgtttatcggtgctgtctgcgctgaggtgtttgttcatcaaaaggatatcaagtccgcggcaaaagtggggctcggctcgttaatcggttttttaacaagcgtggcggcaaaaggcgtcattcagctctttatgatcggatatttcttatggacggtgctttagaaaggtttaatttcggcagggaacggataaagtgtaatatgtctgctggaatcgccggattgtgagctttttcattgattaccatgctttcttttgttacattgagattagaaaagttcgcgttaagcggcatttcagtacatatatttaaaggaggaaaaaaattatggcttacaaacttccagaattgccttacgcttatgatgctttagaacctcatatcgataaggaaacgatgacgattcatcatacgaagcaccataacacatacgtgacaaacctcaacaaagcgatcgaaggatcagcgcttgcagagaaatctgtagatgagcttgttgctgatttgaacgcagtgccggaggacatccgcacagctgtccgcaacaatggcggcggacatgccaaccactctttattctggactcttttatctccgaacggcggaggcgaaccgactggtgagcttgctgaagagatcaaaaacacgttcggaagcttcgatcaatttaaagaaaaattcgccgcagcagctgccggccgtttcggttcaggctgggcttggcttgttgtaaacaacggcaaacttgaaattacaagcacgccaaaccaagattcaccgctttcagagggtaaaacacctgtcctcggtcttgatgtttgggagcatgcgtactacctgaactaccaaaaccgccgtcctgattacatttcagctttctggaatgttgtgaactgggatgaagttgcccgtctttacagcgaagcaaaataaatagttcgatcaaacaaggtctcccgcgggaggccttgtttttttattgactttgaatccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggccggccggctggctaaaaaaattgacagggtgtttattctcaggttcggcgttatctttttggccgctttttatttaagtgtgctgcttgctggagaaactgcggcttcccgtctcgttttgataggggccgtgctcggagttggatacggcttttactggctggcttttaatgtgctgacgttcgaaattacggaaccggaaacgagagatttttttaacgggtttttaggcattttgtcttcatcggcgggcatgatcggtccgattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtttttgtattcattgcgacaaacagtgagctggcgctcggaacattcggtctcgtcaattccgcggtttctttttttgcctattattttgcatcaaggctcatcaaaaaaagagctcggaaaaaggcgattcttatcggcggattgatcttgtacggtgccctgtttcttatcatttttaaaatgagcttcacgacgctccttttgtacggagtgtttattgcgatcggctatccagttctgctcgtgccgtatgtctcgcttacatatgatgtgataggccgggcgcggcttgccagaaaagccagaattgaatacattgtgctcagggagttatttttaaatgcgggcaggatcgtttccatcctttgtttccttgtaatcgttacattattcaaggaaaaagtgggaataccggcggcgctcgtgctgctcggagccggccatccgctgatttattactttataaaagacatcagactggatacagaaacttctgatgaaacagtagaagaagaccgacaaaaacaggcggcggaaccgaattttataaaaggagaaagataaaagggttatctgtagaaaaatatcgaaaaaacctttagaatgaaaaatgacacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggccgcgtttcttattttcacttggattatcgtcgagcttggcatcaagcagatcgttcagggtgatgattataaaaacgccgctaataagcaggaggagtctgatgtcagcacggcggttccgagagggaaaatatacgaccggaacctaaatcccatcgtaacgaataaagcattaaatgcgattacatatacacgttcagcctcaaccacccaggcgcagcgtttaaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgaagatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttagatgaactgccgggagttgacgtgacgtctgactgggaacggtcttatccttataaaagcctgatccggacattgctcggcagtgtatccagtgcgaacgaaggtcttccttccaatctgctggatcactatctgtcactcggctacagccggaatgacagggtcggaaaaagctatttagaatatcaatatgaaagcctgctgcagggtcaaaaagagaaagtgcagaacttaaccgactcatccggaaatgtcacgggcagcaaagtgatttcaaaaggacaggccggcaaagaccttgtattatccattgatatggacctgcagaaatccgttgaaaaaatcattgagaaaaatttaagatcggcaaaagcgagaccgagcacgaagcttcttgatcgggccttcgtcgtcatgatgaacccgaaaaacggagaagtgctgacgatggccggcaaacagattacgaatgatcatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggaccaatttaggtcccgtagatatccaaaaagcgcttcaggaatcctcaaacgtgttcatgttcaaaacggcgattgctgtcggtaaaggggagtacaaaaaaggccagtcccttccgcttgatatgaaggcattcgatactttcagatactacttcaatcagttcggactcggagttaagactgggattgatcttccgaatgaagcaaccgggtaccaagggacacagcgaatttccggtcttctgttagactttgccatcgggcagtatgatacgtttacaccgctgcaaatggcgcagtatgtatcaacgatcgccaatggaggctatcgtttgaaacctcagcttgtaaaagaggtcagacagcctgattcgaaaaaaggaatcggagccgttgtagagtctgttcagccccaagtactgaacaagattgatatgaatcatgcagacattaaagaagtgcaggcaggtttcagacgtgtcatgacaaaagggacagccgcaactgattttgcgacggcgacatacagtcctgccggtaaaacgggtacggcgcaatctttctatgacggtcctgacaaatcagagacgggtgaaggaacgtataatacgactcttgtcgcgtatgcacctgctgataatccggaagtggctatttctgtagtcgttccttgggcctatattaattacagcgatcgatattcgattacgaatgatataggaagagcagctctggacaaatactttgagctgaaaaagaaacaagaagataataatacgaagcagaaaaacgaagataaaattcaggaagacgctgaaaacggcaatacaagcaactaacagaaaaacgctcacaacctgtgagcgttttttttatacaaaaaaacatccggatttacaaaaccttaacacttgatttatacgcattttacaagaaccctttactctatacgtgtaggacaaattacacattaaatgcagggggaattcaggaaatgaaaaaaaacaaatggatgcttatgcttctgatggctgctgttatgattgttgctgcagcatgcggaaatgcaaaggaaagcggcaagacagacagtcaatctgcaagtgaggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggactttcgcaagtgtctgaaggggcagtgcaaatcggcaactcagatgtcttcgctgaagaaaaagaaggcattgatgcgaaagccctaaaagaccaccgagtagcggtagtggcgatggcggctgcggtcaaccccggtgcgggcgtaaaggatataaccaaaaaacagctgacagacgtctttactggtaaaattaaaaactggaaagagcttggcggtaaagatcaaaaaattacactcgtgaaccgtcctgattcatctggaacacgcgctacgttcgtcaaatatgctcttgacggagcagagcctgcagagggcattacagaggattcctccaatacagtcaaaaaaatcattgcggaaacgccgggagcaatcggttatctggcattctcttatataaacgatgacaaagtaacgcctttatcgatcggaggcatcaaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcagggctacattccgatctctgatatgaaagtaacacgtgacgcaaacggcaagcaaagctgaggggagggcgggctccccgcctcttcttctttataggagtgtaaacaaatgataaatcacagagaaaaagagtctgtaagcgaacgcttaataagctcaaaacaaaacaggcaattggatgaagtccgcggaagggtgattgtgtctgtgtgtgccgcgattatcattgcggcatcagcggcgatcacaattttcctcggcataaaggggctgcaatctttttttgtaaatggtgtaagcccgattgagttcttaacaagtctgaattggaatccaacccaggcaaaacctgagttcggcgcgctgccttttattttcggatcatttgcggtcacgattctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggggcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattatcacgttaaacatgggccataccacatacggcagtattgaaaataatacgttatggtctatggggcttgttcttctcatcatgtcgtttctgtttatattgctcatacgctacttgtcatctaggaggaaagtgtaatgaaccggaaaataacggataaattggccaccggtgtattcgggttatgcgccgctgtaatcgcggcgattttggcaggattgtttttgtacattcttattcacggcgtctctgaaatctccttgcgttttcttacgtcaaaatcaagcgccattgcctcaggcggcggaatacgggatcagctttttaactctttttacattctgtttatcaccatgctgatcacgataccgcttggtgtggggggcggcgtctttatggctgaatatgcgccccaaaataaaatcactgattttatcagaacgtgtattgaggtgctgtcttcgcttccgtccattgtcatcgggatgttcggcatgctgatgtttgtaaacctgaccggatggggctacacgattatcgggggcgcgctcgcattaacggtctttaaccttcccgttatggtccgggtgacagaaggcgcgctcactgcagtccctaaggagctgaaagaagcttctctcgctttaggcgtatcgagatggcataccgtcaaaacggtgctgattccgagtgcgattccttcaattttaaccggagccattctggcatcaggaagagtattcggagaagcggccgcattgttatttacagcggggctgacaacgccgcggctgaactttacggatttgaacccgttttctgaatcatctcctttcaacattttcaggccggctgagacgctggcggttcatatatggagtgtcaatacgcagggaatcatccctgacgccgaagcgattgcaaacggcggctcggcggtgctggtgatttcggttctcttgtttaacctttctgcgagatggctcgggtctgtcatttataaaaagcttacggcaaattaatcggaaagaggcgaaaacatgatcgatcacatcatcagggaacaagcggaacagacaaagcgtttgccggagtcttcgattttggaagtgaagcatttatcaatttattacggtgacaaacaagcggtaaaagatgtaaacatgaatattgaaaaacatgcggtgacggctctgatcggtccgtccggctgcgggaaatcaacatttttgagacagattaacagaatgaacgatgccattgcttcggcgagaagtgagggagaaatcctttatgaagggctgaatattttgggtgaagcgattaatgtcgtgtctctcagacgggagatcggtatggtgtttcaaaaaccgaatccgttcccgaaatccatttacaataacatcacacatgcgctgaagtatgcgggggaacgcagaaaagccgttttggatgaggcggtcgaggaaagcttaacgaaggcggcgctttgggatgaagtcaaagaccggcttcattcatcggctctgtcgttatcaggcggccagcagcagcgcctttgtatcgcccgtacgctggcgatgaaacctgccgtgcttcttttagatgaaccggcttcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagccttgtgaaggaagcggtgcacacacagaatttatttgatattcacggcatgaacgtatggtacggagcccatcaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacgggcgcaatctgctgaaggaaaagacggatgcggcagaattaagaaaacagatcggtatggtgtttcaaaaaggaaatccgtttccccagtcaatatttgagaatgtcgtgtacggtccgagaattcacggcgaaaaaaataaaaagaaactgcttgaaatcgccgaggaatctttaaaagcagctgcgctctgggatgaagtgaaggatcgccttcaccaacaggcgctttcactgtcaggcggtcagcagcagcggctgtgcatcgcaagagcgctcgccaccaaaccggacgtccttctgatggatgaaccgacgtccgctcttgatcccgtgtccacgcggaaaatagaagagctgattttgacattgaaagaaaagtatacaatcgtcattgtgactcataacatgcagcaggctgcgagggtctctgatcaaaccgcgtttttctatatgggcgaactggtggagtggggcgatacgggcaaaatattttctcagccggatcatcaaaaaacacatgattatatcaccggaaaattcggatgaaaaaaacgggcccggccattaaccgggtccgttttatatgtccattaaaaaagcctgccggccgtatccatctgaatggacgatgcctgtaagcttttttagcgggttaatgttttgacgatttttttaaagctcatatctgaatcgactttgaaatggccggcgcggatttctttgtggtagcctgcgtcaatgacgtaatcattgaagtctttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttgtgctgatcgtcgaggtagctgtttacttctttttctgtcaatgctgttttttcggttttaacggcggctgcctggtcatggtcagtcaaatagaagacagcggcgagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggttaatgccgctgcttttggctttgcggatcacgaggttggtttccagcaattcttcttcaagcaccgtcattttctttttcaacttgtaaatttcctgcatggcggaaagctgaagcgtttctagctcctgttccacgtctttcatcggatctctttgagaatatgagaatgcaataagcgctatactgacgataaacaacgcaataatagcaatttccacgtttcatcaccttctattattaatttgcccttcttttttataccataaaacgccgccattctaaaggaaatagagaaaaaaacggaattttgtcggaaaatcttttttactcggggagcaaacggttatttctctatagatttcgtatcagaaagcccttttttgtcctgtttagtcatattttgccttcttctgacgcaagctcattcagaggatcagaagcgtaaactgatgttttctgcacttaaacaacatttcatgtaaatcagctctagcattccgtccattatagtggtattatatataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaacacagcggaaaaagctggagctttcaataaagttctggcttttttgtctttcagggaggtttgagaaacgtgaaagcacaaatcagaaccgatataaaagcaaagctttctgacatgaaagaaagtgaatgggagaaaaaatgccgcagcatgcgtgaaacgctgttttctttaaaagaatggaaacaggcccgcgtgatcgccgttaccatctcgacacgcctggaaattccgacacggccgattattgaacaggcctggcaagagaaaaaacaagtctgtatcccaaaatgctttccgcagacgggagcaatggagttccgtacattttctgcgtatgatcagctggaaaccgtatatgcgggcctcagtgaaccgatcgagagtctgacggaaaaagccgcccaaaatgacattgaccttgtgattgtgcccggcgtggcttttgaccgggaaggcttcagaatcggatacggcggaggatattatgatcggtacctgtccggttataaaggccgtaccgtgtcgcttctctttgactgccagctgacagaccgcattccccgcatgccccacgatattccggtcgatatgatcgtgactgaatccgaaaccatcgcttaatcgcataaaaaactttttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggacattcattcatttctttttaaaaataccgtttatcagaaacaaattcattcagcaggcattttaaacaaatcccgttttttaagcgggattttttgcataagaaaacctgccggaaaaaaacggcaggttttctcgtattgtcagctttttttcaggaaaccgagcagaattgagatcataggagaaatgtacaggaaaaaggtaaacggcaggtagtcgacgacggaaacccctaatgcgcttgccataaaagcgccgcttactccccagggaatcagcgggttgatcaatgttccgccgtcctcaagcgaccgcgcaaggtgaatccgcttaatgccgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcataatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcaccaacagaggtgaaagaagcgaccaaggcgtaacgtgcacagcctcttttattccggaaatgaccgcctcaatattttgcgttgaagcggcatttattgaaacagatgaaccgagaatataaaaaagaacgatcgtgatcagcagtgccggaacggtggtgcccatcatatggcgaatatgcttaaaaatcggaatttcgccgattccggcggcaaaattcgtcgtgtcggacatcggtgacattttatcaccgaaacaagctccgcaaatgactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacagagcgtaaacggtgacggtgggaatggcgccgctgtacatccaggcgccgatcagcacaccgatcaaagccagcacgataatcggctgcacaccgtttttcaatccgctgacaattcctttttcaagactgtcccacgagaaaccgagccataaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatattgtttatttcggtgacagacaagccgaaattgactttatgaaagatgaattaaaggaaatgtacttgtcaaacgtgattgaaagagatttatggcaaaaagccgccggagttcttcagagagaatcggagcggatcaaagacagataacacagcaggattttaaataagaaaaggagattattatggaagatacatggtttgcggggattgatcttggcggaacaaccatcaagctggcctttatcaacatgtacggtgaaattcagcataaatgggaagttccgaccgataaatcaggaaacacaattacggtcacgatcgccaaagcgcttgatcagaagctggaagaactgaacaagccgaaacggatcgtaaaatggatcggaatgggagcgcccggacccgtggaaatggcgacaggaatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgcttggaaccggagtcggcggaggcatcatcgtcaacggagaaatcgttcacggtaaaaacggggccggcggagaaatcggtcatatttgcagtattccggaaggaggagctccgtgcaattgcggaaaatccggctgcatcgaaacgattgcgtccgcaaccggcatcgtccgcatcgcgaaagaaaagcttgcagcggtttccgactctttgctcttacaagtgcgcgatctgacggcacgtgacgtgttcgaagcggctaaacagcaggataagacagcgcttgaagtcgtcgattacgtcgcaaaacatttaggcctcgtgctcggaaatctggcaagcgccatgaatccgacgaaaatcgtgctcggcggaggcgtgtctaaagcgggtgaaatcctgcggtcaaaagtggaagagaccttcaaaatcaccgcgttcccgcgttctgcggaagcggccgatatttcgattgcggcacttggaaatgacgccggagtcatcggcggggcgtggattgccaaaaatgaatggctcaaacatcaaaactgctgaagaaagtctgcctgcccatatcgcgggcagctttctttttttatctcccctgtcatatagttttaaaaaaagggggatgaacatggcgggaattcgtgttaaacctgaattgaaacagcatatgaaagatattgcaaaggtgctttcaattgatgaaaaactgttgaaagccgctgataaaacggcggaaagcgatgaattattttgtcccggctttgccgtgagcgggcagtcagaggggccgccgcttgagacgctgagcgggctttcgcgatacatccggcactgtgaaagcgttctttccgctgatcaatggctgaaggaagaaaaggtgtacggctcccaatcggtttatgaagaaattgagaaaataacggatgtctttccgtttgtcacatgccgtaaaatcggcagttccgtattgggaaagccgctttatgagctgaaaataggtgcggatacggccgaaagaaaagtccatgtaaacgcctcatttcatgccaatgaatggatcaccacctcggtcgcgcttaaatggtgtaaagaatattgcgcggcattatgcgaaaataaaaccgttttcgggcagtctgtgcttgatatattcagccggacatcattgtcattcgttccgctcgtaaatcccgacggtgttgatctcgtactttacggatgtgaagatttatcagaaaaaaatgaattcctcaacgaattaaatgagcaccgcccggatttccgcgaatggaaggcgaatataaacggtgtggatttaaataaacatttcccatccaattgggatattgaacaaaggcgcaaaccgaaagccccttcataccgtgattttccgggaacggcgccgctcactgaaccggaggcgcaggcgatgcaccggatgataacggaacagccgcctgaccggctgatcgcgcttcatacgcagggagaagagatttactggggatacgaaggatgtgaaccggagcaatcatcccagatgattcgggagtttgaagcgataagcggaaaccgctatcaaggcgttaaaaccattgacagccatgccggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctgatgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggaaaaaacggaaggatggctggataacagaacaattctgtatacagcacatcatcagctgatgaaatatgatcttttcagcggaaaatccgaacggctctatgaaacaaagggcaatattgtcaatgtaaagatcagccggaaaaaacagctgattcttgtacaggtgacaagcagcggtcagactgagcttgtgcttataaacaagcaggggaaaagactttatcacaaagcctttaactcttatgagctggagacggcttggaatccgtatgacccgtatcaaatgatgattaccgtttttactgaaacatgggacttcacagcctatacggccgatatgaacaatggcattttaaaaaagagtcccgttcaggccccttttgttcattggacctcccctaatgaattccaatatatcaagcaaggaaaaacggaggaagagggtcctttatattcttatgacttgcagacgaaaaaagaaaaaagagtgcttcatcacgtcatctgggctgattcccgcccgggcatgacgattgccgtcagacaaacggatcaatcggacggagacggcgagttccttttccaaaagccggcatccgtgacacaccgctttcctctccaaaaaaagtatgagagctttgcgccgatggaatatgattacgatcagacacacaagcggttttacatatttaagcctgaaggccgctcttacaatctgatcagctttgacttaggagacgaacgggagcggatggtgctcaaaaacacggaaatggagccgattcagatctctccgaacggggaatacgctttatacggctttacgtatgaccgtctgatttcactgaaaacaggcatgacagaaccaatcataacaaatgaaaaaggagtttgaaccaaatggcaattgcagatgtcacaatcattccgatcggaacaaaaacaccgagcgtcagtgagtatgtagcggatgtgcaaaacattttggagggttacaaagctgccggcaaaatcaaatttcagcttacgccgatgaacacgttgattgaaggtgagctgagcgacttattcgcagtcattcaggacattcacgaagccccgtttcaaaaagggctgcacagagtggcgacaaatatccgcattgatgacagacgtgataaagaaacgacgctggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagggtggcggcggctaacaaaaatcccaggatatttctctgtctgacagcccgcaggactcctaatacagctaataatgcgacaaggccgaagattacaacaagtaacatcatgctcctcctttgtcattggaacctgaaaatctttccattttattttaaccgttttcattttgtttgtcgatagcgttttcccatccgcattcattgaatcttccgcagaaaaccttcataataagggcatatacataaagaggtgatgaaagtgaaatggagacgaatgccggccggtccgattcaggcaaacgcgtattttcttgttagtgaggatcagtcctgtcttatttttgatccgggcggggaagcggacaaaatcaacaattacataaaagaaaacaatctgaagccgctggccatcttactgacgcacgcccattttgaccatatcggcgcacttgacgaagtaagagacagatgggatgttcccgtatatcttcacaaaaatgaagaaaagtggctggaggactcttccttaaacggatcaggcatattgcggggcatcgccgtaacggcacggcccgccgaacggctcatcgaaggcgacggcattttggacatcgggcctttccatttggagaccttgtttacgccgggacattcaccgggaagcgtttcttattatgtgaaggacgcggatctggtgatttcaggtgatgtgctctttcagggaggcatcggccgaactgatttacacggcggaagtcaggacgtattgcttgattccattcatcaaaaactgctcacgcttcccggacatacacttgtattaagcgggcacgggccggaaacggacatccagacagagcaggagcgaaacccgtttatcaatggtttttcactgtaaatgaaaaaagacagaccataatcggtctgtctttttctgttcagtgggttccgccgcccggtgtcataataaaaatagagtagtatgtaaatccggcgaaaaatacggttaagtaagctccgaaaatataaatatacatccgctcagtcagattcaaataagaaagaaatacgaaaaagatcgtctgtccaaaaaacaaaagagaagcgtctttcatgccccctagaaaaaacatgactgcaaatatccccgtccaaaatcctaacacccggaacatgcgattcattccttatcccctcccgagagtctatctgaagtttattataatagatcggcactcaaaatgtaaacattttcatgattatatttattgtggaatttatgtctttccctgtgttttatatcttatgccgttctctaaaaaagatccgaaaaatctttttgaaatacgtttagggaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgacatctattccgggagacaccgacaattgatgaattgaaacagatcttatcattaacgaccgaaggaattgatgaaatattggcgacgagaagccaaacatttaaaaaccttaacctgaacattgaagaaatgactgtaaatgaagtgctgaagcttttgactgagaagccgaaactgctgcggcgtccgattctgatcgatcgcaataagctcgttatcggatacaatccgggagaactgatgaagctgacgaagaaaaaaacggtacatcaatctgtatcataagagaaaaacgaagatccgctgatcaaatttatcagctaatcttcgttttttgcggttgcgggactgggctagctggattcgaac

SEQ ID NO: 108 - DNA, 174162 bp, Bacillus velezensis FL50S
gctcaatctgcacgggccgagtgaaccgatcgacacggcttgttccagctcgctggtcgcgattcatcacgccgtatgcgccattgaaaacgggaactgcgagatggcgatcgccggcggcgtgaataccgtcgtcacaccgcaaggccacatcgcttatgacaaagcgggtgcgctgagcaaagaagggaaatgcaaaacgttctccgacagggcggacggatttgccgtcagtgaaggtgccggaattctgtttttgaaaaagctgtcagaagcggaaaaatcaggcgatcatatttacggcgtcattaaaggcagcgcggtcaaccacggcggacgtgcgaactccttgacgacaccgaatccgaaagcccaggcggaagtcgtcagaacggcttatgacaaagcaggcattgatccgagaaccgtcacttatatagaagcgcacggaaccggaacggagcttggcgatccggtcgaaatcaacggcctgaaatccgcctttcaaaagctgtacgaaaaaacaggcgatcccgccgtttacgcgagtcactgcggtttgggatcggcaaaaaccaatatcggccacctgtcactggcagccggtgtcgcgggtgtgatcaaagtgctgatgcagatgaagcataaaacacttgcaaaaagcctccacagcgaggtcatcaacccgtatatcaaactgaaagacagtccgttttacatcgtacaggaaaaaagagaatggacagcattgaaagacgaaaacggcaatcatctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcagcagctggcgcaagcttcttttacggatgcggatcttgccgatgttgcttacacgcttcagcaggggcgtgatgcgatggaagaaagagcggccattatcgcttcctcggccgcagaactgcgggacaagctaaagagctgtgcgaaagggcgttatgacaaagcgggcatttataaaggaaaagcgggtaaaatcccgctgaaatccattatggcaggcgcaaacggcgaagcggatatcgaagagctgataagccgccgagagaatgacaagcttgcggaattatgggtgcagggcgcggatatcaaatgggacggcttatattctgatatcaagccccaacggatgagtcttcctgcttacccgtttgcgaaagagcggtactggatcacggacaaccggccgaaagcagaaaaaccgcaagctgtgccgacggcgcgggtgctgcacccgctgcttcacgagaatgtatcggatttaacagagcagcggtaccgatccgaatttacgggacaagagacgattttcaccgatcatcttattaaaggcaagccggtcatgccgggcgtcgcctacttggaaatggccagggcggcggttgctcaggcagtcaaagggcaaaaggaagttccgtctgtcatccgtctgaaaaacatcgtttgggttcggccgatcgaagcgggaaaccgcccgattcaagcgcaaatcagcctgaacccgagggaaaacggtgaaatcgtgtatgacatttacacggattcacaaacagaagcaagcggcaggcagatacactgtcagggggctgccggcattctcggcgccggggaggctccgcaccgtgatataggcgcactgaaagctcaatgcggcctcagtatgctgacttctgaacagtgttacggcttattcagcaaaatcggcattgactacggtcccggacaacaaggaattcagcacattcatatcggaagcaatcaagcattagctgagctccgtctgccttccttcctcgaagaaacggcagatcaatatgttcttcacccgtgtatgcttgattcagctctgcaagcgacaatcggactgaagctgcatgcagatgataaccagctgtcactgccgttcgcccttgaggaactggacattttcagcccgtgcacgaccagcatgtgggcgtatgtcagctcccggggaacggatgaaaaaatacagcggctggacattgacttatgcgatgagacaggccgcgtctgtgtcaggattaaagggatttcttccagaatgatggaaggcccggcgccggaaacatcattaaatggagcaaaccttctggctccggtatgggatcttgcggaattccgtgaccaaagcccggcatataagacggaagaggttgtctttatcgcaggggatgaggaaagcgaagcttttcaattgcatcatccttctgcgaaacggcttcatatcaacccggaggatgaaatagaggctgttgcggctgaactgaaagcaagaggggctttcgggcatatcgtatggatcgctccttttcacagcgatggtgacatggtgaaagctcaagatgcgggcgtcatccagatgtacagagtgattaaggcgatgcttgctttaggatacggaagcaagcgaatcagcttgactgcagtcacaataaaaacacagtccgtacagccggcggacatcattgatccggctcatgcaggcattcacggtttgatcggttcgctcgcaaaagagtatccgaactggcaaacacggctgattgatgccggatgtccggaagatgtttcaaaggcggagctgttctcagcgccgtttgatgagcaaggcaatacatgggcgtaccgcaacaatcactggtacaaacagcgcctcatccctgtacagcagccggtgtcaagccggcccgcttaccaaaaaggcggcgtttatgtcgtcatcggcggcgcggggggcatcggcgaggcatggagcgaatatgccgtgaaaacgtatcaggctcgagtcgtttggatcggcagacgaaaacataacagcgccatccaggaaaaaatcgacagactcagccaattcgggccggcgccgatttatattgaagctgacgcggcaaacccggatgagctcacacgggcgtataaaacgatcaaacgcacgcacccgcaaattaacggaatcatccattccgcaattgttttagaggatcagagcctggcgaatatgccggaaagccgtttgagaagcgtgctcgctgcaaaagtcaatgtcagcgtgaatatggcccgcgtgttccaaaatgagccgctggactttgctttgttcttctcatctgttcaatcatttgcgcgagcggccggacaaagcaattatgctgccgggtgcagtttcaaagatgcctttgccgctcatttggctcaagttcggccgtattcggcggcagtgatgaattggagctactggggcagtgtcggaatcgtatcatctgccgaatatcaagaacggatgaaacaggcgggagtcggatcaattgaagcgccggaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgttatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacatcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcgtggcagtctgcgctggaaagcgagggatatcggtacgttacatttatggcggaatcgtcacatcacctcggccagcagatcgtggcagcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacgcggcgatttatcactgaacaaaaagagccaaaagcgccaaagccggaaacagaaaccgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacgatggcaaaagaaacacgaaaagaagaacgcaaaacacggtacggcggatttctgcagcatattgacgcttttgaccatcacttgtttgacatccgggaagaccatgtgatggagatgacacctgagctccgtctaagccttgaaaccgtatgggaaacatttgaaaacggcggctactcgttagagagagtaaacgaatggcaggaatcagacagcggaatcggtgtatttatgggcagtatgtacaatcaatatttctggaatatcccgtcattggaaaaagctgcgctcagctctaacggaggggattggcatatcgccaaccgcatttcccactttttcaatttaacgggcccgagcatgggcgttacgaccgcatgctccagctcactgagcgccattcatctcgcctgtgaaagcctgaagcttaacagctgttccatggcgattgccgggggggtcaatctcacgcttgaaccgtctaaatatgatgcgctcgaacgggcgaatttgcttgaacagggaagtgaaagcaaaagcttcggaaccggcacggggctgatgccgggagaaggagtcggtgcggtgctcttgaagccgctctccaaagcggttgccgacaaagaccatatttacggggtcattaaaagcagcgcgttgtgccatagcggcggaaggcagatgtacacggctccggatccgaaacagcaggcgaagctcatggcggcttccattgacaaagccggaatcaatccggaaacaatcagttatgttgaatcagcggcaaacggctctgtattgggagatccgattgaggtcattgccctgacgaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccgaccattaacgcaaaaccgcaaaatccgaatatcgcgcttgaacaaacggccttttacctgcaggagaaaaccgagtattgggagcgtctgaaggatgccgagacgggagacatcgtaccgcggagaagcatgatcaattccttcggggcaggcggggcatatgcaaatctcctcgtagaagaatatatcagcccgaattccgatcaggcccgtcacggcgatgaggaatatattttccctgtgtcagcgaaaacaaaatggagttttgaagcctatcttgagagacttgcggcctttttagaaaagacgccatctcttcatccggccgccatcgcatctgcgctgcaaaaaagaacgcatcatccggagtatcgggcggcatttacggctgcttccgttcaggaactgctggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcggcggagaaccggtactcgtcggcgctacatataacagtctggcagtcgatcatttttgtgacctttttcctgaagcggaaggaggacatattaaaaaactgaattacgtcagccccattaccgtaaaaaaaggcgatcacatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcagatctggcggccattcagcgctcttaccgggaagtgggccggatagatgagttatacggagatggaacgggaaccgtcgtgtggggagaagaatttaaaacgatcacccgtctgtacaaaggcactgatgccgttttagcgaaagtgaacctgaacaatagcgactcacaacaagcgcatcattatgccataaatccattaatcgccaacagtgcttacttggcctcgctttctttattggaccaaacagagacggaaagctatctgccgttcggcattaattccgtcaccttcagcagcccggaaaatcttaccgattgctggctgcacatcaagctggctaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgttaagaatgcgggagcaccgatttctgccggcagtctgacagatgatatccgcagctacgtccttggcaagctcgccaagatgatggatgaacccgcgtcatctcttcgttctgacgcgaatatcatggaattgggacttgattcagcgagtctgatcgggctgacaaaagagatcggccaagaggcggacatcgatgtgaatccaacattgtttttcgagtatccgacggcggaggagctgacccgccacttcgcgtcagcatatgagagcaagttttctcaattgcttgccgatcataggcattcagaagaggccggggtcacggaaacagaagagcgcactttaccgaagaaacagcatacgccttgtgaaaacgccgatgtcaagcaaggaatcgcgattatcggtatgtcagctcagtttccgcaatccccggatatccagtctttttggggacacatcgtaaacggggatcactgtattaccgaaattccggcggaccgctgggactggcgccgttacgccggcgatgagaatgacacgagtctcagatggggcggttttattgacggtgtcggcgaatttgacccgctctttttcggaatttctcctaaagaggcatcacaaatggggccggagcagtttctgcttttgatgcatacatggaaggcaatggaggatgcgggcctgacaaataaggcattatcaagcagaccgacaggcgttttcgttgccgcgggcaacagcgatccgaacaatggaacagccattccgtccatcattccgaacaggatatcatatgccttgaatttacaaggaccgagtgaatattacgaggctgcctgcacgtcaacgctggtggcattgcacagggcggttcaatcaatccatcataacgaatgtgagcaggctgtcgtgggcgccgccaatattctgcaatcgccgaaaggttttatcggttttgactcgatgggatatttaagcaaaaacggccgggcgaaatcgttccaaaaagatgccgatggctttgtcagaagcgaaggggcgggcgttatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaagaggaaagcgcgccttgttatatcagcaccgtgaaaccttgcatcgggcacggcgaactcgcttccggactggccgcccttataaaagtagcgatggccatgaagcatcataccatcccgggcattcccggatttacagctgcaaatgagcaaatggttattcagaaaagccgcttccgtttcaccgaagacaatcaggaatggtcacagctcaccgaccatacgggcagaccgatcccgcgccgggccgcaattaacagctatggcttcggcggcatgaatgcgcatgtcgtcttggaacagtacagtccgagccataaagacaaagaatctgcgcatgacccgcagcttatcgtgctttctgctaagagcgaagggcgtcttaaggcggccgcaggtcagctggctgattttgtgcaaactggagatactccgtcactgcgggatattgcttatacgcttcagaccggccgtgaggcgatgaactgccgcttggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaagcttgcattttgctgggtgaaaggagcggatataccgtgggacagactccaccaaggcaaatctgttcaaagagtgccgcttccgacatatccttttgaacaccacaagtattggaatggcggtcagccagaagacatcacccttgcgccggtttcccaggaccctcagctccgccgcgagagcgcagctgacattgtggctgacattttggggatgaaggcagcggaaattgatcaaaataagccgctgactgaatacggctttgattcaatctcctctattcagctgctgaaaaaacttgaggacggagacagccgcatcagtctggaagctcttcagaaatgcagcactcttcaggagatcggcatgctgttaaaaacgaaccagccgcatgaagcgggccggaattttcccgaactcgtcaagctgaatgaaagagaaaaaggccgtcctgttttttggtttcacggcggaacaggaggcgttgaagcataccagccattcgccaaaaagagtcagcgtcctttttacggcatccaggcaagaggtttgacagggaaagagccgctgcaaggaatcgaagagacggccgcttcttatatgagaatcatccaagcggtacagccgaaaggcccttatgacctcggcggatattccttgggcgggatgcttgcttatgaaaccgcgcgcctcttgcaggaggaaggtcatacagtaaaaagcgccgtcatgatcgacaccccgtacagtgaaaaatggaaagagagaaaaccatctgttaagtcagtcatgctgcaaacgatcaatacgatgcttacggcatatcttaagcctgaaaaccttgaagaggcattaatcagcagagaagacattaccgtccaggctgaggaagaagaagtattgaaagaattgatcggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgtttctcggagattttgaacgttatctgacagcagaggaagaacaaattccgttagaccatgatgcgtattggaaagaatgggaacaccagatgaaacactttcacctgctggacgtccactcttccaatcatgtcacaatgctgtcggaaccaaagccgcaaaacgccattaaggcattctgcgaaaaactgtacgcaaacaaaggaacgataagcgcaaatttccttaaatctttcaaaaaaaagctggacgaaacaaatgagttggtaaaacggtaatagagaacggccggagcaatccggccgctttttttacaatagaactaaatacactatgtactaaatattcactgttatattgatttcctgtttataagacattaaaaaacccccgataaacagggggcgatattaaaatctgacaggcaatgtttcaagccctctcaaaaacacgttttttctccactttacatcctcgtgcgcgcctttcagctctatattcggaaaccgttttaaaagcgaagtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcgccttttttaatagaaacatctttataggtgaaatcttcaatcgcccatcgattcgccatcatgatgacgggagaggtgtaacgcaaaagctcttcgaccgccgtctggatattttcgggctgccgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttgcttgtcagatcttcagcgggatgttttcttttttcttcgatcagtgttttcatatattgtttaaattctttgagagcctggttggtcgcatcttgtccgctctctgacgtgtcgaccatcgcgtttgtccatacttgaaatttggcgcggtcctctttcggaattccgagcagctcggaaatgacgataaacggaagcggtgccgcgaaatctttcatgatatcagggtctgcttttgtttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcgctgacattcagcttcgcgatcagctccttcggcataacccgttttacatctctcgtaattctgccgtcttttaaaaacgccatacaatcatcataacgcgtgatgagccatgccggaaaggtgcctccgaaacgctgcagttcgaatttatgtatggggtcctgctctctgaatctgcttaaaaccgcaaaagggtcttcgtgaaactcgggtgagtgtgggtgaaacattgttttttccatctggatttccccgccttcatgtttttgaaaagacataaccaacagccggtgcctgccgaccggacggcattcctccttttatctgccgaagacactgatcacaacggctcataagtatgtctaaaatatataaggaaaaagaagccggttcaatagacaaatcgtaaagccgccattttcgttgattatcaacaaaacagcaaactttttttgccatttcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcatgctgcatcccgatacgatcaggtgctgtatttcccgctgtcaaaatatccggagacgggaaatcatataaaagacgccatttcggcaggtcattctgagatttgtacaattgatcggggcggagcggagaacagaaggaaagaatcattgaaaggaattccgacaaagcccgggtttgaccgtgatgaatggcccatggcagtctgcacagaaggcggggcgggggctgatatcagatatgtaaccccatcggataaccgcggggccggttcatgggttggaaatcaaatgagcggctattccgacggcacgagagtattatttatcgttcagtaacttctccggttcgccggagtttttttatgctttgaaaaagcggcacgccggctggacatatgaaatggcaaagagtaaacttatatgttggaatcagcatgagaaaggattggatcacattgacagtgactacataccgaaatattgcacttttacttctttgtttaacagcgggaattgtggatgtgatcggttatttaagcctgggacatatctttaccgccaatatgacggggaacatcgttctgttcggcctggcgatcggcaactcatggcaccttgccgtactcaaatcgttaacctcgttaatcggatttattgccggcgttattgccgcggccctgcttgtgggcaataaaaagaaatcattctggccccctgcggtaactgccgctttagctattgaaggagctgttttgctgctgtttgctttgttctcctgcttttttgcagacgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgtattgcgcgcgcttgccttggttctgtattgctttggggcggtcataggcgcttttgccgaaccggattataagtttgccgtgatctggctcccgattatcattattttaggcattatgctttgcgcattcacgatgttccacggatattctgaagaaaaaaaccaataaaaaacgccgctgtttcacggcgttttttctttttattgctctttccgggtcccgattgtatacacggcccgatctgtatgtacctttaatccgtcttgctcctgttggatggtaatgtcgccgagcagaggaatttcatacgcatcttggggaagcgggacatttccttcctccgtataggttgtgccgtgcccttttaagacgagttcttcatccgctacatagtcatcgggatggtttgtccggcggacgagaacgtcatcaaggtgaagcatgatctgatccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttttagaaatacactgccttgcgttgatctttttttctgacagccggttctgacctgttccgagttccttcattataaatgtttcatctattcacctgaaaaacggagtcatctgccggtgcagacgaccccgttctcatgataaaaaggttactctttcggcacggcgttttcggcgttcactgcgcccgctccgtaaatgttcggatcttcatttgtccattgatccggactttgtctgatcaatgttttcacttcgtcaggcgaaagctgcgggttttgctgaaggattaaggcagcgatgcccgcacagatcggagtggccatggacgtgcccgacagactgaaatacaaggagcctactcggtttgatttctgtaatttgtcaagatatgaacgcggagaacgaagagatacgatatcgaccccgggcgcaagaatgtcaggcttctcttttccgtacaccgtcgggccgcggcttgagaaagaagcgaccgtatcgtcctcattgctggctgtatcattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcgggtcgtccgtttctttatcatatttgagcgcatctccgcccagcgacatgctgatgattctgatcggattctttgtgtgttctttattatattgtatgcaccattccacaccttcaatgatatcagccaaggttcctgatcctgatttgtttaaaaccttgactccgatcagatcggcttccggcgccggcccctgatatttacccgaagatgaagcgccgctgcttgcgatatcaccggcgcaatgggtgccgtgtccgttgtcatcatacggttctgtcttttggttgacaaagtccgcaaagccgataatcctgccttctaaatcaggatgctgatagattccggtatcaataacggcgacggttacgccttttcctgttaatacggtgccgttacgggtcacttcttttgcatgagacgattcagctgctgtatcaaggagagcttttacttcacggtttaaatagattttacggatatcccggcattgcgaaagaagcatgtgaagggcggacggcgtgacttcggcgctgcagcaattgattgtttgaaactgcttttttatggtgcagcgtttttcttttgataagacctgtcctgtgctgtgaaaaccggattcatggcagccctcttcaaattcaatgatgactgacattttctttctgtttttcacctttttttcgaaaaaattgtgtaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggccgtaagttcggtcagtttgtttgtccttcaggagcgctggttacttgcggctttttcaggagaagaaatcgagttgaaacggaacgtttgttcgttttgtaatgaagccggcggaaggtagtttatacatgaacatcatattgagacattccttggaaaaacagcttccgattgatattatatatatgaaaaaagacggctccgtttcaaaacggaccattatgataaaaaaaggggatgagcgggctgtaatggcattttgctgtacaaaaaggcagatgagaacttttttgacgggctccattctgtcctgcgcatttgcttcgggaggcggatattcatttctaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaatatttcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagagaaaggggagccccgtattgatcatgtccccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcaaacgaaacggatttcctgcagaattggcaacctcaaaaaccggtctggccggggttgacaccgaaaatatcaataaccaggcgcaaaccgggctgagtatacagcttgagatcagcagagaacagcgggaggcgttttttgataattttgattaccgcgaaagggaattcacaaaaacggaggaattttaccggtttgtccgtacgataaaaagagtgatcaatcaagagtattcgtgagcttaaaaaaagacaaaccagtgaaaggtgagtaaactgaaaaaaaaggaggtttgtcccttggcaaaacatcacttttatttaaaagcaaattggcccggaaatcgcaatgacgtcggcgatattaaaagcggccggctggaaaccgctgtgtccattcctaaggaaatggacggacccggagaaggcacaaatcctgatgaaatgctgcttggagcggccgcgacctgttatattataacgcttgcggcgatgatggaaagaagcggcctggataaagaagatctacatatggaatctgaaggaattgtagacgtcacgaacggtgtgttcacgtaccagaaaatcattcaccgcccgtttatattattaaagccggatgcagccgaaacggactttacgctcgccaggaagttagcgcaaaaagcggagtcctcatgtatgatttcacgagcggtccaaggaaacgtggagatggagcttgaggttgaagtaaaagctgcccgcgcttgacgagttcaaacggtcagctccgggccgtttgattttttttagctttttgagacttggaacggttcagcaggatgacgcccgtgatgacaaaaataagcccgatcatcattttagctgtcatggcttccttaaaaacaaaaaagccgacaattgccgttaaagccgtgccgacacctgaccatgtcgcgtatgcggcggataaatcaaggcttttcaaagagaagctcaaaaacataaaagaggctccgattccggcaatgacgccgagagcgggccataagtgcgtaaaaccgtccgacagcttcagcatcgtgcttccgaacacttctgatacaatggctaatgccaggcagagtaatcctttcatatcatgcttctcctttctaccaattcatcagaatgacaccggccaataagaatacaagtccgatgacggcctgcttgtccagtttttcatgaaaccatttcgctccgataatggatgcgagcaccgttcccgctccgctccatgttgcataggataagctgagcggaatgagattcagtgtaagtgaaagcatataaaaggccaatgaatagcctgccactacaagcgcgctcggcaaaaaccgcgtaaatccgcgggagaccttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatataaaaaggcccctgaaaggagccctttttgattgtcttagtagtaatacggatagtaagggtagccgtaacctccgtacaggtacggattgaataaagcgcttccgacaagccccccgacaagccctccgaagaacggtccgccgtaaaaaccaaacggccgtccgaatccataaccaaaccaaggccggccaaatccaaaacccggccgcccgaagccgaagccgaatccgggccgcccgaacccgaagcccggccgtccaaacccaaatccgggccgtccaaacggtctcatatcactatctgctgcatatgtgtattcttcattcataatttaggtacctccaagaataaatttgagatgataacagagtattcagcccaccaatttttgattgggcatttatcaaaaaaataaaggagtgagcttttgtgggcctgtatcagtccgattggtcaaaaaaacctccgcacacacacgcataccgggctgttacggatgtagtgcaggggcactaccatatgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcggatccagcatggcggcgtcgtttacgatccgcgggaggaaggacggaaaacgcaccgccatacgctcaaaggaaaaacgagagaggttgtcggaaacgagccgatcgggtggtagcggacgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcggattatcagaaaatggtgaggggaaaaatcaccgagattgccggtagaggaaagctgccgatgattgtcggggggacgggtctgtacattcagtccgtgctgtatgactatacgttcacggaaaactccggcgaccctgtattccgggagcgaatggagaaactggcggctgaagaaggggcggaagcgcttcatgccaagcttgcggcagccgacccggaagcggcggcagccattcatcaaaacaatacgcgaagagtcatccgcgcgctcgaaatcctgcatgtatcgggaaaaacaatgtcagagcatcttaaaacccaaaaacgggagctgctttacaatgcggttcttatcggtcttacaatggacagagaagtactgtacggccggattaacgagcgcgttgacctgatgctggaaaccggccttcttgacgaagtaaagcggctgtatgatatgaatatccgggacagccaatcgattcaggcgatcggctataaagagctgtatgaatatcttgatggaaaagtgccgcttcctcaggccgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaagataaaagggggttcggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaatcgcagacagaaggcatggtgcagctggaacataatcgtttcggcattgtcgagggcggttatctaaaaatataccgctatgatgaaaaaacgaataaaatcgaactgaaaaaagaaacggcgctggatgagcttgaataaatttcacaagcgttcgaatttacaaagcgggccgcacaagctacactaagtactgacattgatcatgcagagggtgagacgattgaaacacaaggtgataatcaaccattgggaagaaacttgtgaagatgattcctgctatgaatatggaaccagcatcatcgttgacggcaaagaactgatcagggaggcttccatcacaagcgctctgaaagccgtactgaaagaaatcggtgctgatgtagagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgagaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaatggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgcaaatggcgacactgagaaagcaaaagaatatgtgaatctgatgatcaatcaggaatatcagccgagcacaccgacatttttgaatgccggcagaaaacgccgcggagaactggtgagctgtttcttgctcgaagtcaatgattccttaaacgatatttcacgggcgatcgatatttccatgcagctttctaaactgggcggcggtgtttctcttaacctgtccaagctccgcgcgaaaggtgaagcgattaaagatgttgaaaacgccacaaaaggtgttgtaggcgtcatgaagcttcttgataacgcgttccgttacgctgaccaaatgggccaaagacaaggctctggcgcggcgtacttaaacattttccaccgcgatatcaatgactttcttgatacgaaaaagatttctgcggatgaagatgtgcgcgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggagcttgttgacaacccgcgtgtcaaaaaagaaaaagtgaatgcgcgcaaattgcttgaaaagcttgccgttctccgttctgagtcaggttatccgtacattatgttccaggacaacgtaaacaaagagcatgcgaataaccacgtatcaaaagtgaaattctcgaacctttgctctgaagtgcttcaggcgtcacaggtttcggcttacacagattatgacgaggaagacgaaatcggcctggacatttcctgcaaccttggttcattaaatattttgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagattttgcgaatacgttctttatgatggtgaacttttattccatccagcgttcagctgagcttgcgaaagaaaaaggcgaaacgtttgagcattacgaaggctccacttatgcaacgggagaatatttcaataaatacatcgaaaaagagttctcaccggcatacgaaaaaatcgctgcgctctttgaaggcatgcacatcccgacaatcgaagactggaaagagctgaaggcgtttgtcgccgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagttaacagtgacaaaaatttatgacgcagcaaactggtcaaagcatgaagatgatttcacccaaatgttctacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacgggcatgccgattgtggctgagcacgtcgaaggccatcagcgaaaagcggttcttaatttcatggcgatgatggaaaacgcggtgcacgcaaaatcatattcaaatatttttatgacgcttgctccgactgaaacgatcaacgaagtatttgaatgggtaaagcagaataaatatctgcagaaaaaagcgcaaatgattgtcgggctttacaaagccattcaaaaagatgatgaaatttcactgttcaaagcgatggttgcttctgtctatctggaaagcttccttttttacagcggtttctattatccgttatatttttacggacagggaaaactgatgcaaagcggtgagatcatcaacctgattcttcgtgatgaagcgatccacggtgtatatgtcggactgctggcccaggaaatattcaataaacaaacagaagcgaaaaaagcggaacttcgcgaatttgcggttgagcttttagaagagctttatcacaatgagcttgaatatacagaggatctctacgaccaagtcgggctgtctcatgacgtaaagaaattcatccgctataacgccaataaagctttgatgaacttagggttcgatccttactttgaagaagaggatattaatccgattgtattaaacggattaaacaccaaaacaaaatcacatgatttcttctccatgaaagggaacggctacaaaaaggcgacggtagaaccgattaaggacgaagatttttattttggccaagatgaagagcagatataatatctgctcttttggcttgagtggagaggtaagacaggaggaacgggcatgaataaaatggatgaaatcatcttggctgcaccgcggagtgacgtctttcaaaacgaaatgctgacatttcagggagtcaacagcgaggatgaacgtatcataaaaattatggctcaaattgaggcgcatttttttgaaatcagaagaggcgacgcggaagaggacccgcgatttaaacagccgattccgtatgtcgtcatccgccgcgatgatgaggtatttgtgtatgaacggctcgcgggcggaggggaatcgcgcctccataataagctttctctcggcttcggcggacacatgaaccctatggaaggggcggcttcatttttggaagtgctgaaacagaacaccgaccgggagctggcggaagaattgtacattcgcgaggaggacaaacaaaacattgtcacactcggcctgatcaatgatgatgaaaacgatgtagggaaggtgcatatcggcatcctttctgcgctccagttagcgcctgcagcacaagtcgaagtgaaagaaaaagatcaaatcgccgggcgctggatgaaactgagcgaactgaaagaggaaaatgtgtatcatcgtcttgaagcttggtctcggtttgtcgccgatatacttcaataacaaaaaacccccgttcgtcccaaaaagggagagcaggggttttttcatttagtcttgcacaatgaaggcatcaaatccggctttttcggcccgcgctgccaacgcttcagcataatctctgaaagagaatgcgccgatctgcactttaaataagccgccttttggaagcacaatcgcgtcaaaacctttagacaccgcatcggcggcaagcgcatcagcatttgctttcacgttgaatgcgccgatttgcactttatataagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatccttgtctcccgcagcacatggaagttggctgttttttttccgcggtcattaaaacccgatgcttgaattacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagtgcgatctccagcgtgaccgctttttcctgaagtccgtttccggttgcacctgaatcagttccgccatgaccggggtctataaaaattttaaccattctccatcacctcattacagcatatgatgatattcaaaaggtgcttgtacggctgtcattcatgaaaaaaatgagaaatacacccaacatttcccggaaaataaaaataaatggtttgtcctcccgtttttgctgaatacaataagaaatgaaaaatatttctcgggaaagcgcaggattcaacatcattcccgaagagaacggaaaaagtgacagataaagaggaaaacgggcctcatgatgataggcggatgtcacagaaccgcttcatcatgagtaagataaagagagaacagagaggtgagcatgttggagcgcgctgtaacctataaaaataacggacaaattaacatcattcttaatggccaaaagcaagtgctgacaaatgcagaagctgaggcggaatatcaggccgccctgcaaaaaaatgaagccaagcacagcattctgaaagaaattgaaaaagaaatgaacacattagtgggtatggaagaaatgaaacgcaacattaaagaaatttacgcgtggatattcgtcaaccaaaaacgggccgaacaagggctgaaagtcggaaaacaagctcttcatatgatgttcaaagggaaccccggcaccgggaaaaccaccgtcgcgagactgatcggcaagcttttcttcgagatgaacgttctttccaaaggacatctgatcgaagcggaacgtgccgatctcgtcggtgaatacatcggacacacggcgcaaaaaacgagagatctgattaaaaaatcgcttgggggcattttattcattgatgaagcatactcacttgcaagaggcggagaaaaggatttcggtaaagaggcgattgatacgcttgtcaaacatatggaagacaaacagcatgaatttattctgatcctggcagggtactcgagagaaatgacacatttcctgtcattaaatcccggtctgcaatcgcgcttccctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcgatccgcgctcaggccatgagacttttaatgggagaccaatacttgaaaaacgatttaatgacgatcaagagccaggatttacttataaaagatgaggcggcagctcacgaatagacctctcagccggtttgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgagcactttgaacattccatggaagagcttgcttcattgacaaaaacggctgacggaacggtgctgacccggattacgcaaaaacggaacagagcggatgccgctacatacataggcaaggggaaagtagacgagctgaaggcgctgtgtgaagagcttgaagcggatctggttatttttaatgatgaactgtcaccgagccagcttaaatcactcgccactgcaattgaagcgaagatcatcgaccgcacgcagcttattttggatatattcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctgtcaacggttatccgccacagaagccgttatcgggagagacgcaaaaagaacggcgtgcttcaggctgcactcgtcggttataccaatgcaggaaaatcaacgtggttcaatcaattaacaagctcagacagctatgaagaagatctgctgtttgcaacacttgatccgatgacgagaaagatggcgctcccaagcggctacagcgtccttttgtctgatacggtcggcttcattcaggatctgccgacgacgctgattgccgctttccgttcaacgcttgaggaagtgaaggaagcagacttgatcattcatgtcattgattcatccaatgaagattatgccgggcatgaacagactgtcctcggactgttaaaagagcttgaggcagatgatattccggtgctgaccgcttataacaaacgtgatgagacacttcctgacttcatcccgacagcgggagaaggccacatcatgatcagcgcccgaatcgccggggatgaagcgaaactaaaagcggaaatcgaagcttatttgcgccgggagctgatgacaccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaattgaagaaattcatgtaaggaaggtatacacaacatgtttgacacactgacccacggcgctcttttacaaaaaaccgccgaagaaacagaagcggaaatctccgccgttcataaaagaatagaagaaatcagtgaacggaatgaatggagagtcctgcaaagctacagaaaacataaagtaagcgatacgcattttacgccttcaaccggatacggttatgatgatatcggacgggatacactggagaagatctatgctgatgtgttcggaggagaggagggacttgtgcggccgcaaatcatttccggtacgcatgcgatttcaatcgcgctcttcggcgtgctgagacccggggacgaattgctttatatcacaggcaagccttacgatacactcgaggaaatcgtcggagtaagaggcggggagtattcaggctcgcttaaggaatttcaaatcggatacaatgcagtcgatttaacatcagaaggcagagtggactttgaagcagtccgggctgcaatccggccgaatacaaaagtgatcggcatccagcgttcaaaaggatatgcgaatcgtccatctttcagaataaatgaaattgaagagatgattcgtttcgtaaaggaaatcaaagaggatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaggccggtgcttcgctttattcactgcaggaaatgtatcaaggtttctttctcgctccgcatgtagtggcgcaaagcttgaagggagcggtatttaccgcccgttttcttgaaaagctcggctttacgtcaaaccctgcatggaatgcgccgagaacggatctgattcaatcagttgagtttcaggaccctgataagatgatcgctttttgccaggcgatacaatatgcatcaccgattaatgcgcatgtgacgccttatccgagctatatgccgggatatgaagacgatgtcattatggcagcgggcactttcgtacagggagcaagcattgaattatcagcagatggacctatcagaccgccttatgtcgcgtatgtccaaggaggattaacctacgcgcacgtgaaaaatgcgatttgcagcgccgtaaatgctttaatggaaaaagagctgatttagggcgtttgcaattttcaaagaatttgatgttaagattccttacattgtgttgacacaaaatataacatcacctataatgagactaagataagaaaaggaggaaattgagatgagtgataacattcgccgctcaatgcctttatttccaattgggattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaaccgccaaaccgatgaaacacaatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacgaaatggcaaagtacacaagagaagacatcgtaaaattagtaaacgaggaaaacgtaaagtatatccgccttcaattcacagacattctcggaacgattaaaaacgtggaaattcctgtgagccagcttgaaaaagcacttgataataaatgcatgttcgacggttcttccatcgaaggtttcgtccgtatcgaagagtctgatatgtacttatatcctgatctgaacacatttgtaatcttcccgtggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgacctggctccgactgacttgggagaaaactgccgccgcgatatcgtgcttgagcttgaagaaatgggctttgaaatcgaagcatctcaccatgaagttgctcctggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagataacgttaacgcattctttgataaagacgctgatcttcagctgagtgaaacagcaaaacatttcattgccggtatcgtaaaacacgcgacaagctttacggctgtcacaaacccgacagtgaactcttacaaacgccttgttccgggctatgaagcaccttgctacgtggcatggagcgcgcaaaacagaagcccgctgatccgtatcccggcttcccgcggcatcagcacgcgtgttgaagtccgcagcgtagacccggcggcaaacccgtacctggcgttaagcgtattgcttgcagcaggccttgacggaatcaaaaacaaacttgaagcaccggctccgattgaccgcaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcattgaagcaaaagaaatcgaatgggatatgttccgcacacaggttcatccgtgggagcgcgaacaatacatgtctcagtattaatctctcaatcccttggcactattggtgtcaggggattttttaagttttggtcaaaaggttaagaggtcgatattttggtccttgaccaaaaaaaatgaagttatgaatctaactccataattgaggacacgtatttattgtaatcccttattcggtttaggatggaggctaaatgaagccaattatgctctaaaattgaaccggccatttttattttcaaaaagcaggagcaggaaattcatcaattttgatacgaagtaaactataaggtttctgtcgtaagtcttctccataatgaaatctagcctgccgatgtaattggttcacgatgacgtataagtatccatccggaccaatcgaaaaagtatccggccataaaattctcggatcatgtgcgatggtttccattgtgccattcggcagcatctttcgaatactattgttctcgtaatctccggcataaacggctccttttgcatctgtaatcattccatcagacgcgcctttttctccccaatacgccacatgataaagtaaatccatgtccgatatatttctatctctcagggcttctgttgagatagagaacaaatggcggctggtcaggggacaaaaaaataatacctttccgtcgggagagatcgcaataccgtcggatgccagcctaaatggggaagttgaaccatccttgttacgattcatcaaaattttgccttctactttcggtataaaagaggaatccggtgaagttggatttgctccatttaaccgtctaaatgcgtttccggtttctaaatcaacgacgataatagctcctggtcctttggaagaagaatccgttatataggcataacctgcagttccgacacgaaaatcaaatcggacatcattcaggtaggttgttggaaggacaacatcttctgtaaaggtatacactcttctgattgtattggtttttaaatcaacagcgactaattttgccccgcctttaattggttcagaaaaattgggcgccgctgtatctagtatccaaagcgttcctcttccatcagcaactacactttggacactgatgaaagtcattttgatattctcaaagttaaccaaattggtttgtgaatcaggataaggctgcaatttatctccaattatttccgctgccgtaaatttaacatcgtctccccatttcggaaaacaaatgaatatacgaccggtttctgagacagtaacaccggtaggcatagctccataaaatgcataaaccagttctaaatcaccaaaatatttttcaaaaggcagcataggtttcataatatcctcctcaaccaattaaacgggatatcacttatatatgattcgcattttttcaagtgcatgtttcttaataagtttttctaaacaaaagatgatggaagtgcttatcatttaataaatcagtcaggtgacacatagggtttttacttaacgtctgtcgaaggagccggcaattacaacatggtatgtcctttgatcggttttaaattttctgaaaaaagagttgaaaaagcagaaaagattttataatatgaaatcaagttagtttgttcgatcaacaaactaataaaccgctttaattgtccttcatgtaaaggtcttaaatggaagggggataagaggctcgatttaattggaggtatatataaaacgaaagccaagcttttatcctgttcactacgatgaaagtgctctgtgaaagtaaactgctatcattttttgaaagcgcttttataaagacctcactggccgataaaattgaagaaatgttataccattcatcatgttccttatgtaaaggatcgaaaaggggaggaaatcatgctcagtgaaaatgtaaagaagatcagcatggttgaaaaagttggatatgcgtctggagattttgcatgtaatttaatttatgcaacagtgtctacttatcttttgttcttctatacagatatatttggtttaccggcagcaacagccggtacgatgtttttagtggttagaatcatcgacgctctcgctgatccttttattggaacgatagtagacagaacaaatagcaggtttggacgcttcagaccgtatcttttattcggagcttttccatttgtcatactggcaatactctgttttacaaccccggatttttcggatattgggaaattaatatatgcctatatcacctatgtcggtttatcgcttacatacacaatgataaacgtgccatatggcgcgttaacctctgcaatgacccgaaataatcaagaagttgttagtataacgtctgtccgtatgttatttgcgaatcttgggggacttgtcgttgcattttttgttcccttactggctgcttatttaagcgatacgtccggcagcgaatctcttggctggcagctaaccatgggtattatgggagttataggcgggtgccttttaatcttttgttttaaaagcacaaaagagcgtgtcacgcttcaaaaatctgaagaaaaaattaaattatcggatatatttgagcaatttcgtgttaatcggcctctagttgtactaagtattttttttattattatttttggagtgaattcaatcagtaattcggttggcatctattacgtaacgtataatttagaaagagcggatttagtgaagtggtacggtttgttgggaagtttgcctgctttggtcattttaccgtttattccaaagcttcatcaattattagggaagaagaaattactaaactatgcattattactgaatatgatcggcctcttagctttactgtttgttccgccaagtaatgtattcctgatactttcctttcgattgctggccgctgcaggaagtctcactgccgggggatatatgtgggcgcttattcctgaaacaatcgaatatggagagtataagaccgggaaaagaatgggcggtctcatatacgctattatcggatttttctttaaattcggcatggccttgggaggggttgtaccgggtttggttctagatcagtttggatatgtggcaaatcaggcgcaaacgccggaggcattgacgggaattttaattacagcaaccattattcccgtgttcttactggttctggccatgattgatattaatttctataacttagatgagaaaaaatataaaaacatggttcgagaattagagaatagagacaaagtttatttggatcatattgacgatttcaaagcttaaaacatgatagtcaacagaaaatagctgaggaggcgttctgcatgaagattatcaatccagtacttaaaggattcaaccccgatccgagtatttgcagagtgggagaggattattatatcgctgtatctacatttgagtggtttccgggagtccagatacaccattcaaaagatttagtcaattggcacttagttgcacatccattacagagagtttcgcaattagacatgaaaggaaatcctaattcaggcggggtctgggcgccatgtttaagttacagcgacggaaagttttggctgatctatacggatgttaaggtcgtagatggcgcttggaaagattgccacaattatttagtcacttgtgacacgattgatggtgattggggggagccgatcacattaaacagctcggggtttgatgcttctttgttccatgatacggatggaaaaaaatatttattaaatatgttatgggatcagcgtattgatcggcactcctttggaggcattgtcatgcaggaatattctgataaggagcaaaaactgatcggtaaaccgaaagtgatatttaaaggaactgaaagaaagctgacggaagcgccgcacctttatcatatcgggaactattattatttattaaccgcagaaggaggaacgcggttcgaacacgctgctacaattgcccgttctgcaaatatcgaggggccatatgaagttcatcccgataatccaatcttaacgtcatggcatgatccaggaaacccattgcaaaaatgcgggcatgcatccattgttcacacacatacaggcgagtggtatttagctcatttaacgggacgtcccattcacccggacgatgattcaatttttcagcagcgaggatattgtcctttgggcagagaaacagctattcaaaagctctattggaaagatggctggccttatgtagaaggcggaaaagaagggagcttggaggtggatgcgtcttctatacctgaaaccatatttgaagacacgtatccggaagttgatgaatttgaggatgcgacattaaatattaattttcaaacgttaagaatcccttttacggagaaattaggttcattaactcaagcgccaaatcatttacgattatacggccatgaatccttaacttcgacatttactcaggcatttgtagccagacgctggcaaagtctccattttgaagcggaaacggctgttgcgttttatccggaaaattttcagcaagccgctggtttggtgaactattacaatacagagaactggacggctcttcaagtcacgcatgatgaagaacttggccgtattcttgaattaacgatatgtgataacttctctttttcacaaccgttaaaaaataaaattgtgattcctcgtgaagtcaagtacgtctatttaaaagtgaatattgaaaacgaaaaatattattatttctattcatttaacaaagaagattggtacaaaatcgatattgcattggaatcaaaaaaattatcagatgattacatccgcggcgggggattctttacaggagcttttgtagggatgcaatgccaagatacgagcggaaatcatattccggccgacttcagatatttccgttataaagaaaaatgaatgtccgcatgaaaaaggagctttctattttggaactcctttttcatattagaaaatgcccgtgtggaaaaacacgtcagaaatgctcccattcaggatgaaaataacaaaacaaaaaacccatctttaaagatgagcgtaaaacatagaagtttgtacatttcagttatgaaccatgtcgagaaaatgatcaatcacaatagaggacattcccaatgccggtgcgttttttcctaggatagatggtaataattcatagctattgtctaggtgggaataaaccctggacgatacttcgcttttaattgaatgtaaaaccataggatgcgattcgatgatgctgtttcttaaaatgatggcttgcggattaaatgtatttaaaatattggtcaggcctatccctaaatagaatccaaaattctgtaatgcatgtaaagtttcaatatcattcagatgggcgaggtctatgatatcttgagtggacacttttttctctttcgtctgaagagatgttaataaagccttttctgaagcatacaattcccagcagcctcggtttccgcagctgcatttcggaccattaaagtctattgtcatatgtcccatttctccagagaatccgccaacccctctgtataaatcattgtttataataacgccgattcctatccctgtaccgatacttgcataaatcatgttatcgtgattttttgcagcgccgaatactttttctccatatgcgccggcatttgcttcattttcaataaaaacgggcacattgaacttcttttggatgaaagattttaagtcaatatctctccagttggagttcggagcgaaaacaattttttgatttttatcaattaacccgggaacgcatatgcctataccaataagcccgtacggagattgcggcatatttgcaataaagtgatgaatcatctcaattaaaatatctttagtgatttctggagaactgcattccaaatgatggtgttggtcaaggacgatcgtcccttcaagatctgttaaaatgccattaacataatccacgccgacatctattcctacggagtatcctgcttttttattaaaaacaagcatgactggtcttctgccgccgcttgattgtccctgaccgatttcaaatacaagattttctttcattaatgtgtttacctgtgatgaaacagtcgatttatttaatccggtcatttcagataattttgctcttgaaataggagcattcttaagtatttcgtttagtaataacttttggttaacttttttgacaaaggcttgatcagcgatatccacttcatccactccgtttgtataatctttaaattaagttgaacgttctgtgtttatcgtgcgaaacgctacatagcgaatccaacctttattatatctaatgtgttcgtaaaaaactaaaaaaaatattgaaaatactgatgaggttatataagatgaaaataagttagtttgtttaggcaacaaactaatatataacatgacataaaatcatctgtattcgaatcatcaagtttagaatttatttttaagggggaaatcacacatggctcactctcattccggttcagtcaactattttgaaagcgtaaacaaagtgatttacgaagggaaagaatccacgaatcctttagcatttaaatactataattctcaagaagtaattggcggaaaaacgatgaaagagcatctgcgattttctattgcctattggcatacatttaccgctgacggcacagacatttttggcgcagctacgatgcagagaccgtgggatcactataaaggcatggatctggcgagagcgagggtagatgcagcgtttgagctgtttgaaaaactggatgcgccattttttgcttttcatgaccgggatatcgcaccggaaggaagtacgttaaaagagacaaatcaaaatctggatataatcgtggacatgataaaagactacatgagaaccagcggcgttaagttattatggaatactgcaaacatgtttacgaatccccgtttcgtccatggtgcggcgacttcttgtaatgcagatgtatttgcgtatgccgcagcccaagtaaaaaaaggattagaaacagcaaaagagcttggcgccgagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatacggcttagacaatcattttaaattaaatctcgaagccaatcatgccacattagccgggcatacattcgaacatgaattacgcatggcgagagtgcatggccttctcggctctgttgacgcgaatcagggtgatccgcttttaggatgggacacagatgaatttccgacagatttatattctgcgacattagcaatgtacgaaatcctgcaaaatggcggtcttggaagcgggggattaaactttgacgcaaaggtcaggagatcttcttttgagcctgatgatttactatatgcccatgttgcagggatggatacatttgcaagagggttgaaagccgcccacaaattaatcgaagatcgtgtgtttgaagatgtgattcaacaccgttaccgcagctttactgaagggattggtcttgaaattgcagaaggaagagctgattttaagacacttgagcaatatgcgctgaacaatcagccaattaaaaacgaatcagggagacaggaacggctaaaagcgatattaaaccaatacattttacaggtataaccaaatgaaaaaagaagctccagatcccgccataaaagatgcaggcagccaagttcccggaattgcccgtcatgaagttactgttatggcgggtcatttcaacggaaatctatttagagaggaaggagtgaaaaaatgaagtatgtcattggaatagaccttggaacgagtgccgttaaaaccattttagtcaatcaaaacggcaaggtttgtgcagaaacgtccaaaagttacccgctcatccaagagaaggcgggatatagtgagcaaaatcctgaagactgggtgcagcaaacaattgaagcgttggctgaattgatttcgatatccaacgttcaagccggggatattgacgggattagctattcaggacaaatgcatggattagtactgcttgaccaagatcggcgggtgctgcgtcatgcgattctttggaatgataccagaacgacgcctcaatgcagcaggataaccgagacatttggcgatcatctgcttgatatcacaaaaaatcgtgtccttgaagggtttacattacctaaaatgttatgggtgaaggaacatgagcctgaactttttaacaaaaccgctgtttttctgcttccgaaagactatgtgagattccgcatgactggcgccattcacaccgaatactccgatgccgcgggaacgttacttttacatatgacccgcaaagagtggagcgatgagatttgcaatcaatttggtatttcagcagaaatttgtcctccgcttgtggaatcccatgactgtgtaggatcgctgcttccgagcgttgcggcgaagacagggctgctcgaaaaaacaaaagtgtacgctgggggagcagataatgcttgcggtgctgtcggagccggtattctttcttccggaaaaacgttatgcagcattgggacgtcaggagtcatactttcctgtgaagaagacaaagaaagggattttaaagggaaagtgcacttttttaatcatggaaaaaaggattctttttatacgatgggggtcacgctcgctgcagggtacagcttggactggtttaaaagaacgtttgcgccgaacgaatcgtttgaacaattattgcggggggtggaatctgttccgataggagcaaatggactgctgtacactccttacttagtcggtgaaagaacgccgcatgctgattcatctattcggggaagcttgatcggaatggacggagcccataaaagagagcactttttgagggcgataatggaaggcatcacattctctttatatgaatcaattgagctattccgcgaagcgggaaaatcagttgatacggttgtctctattggcgggggagctaaaaatgaaacgtggcttcaaatgcaggctgatattttcgatacgagggtggttaagttagaaaatgaacaaggtccggccatgggggctgcgatgttagctgccttcggaagcgggtggtttgactctcttgaagaatgtgcagagcagttcattcaagaagcagctgcattttatccaaaagaacaaaatgttcaaaaatataaaacactattcgagttgtataaaaacatttacgttcacacaaaagatctcaatacagctttaaagagctttagacaaacctaattttcaggaggtcaaaggaagaacaataaacggccactcattatcaatggccttggttttataaatctgttaacaaatgagaaagccggcattaataaatcatggaatgcaattctttctcccgcgcaaaacattaagcgattacagtttagggatatcaaagcagcggcagcgctaaaataacttcaaatgtgttaacactattgaaggaaacagataagcattcttgtaagttttgactgcatcagtctaaactcatatgacgatgaaatgagaagtatacacacaaaacatcccctcacattgcgcgggggatgttttttattattgagattttcctgtttcttgaatccgtggggatagcctttctgcaatggattcacaggtatcactcaacttcaggagttccttagaaaatgaagaaagaacctcgccaaattggccaggttctttttatattgcacaaaaacagacacggtgatataatcagaacacgcgcgctttctgtgtgaaaagtcatagttatccaccttatattatgattgtatcatgctgaaaagctcttgtcaaatttttttgaaggggagatatagaatgagttctttggttctcggcattcacgaaattgaaaaaacacagcctttgctcgttggaggaaaggggttacatttaggagaattatcaaaaattcaaggaatacaagtaccggaaggattttgtgtcacaaccgccggatatcgaaaagccattgaacaaaacgaaacgttacaagcgctgttggatcaactgaccatgctgaaagcggagaatcgggatcaaattggtgaagtcagcaaaaaaatccggcaaaccattatggaagcagaaattccttcagatgtagtcaaagcagtcgcttgccatctctcccggttcggcgaagaacatgcctatgccgtacgttctagtgcgacagctgaggatttaccgcatgcctcttttgccggtcaacaagacacctatttaaatattaccggcgtcgatgcgatcttgcagcatatcagtaaatgttgggcgtccctatttacggatcgcgcggtcatttaccgtatgcaaaatgggtttgatcacagccaagtttatttatctgttatcatccaaaggatggtgtttccccaggcttcggggattttatttaccgctgatccgatgaccggaaaccgaaagctgctgtccatcgatgccggttttggacttggtgaagcactggtctccggcttagtatctgccgattgttataaagtacaggacgggaaaatcgtcgataagagaatagaaaccaaaaaaaaggctgtctatgaacgaagagaaggcggaacggaaacacgggagattgatcttgatcagcaaaagattcaaacactgactgatgaacaaattttacagctggcacgtatcgggagacagatcgaagctcatttcggccagccgcaagatatcgaatggtgtttggaccgcgatactttttatattgtccaaagtcgtccgatcacaacgttataccccgttcctgaagcgaacgatcaagaaaatcacgtctatatctctgtcggtcatcagcaaatgatgacggatcccataaaaccccttggattgtctttttttctgttgacgactgctgcacccatgcgtaaagccggcggaaggctatttgtcgatgtcacacatcaactggcatcccctaatgtcagagaagttttcttaaaaggtatggggcagcacgatccgctcttaaaagacgcacttatgaccataatagagcgagatgatttcattaagccgatacctgataaaacggcgccgattcccggcaaaggcaatgcagatatgccggttcaagctgaaaacgatcctgcaattgtttctgatttgattaagagcagtcaggcatcgatagaagagttaaaacaaaacatccagacgaaatcaggatctgatttatttcgttttattttggaagatatccaggaattaaagaatattttatttaatccaaaaagttcggtgctgattcgaactgcaatggatgcttcatcatggattaacgaaaaaatgaacgagtggttaggtgaaaaaaacgcagcagatacgctttctcaatctgtaccccataatattacttcagaaatggggcttgcgctattggacgtcgccgatgtgatccgtccttatccagaagtaattgcctatttagagaatgtaaaagatgatcactttttggatgggctggtgaagtttgaaggcgggcgggaaacccatgacgctatctatgcttatctcaacaagtacggaatgcgatgtgccggagaaattgatatcacaagaactcgatggagcgaaaaaccaattgcacttgtccctatgattcttaataatctcaaaaactttgagccaaatgccagccagcggaaatttgagcaggggcggcaggaggcgttgaagaaagaacaagagttattagaccgattgaagcaattaccggacggtgaacaaaaagccagagaaactaaacgaatgatccaaatcatccggaacttcagcggattcagagaatatccaaaatacggcatgatcagccgctacttcgtttataagcaggctttactgaaagaagccgaacaactcgcaaaagcgggggttattcatgaaaaagaagacatatactatctcacttttgaagaacttcaggaagtcgtacgcacaaataaattggattaccaaatcatcagcacacgaaaaggcgagtacaaagtatatgaaaaactatctccgccgcgtgttatcacgtctgacggtgaaatcgttacaggcgagtacaaacgagaaaatctcccggccggagcgattgccgggctgcccgtttcctcgggagtcatagagggccgggcacgggttattttaaacatggaagatgccgatttggaagatggggatatattagttaccccctatactgatcccagctggacaccattgtttgtgtccataaaaggcctggtcactgaagttggcggactgatgacccatggagcggttatcgcgcgtgaatacggcttacctgcagttgttggagttgaaaatgcaacccaattgataaaagatgggcagcgaatccgcgttcatggaacagaaggctctattgaaatattataatagcgggtgtgtgcacgtcaccagctatttcccgcatattaactgacaaataccgaacaaaaagaaaagccggaacctttcagaagaggaatccggttttttatgtgaaaatgatttaatgtgagaacaccgcattttgtgggcggacccttacaaaaaagattcagtggctaaatctaacgatgacaattttataaaggtgagtaatatcctttttaagttcacagcctctgtaatcctgatgaattaaaaacgccttagttttttaacaactatttaggggttttgttcatgaacaagtctttattctgaattgaattgttcgccttattcttcatagcggcaatattggcgcaggcaggggagaaaactctcccgcttaccagagtgaaaataaaaaatgtttatcttagatagatttttttaaaaagtaaaaacgccataaaacttcttatggcgtctgtccgaactaagggatgcaatgtttgggagacgaatataaatcgtcaatgtgctagaaaaggaatgcagcacctacaatgattaacaaaatgaacagcacaacgatcaatacgaaagaacttccaccgtaatttccaccgtagttccccatattattgccacctcctgttgttaggatagtacataatatgccggacgataaatttcgacatagatttaagtctaaataagaaaaaatggatattaagcctaaaatgaagagcttctaagaatatgaaataatggaaagagagaaatggatgggacgggttgctgtttaaagaggagggatatggctcaacatgcaataaaactgtgtatgaaagtggtgagccatgaagttacttcatcatgcagagccacatacgaagaggtacagggaaattatagttaacgaaaatattcatcatttcccgggcaagcgcagtatacgacaaatcaaaacaaatcacaaagggacagaaggtacgatacaaggaggctgcttgcgggtttgtggtgcagataaagtttccgtttcaaaaaggtcatatgtttattcgacactttacgtttatttctgcagaatgcttggaaaagaaagtcggcaaaactgccgactttcctaacggaatttagatctcaacagatctaaagaaaccatcgacactatcaccggtgccgctatcatatttcaggatgtattctcctttttggttaacgctgaattcttgaatgaacgttttccccgcatttagtgtcgtagaggataagagtgtattcccattaggataattaatggtgaatttgaaagatttgctgccgtcattcgctacaaaaactctgatttttcctggagagctgccttgatagttgaatgaaatcttaccggtaccgccagaaaaaggctgacacgcaatatacggagcgtcacatgaccaaccggcaggtttcatgactttatcttgattcggcaaagattttgcagaaacatctgcagcccccattagcggaattaacccaaaagcaagagcgccggcaataattttctttttcattcgtattcctcctcttaatagtgaatgtgatacagttataaatttacaatatttataaaataattccttctttttcaagttgagagaagaagaaaaaatttaaagaggacaaataaatgtcacaaattaacaatctctacactgcagtaaactggtcaatgcatgaagatgattttacgctaatgttttacaaggcgatcttctcactgtgagttaaagaacaagacgattgttaaccctgtgcgggtacgtaacaactggaagaaagtaaattcccgggcaaggagtatttctttaacctgaaacttttataaagcattaacgtattactttataaaggtaaataaggaggcttctgaatgggattaaaaaatttctttaatactgagctaaaatgctctatctgcggaaaaacattaaaatcaggggatgagataacagcttatcttacacttccgagtgagaagaagatgcctgtggggagaatggacaaagtgttaagcaaacactctgataaggtctgctgtaaaaagtgcagtgagtaggtttttagtgttatgaggaacctctggtgggtttccacataacagctacgcttcggcaatgaatgacctggcattatattggtatcagggttagttcaggcagtacttgcaaaatgaatgtccgccgaatggtctgtaaagtttcttttctgaactaaatgacaaagtctcattcagtctgggtggggcgcagagcaagaatagagatcaaaggctgccgtatcattcccggcagccttaatgattaggaagtaaaatcgataaccatgcggccggtcactttgccttgctccatttcttcaaaaatatcattcacatcttcaatcgggcgttttgtcactttaggtacaactttaccgtctgcagcaaattgaaaagcttccttcaggtcttctctggtacccactaatgaacctactacctgaattccatctaacacgagacggggaatatctaaatccattttgtccaccggtaaaccgacggcgactacgcgagctcctgcttttacaacatcaatcgcttgattgaaaggggttttagagacagccgtgatgaccactgcatcaagccctaaatcgttagtcacttcttttgctttagcgacggggtcttcgtttaaactgtttacaaccgcatcagcgcctaagctcttagcaaaattcaatttttcatcgctaatgtcgaaagcaattactttagcgttaaagacattttttgcatattgaacagccaagttgcctaaaccgccgactccaaatacaccgatccattgacctggcttaatttcactgactttaacggctttataagttgttacacctgcacaagtaatgctgcttgctgctgcagggtctaagttttccggcacctttattgcataatcaactgctacgattgcttcttcagccattgcgccgtcaactgtatagccggcattttttacatcccggcacaaggtttcacggccagttaagcaatattcgcagcggccgcagctttcaaacatccaggcaatagagacgcggtctccctttttcaaacttgttacgccttcaccaatctcagttacaatgcctattccctcatgacctaaagtgatgcctgtaacatccccgaaatcagcatttttaacatgcaagtcagtatgacatacaccgcagtattccatcttaactttggcttcaccatgccgcaaaggacgtaattctttttgtacgatctctatacttttgtctttcgttgctactactgctttcaaatcatacacccctttcaaatattcgcagaaaatttttacttatcttacaatttagcacacgactcttcttttgaaaacccttacatttttgcggacaagtgtctctacaaaaattgagggagctatgcagggaggattctatggatgatttgtcatccgaagggtgttttaaatggggggttgtcatctccaaatgcactgaatgctttgaatttgtgctcataatctttctatagatatttgacttgcactgcagagaattacaccggcaggatatgattttacccttagtgaaaagaatttcacgggtaatcatttgaacttgagctcggctgataaggtgaatggtgatgcaaacataaatcattacttattgatcacaaaaggagccggctgcggagatgtgtggatttcacggattcgaacacgatgagccggatgcagattggtgagcgatacacagtcaaggtatttccttgaccttttttatgggtatactgataattaaaagtaatcatagtatactaaagttacaataaaagtaacgaaatacaaattttaaggagttgcataaaatcattcttttaaagagaaggggatcaggttggatcagttaataaatcctacgaaacattctttttattttaggctaagtaaacatgactgttataaagttagaacaggaaagtgctccttagatttaactgataaggaatttaatgctttagaaggcgaagagcatgaatatgcattaaaatgcagaagattggctgcgcactacataaaaccggacatgcataaaaaacattcaggaatatatgcaagcgtaaatgcttgcggtcatatttcgtttagtgatggtcagcacaggatgtgtatctgcaaaaggtcaggtgtcgataaattacttattcatttatcaaacaacggagattatatatgtcatatatgccaggacaaaaacaaaaaattaacagttaaagaaaaattgaagcaaaggttttttaaaaaggattcgaataaacttgcaagagaaaatgattttattgatgatgagttttttgattaaaccaatcttttatttcaaatggaggggtacatttgggtatactcaactttttcaagaacaaagttaaaaatgaacaaaatgagaataaaaataataatatgaacactgttggcgttaataacgaaacagagatggtatcgaaaaaagaaaatttcccaatcttgattcaagagacaggcttctcaaggaaatatgaagaaaagtctgcatttttcgagtatatagactttaaggttgcaggaacatcacactatcaaaaagatattaagaaagccatcaagactgaggatgaagacagctttttcttcgatgaaaaatatgatggtatgacaaataaagagattctagaatcaacttttgatgagccgatatttatttatcataattcccttttctcaaattgtgaattgcggttagaagagaacaacaagtacgatccggaagctatagctgtctatgtaaatgattgcaaagtaggacatgttcctcgaaagaattttcaagaaggcaagaaatacatttacgatcagttaaagagtggtataaggcacccgatatcagcaagtttgtatggagggaaatataaagttaaccgcgatgatacaaagattgaaacaggagaaacagattataaaattgaatgtcaaatagtgattaaaacagacaaatagacaataaaactacgatattgtaagtgcgaagtaaatgaacggggcggtgacttgaagctgaattcaacaagattaaagagctatacctacacattggctttttcaagtttgtcgtatggtttgattttcgggctatatatgtttgtatactcgggttttgtgccaattgcattggttactgtagttatcattgctttttacgcattcattacttactttttgtttgctgttcctgtgcaactatggctaagaaagaagcctaaaaagtttagtttggttcatcttttcatttataccgcagtcgcttttttagctgtgttcttgttctggcacataggtaatccgtcaattgatttcacggttttcagaagtttcatttattacataatgagcattgctgctgcgttcatatattggtactgggactctatatttctgagaaattacaatgttcatcggaagtaaagctgatgtttccaaaagaaagcgggtgaggaaaaatggaatacattgagttgaccagggacaatattgatgacaatcatatttgctgtgcgttaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagcgcacctcattttatgtttattaattgcctttgggtctcaggtaaatataagaataacggacatgcaaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttgatgtcactgacgtggaatgaacatgcacatcctcctgtatttaaaaaacaggtgaaaagtaattccgttaatgatgagggaatcacaatattttatacagctcaatgcccatttgcagtcggagtgttaaagcatttaaaggaactgactgaaaagaaaggacttcattttcaggccctgagaataacgtcaaaagatatggcgcaaaaatccccggcagtttggacgacttttagcatgttttataaggggggcttttctcactcatgagatgatgagcgtaaataagtttgaaaaaatactcaataagcttttaatggcttaactttgttttattactattgctcgtttttatattcgatactgagggtttttcacgaaaattgttcagtactttacattgcgggcggcaaatgaatgattattgtttttgacaaagatgataacacccatcattatagtaaaaatagattgtgataagttcttcaacaaacgaagaagttcttttcaaaggtcgataacaatgaaacaggagactgcaaatgcaaaaaattgaaacccatcgcttaattttaagaaattttaccgagagagatgcacaaggtctgttggaatattcggcacatccgagagtgaattgttttcttgatgacagaatatctacgttagaagaagctgccgtaaatgttcaaaaaagaagccgagatgactcttatattgcagtttgtttaaaagacagtaatgatctagtcggagaactattttatttaaaagaagagccagatacctattccgtttgttggaatttcaatgcccgttttgaaggggcgggatacgcaagtgaaagtgcgaaggctttctttgagtatctctttatgcaaaaagaagcaagaaggctttatgcatatgttgaagatgataactgcaggtcacaaaaactatgtgagagattaggaatgcgtaaagaaggttattttcttgaatttatttcatttactgcccacgaggatggaacacctaaatatgaaaacacttaccaatacgcattgctaaagaaagaatggttaaaacaaaaacatagttaatagaatttgtggggaaataatctcccctttaccgaaaaaaccctgctgaaagcaggtttttttaagttaaatacttcattaggttacctagtaacgatcaaaaagattcagcttgaaggttgggaaaaacatgaaaatcattatagcaatgttgtaaaattagagagaggatgattgtgacggacattttgcagtttagcgacagaaggtgcaggaagtaatttgaatcagcaatgttcaattcattttgatgaatttaaagaagcgcttgataatcaaaatgtgaaaagcagttcagagtcaagacccattttgcggtgagaccggaaatatgctcttcatcttctgatgttgttcaaagctgacacctcttgatgcttatgtataagaaaataataccattgaaatatatgtataaggttggaaacggaggggatcaaagttggtgcgatcttgtgtaaaagaaaggatcaggatgaatgtgaccagcatccaccctgatcaatggggttcacagtgttctatttcattgtattccaatcggaataatattacaagggtgaaaaagaaataagcggaatgttttcggcttcttctgtctctggagcgggaaacggaaagtgagatgtttgaatgaaaataaatgattatctgaaggaaaggtttccgactttaaaattagtgcccggcatttatcatcaatgggacgtgggaattcatttttctctcggcggcaatatgtatcaatttaatgaaagcggtgctttgaatcttgagtattttcagcttgttcatcatcaaaccgccgcacttttcaatgaactgtttgaacatagcgatgacatgtaccttgttgccaacgtatataagcacaaaactcaaggtaatcacccgagaaaattaaaggtttatcagccgtttctgaagtgtaaggatgatttatatcggatccaggtgaagacctgcccctgtccgtttgaagaagatgatgcagaagaatatgaaatgcagcagttttctttattatgtaaacggaaagatctgcgtattccccaattacttaaggcagccgtccacgaagattttccgctgaagccaaggttcgggggctgttccgttgggtatcccgatgttttctttgtgaatatgacaaaagatattattttctttctgtatgatgacagagggtgtgaagtcatcgctcttgatgccggaagaataggaaagctttatgatcaatatcacgattggattgaattggactgaaaaaacgaacacatgaattcgaagccgcttgtgccggctttgttcttgcctagtccggctgcatgagtataatgggcagaattgaagggcgccggaaactttttttcctctcataccggccttctgcatgttaagcttctgtatttattttgaataaattcctatttataaaacggctgaatagaataacataaaagcttttttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaactggctgacgacgcagggcttgatgtattcggggtaggcgagcatcatcgtcttgattatgcggtatcttcgccgccggccatcttatcagcgatttcacagatcactgaaaatattaagctgaccagtgccacgaccgtattatccaccgcagatcccgtccgtttatttgaggattttgcaacgcttgatctgatttcagacggccgggcggaaatcattgcgggacggggcgcatttttagactcgtttcctcttttcggttatgacgtaggccattataaagaactgtttgaagaacacattgacctttttttaaaattaaattccggggaagaatcggttacctggaaaggacgttaccggccgccgctgcgcgaggcagaaatttctcctcggcctttttgcggaagcattccgctatggttaggtgtttcggggactccggaaagcgcagaacgagccgggcgtgcaggtgcgggtttggcattagctgtactgagcggtgatccgatgtcatctaagccgcttgttgacaaataccgggaagcggcttctaaagccggtcatcctccggaaaatgtgaaggttgccgtgaccggacatatgttcatttcaaaaacgaatgaacaggcaatacaagaattttacccgtatcattcaaattactggtctcacgttcattcatatcacgggatcgatgagcctttaacgaaggaagattttgagcgggcgtccggaaaagaaacagctttatttgtgggaagttcacagcagatcattgaaaaaatcatgcatcaatatgagttgttcgggcatcagcgatttctcgcgcaaatcgatataggaggtatgccgtttaaaaaagccgcggaaaacatcgaacgattagcagcggaagtagcaccggttatccgaaaagaaacccgcaaatccagagaatgaagttctgagcataaggggcgggccggtttttggcaatcgcggattcgaaaacagaatcggcccggctttttctttatgattataaaaaacaaaggggaaagcgcgaacctcattgctttttcctatcaagaaaaggaaggtcatttcatcctctatcgtgaagtgtatataccgaaagggttttcattaacaaaaaagggaggatgatgaagtaatgaagggtttggtcaaagctgcagttttaactgttactcttgggattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggccgaaaggatttccggctgcaggtccgccggatggaagaattgcgtctgcaaatgggggatcgggacaaattgacttcggtttagacaagcagactgcagattattgggtaaaacaaaacatccgcggcggttttaacacctttacttggtactacacggctcctcatgcgacatcaaagtggcactattatatcaccaagaaaaactggaatccgaataaacctttgtcaagagatgaattcgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaaccttacacaataatctatgaattactgatcggctgcatgttcatcggccgatctttttagttttaatgtgtgaaagaaaaggggaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatactatgccgaaatgaaaagtttgatagggatgctagtttactttttgaaaaaaggtttcttagtctatatttcctttacatggccatccgttaaaatgagtaaaaggaggaatcgtactgcttcctgtaatagaaacggataggctcatacattgagaagttgcgaagaggatgcgcagttggcttgtttttttaaaaatgaaaatgtaacacgctattaggattggaaccttttgattcaacggaacaggctgaagaaatgattggttggtttcaagagcagcagcatgaaaaaagtggatgtgatgaggaatagagaaaaaagatgcgaaaggcataatcggaaccatgtatcaaaacggactgcctggtgatatacgcgtatactccattccgaatgggaacgtaacgatctaaacagaagaacttcaagtgttctgcggtaaataaaaaaagccgatgaaggcttaaaattgattagacgctgtaaagcattctttccgttgcgctttctgcagacggagtttgattgtaagaaacgattccgatcatcactaacaagataatgaaaaccaatatgctccacaacactatttttaaagactttgacatggcataccctcactttgaaagactttaccggggctgcgatcggagcccgcacttcaagtatagtcgttataacggtgaaaaatgtacagtatcccgttatcaaaataaaaacttgcgggcgctgccgcaagttttctctgaattaaggtctgtggaattcaatatgctgattatcacgatcgaaccatcctctgaatgcccaattgatccagcccccgtctcctttgttatcaaaggaaccgtcttcgaagacccagattccgtaagtaatgccgtcataaacggctgatccgtaaaattgaacgccgttaaagcggtcttcatattcttgatttaaattgaacaccatgacgttgtacttctgtcctgatgcgtaaaatgttgtttccatgacattttttacccagccggttcggttttgatctgacttaaccgcttcagcaatgcgatctgaaattccgagaacatctacgtttacgttcagcccgccatcaacacctgctgcttttacgttttggcctgctgtttgggataatttactttctaacggatttgcaacgggtgaaacgtgaggcgcattcgggtgttcagactgactggctgctgaggcactggctgtgaaaggaattgttagagataaagctaagcatgatccgactattgttctggcgattttcatgtctatgacctcctgaggaaatttttaaaaattgttgcaaattcatggtatcgcagaaaaattgaccaagcaaagagcagattttctcaaaagtcatgtcattctatttatgttgttttctgtaaatgaaatacttttaatcaggcgaaaagggaagaaaataatagagtctttttatgtattgtgataggatgaccggattttgggtgaaaatagcccggagaaacgtcataataagaaaaacacccgggatttaccgggtgtaaaaagtgttgatatgtcaagtcagcagcattttttgcattttcttttataaacaacgatgtaatcataatcaagatgctttttatcttgtttcttctttttcttcttttgtttaggctgctttggctggtgatcataatgtccgttcatatccatacccatatccatactcatactcatattcctccttttttcatctgacggtagtattctatgacagaaagcatggatggcttggacaaatgaaacggtatgctgaaaaagaggcatctcattcggtataaaaaacaggatcatacccgcccgatagaaaagagagaagatgatcctgatattgagatcctatttgataaccgcaattgcaatgccgtaccctttttcagcgctgtataaggccgtcagtttcaataccttccagccttccgcggctttagtcccgattccgttatgagccgtgatataatctcccgggctgaccgtactgtcgacccgtacgtaatgccggccgttgagtccgacaatatgccattcgtctctggccgcgcgtgcttcatagtcagcttcaagagccggactgcagtccgggttttgtttcggtacgcgtactgtttctcctgtttcttcgtcagtcacattttcgtatatgaaaccgccgaactcatttgtcaaaaagcggctttgccatccgaagcttgcggctcctgagataaaagcggctgtttctgaaatgacgccgagcatgtaatctccgacgtgagccggttcaattttttcgcctttcactgtgacgatcgtcccggcgggaatcgtctggccggttacactttcaaaatattctccgtaccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgccgcccgtaatatggacattgtttgaagcggcgataaatgcccttgaaccttcggaacttgaacctccggaagagctgatgatcgcatttctgtcacctctggccgtaatatcgcctgttcccgcaataacggcgcttgtcgggttgaatgcaaaaccggagctggtcgcgagctgtgcgcctccctttaaattgacggggatctgctcataagtctgtccttttatagatgcggccgcgctgtaaccttcagcttgcaccccgagaatgacagcctgactgttaggggacgtaattccgacggaaccgccgtctccgatcatcgtaccgttcataatatttacgttatattggcctccgccgattgagatgcctttaggagaagacttgtatatatcaaaatttaaaattttaacatgatcggttttattagatccgccggatatattgatgtcaaccccggcttgtgtaaagccgcgtattttaatgccgttgatcgtaatattttgactgcggtattgaagagccacgactgggttcccgccatagtcgtatgatggatcaccaatagctgtgaatccgtttacattgacgtttttataggcagagatgaccagcgccctcggggtcacaccgtcatagagggcattgaataccggttcaatcgcggtgcaatcggttaaagtaacatcataagccgtcgtgctttcggggtctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccacacatgtttagagccgtcgtcaatttcaatgccgttcgagtttgcgctgccctcagcatgctctgtgccgcgggggtttccggaatggcagttggaaatgaaaatatattcgctgtaatgggtggtaatgccgtcgtctccggcgccgtatgccacacagttatcaatccatatataacggcagccgtctttcgtccattctgtttcaggcaaatgatcgtaagtcggagatgtaatatctataccatgcagacccgcgttaaccgtttcaacattcttaatccagccgtattgcacattagcaaacgttaaacagctggaacactgtcctccggggttcctgactccgcattgacggtcaggattccagtctaaagtcatgttctggacaaaaatattacggtttccattttcgtaatcatcgttagtaatgacccattcgtatgcgggagtgtcctcatgaagcttaagcacggtaatcccttgtccctcaccggaaatagtagtccatgaggggagttttatcccttgaaccaaaaattctcctgcgggaacatttactttgacccggccgttcccgatcgctttccgaaaggcttctgtattgtcccggccgtcagggaccgctccgtaatcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggctgtgcagggcgagactgcaatggggcgtttaaagacggatcaggaaagtttttaaattgaaccattctaaagacacctctttcttttgatataagcgcctgaggcaggtgacagaaaagaatcgcgcgccctttaagcgcttattcttcaaattctttattcagaacgaaattccttttgaaaccgaggcgaaattttaaaaaagctctgttgaaagaacggacatatagctttgcattattgtaattgaaactgtcatgtgaaaatggagggaaaaactgataggaggggtcctcattttaggtttattctcattgtcttcgccgtgcttcctcttcggctgcatatacaccaaaatcagcattcttatcagttaaatggtataatggggcacggattggtcatcaatacgactgaaatagggaagcaaaaggagcagcgaacatgactttacaaatcaaaattaaatattcagatgatacgcaaacgagaatcagtaaaattgaacagggcgattggattgacctgcgggcagctgaacatataacaatcaaaaaagatgaattcaaacttatcccgcttggagttgcgatggaactgccggaaggatacgaggcccatgtcgttccgcgttcaagtacatataagcatttcgggatcattcagacaaattcaatgggagtcattgatgaatcttataaaggcgacaatgacttctggttttttcctgcattcgcgcttcgggataccgacatttccaagggggagcggatctgccaattcagaatcatgaagaaaatgcctgaagtggagctgatcgaagtagacaagctcgggaacaatgaccgcggcggactgggatcaacaggcacgaaataaaacgaaaaaaagactgcttaacagcagtctttttttatggatacagcagttacattcaaattttttcggggattcttgaattgggaaatcaaacaaaactaaggagaagggtttcatttttatcatttaagctttccgtctctttgaacagaaagacttttttaggttaaaggatagaggttgttttgatgtttttattcttcaagatgaacggaggttttgtccaacgtatataatattgtgacaaaagtgtaaacaaaagaaaggatgatgttatggaaaaaagggttagaagagtagaccgtaaagcagccggcaaagaggcagagcagaagaaaccgtccaaagtcaccctgttctgccgttcgcttcaaaggctgaagcatttgtattgtaacataaacatacaaatgccatcaataaccaaaaaaggaatttcaattttaattttaccgtttttgcttctgccgttctttcgggctgatgccgcttcagatctttacggcagtttcgaggaattaaagctgaatgaagatccttccgatttttccatttcaacgcgggagcatgacccttctgtcctcatattagctatacacggcggaggcatagagccggggaccagtgagttagccagagaaattgccgaaaaccggagtttatatttatttgaagggttaaaatcagccggtaatgcagctctgcatttgacaagttcgcatttcgatgaaaccaaggccgtgcaaatggtgaaagggcactctaatgtcatttcattgcacggttacggcagtgatgataaaaagataaaaatcggcggtacagacagagaacgggccgaactcttgaccgatgtgctgaaacggcacgggtatcctgccgttcttcttggcacaaatgataaatacgcaggcgtcagtccgaacaaccttgccaatcaatcttcatccggattgagtattcaaatcgaaatgagcaccggcttcagaaaatcactatttgacacctttacgctgaaaagcagagcatccgcacaaaacgggaccttttaccaatttacaaaaacgatttctgattttatcagtggcaattattaataagcacgcttattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctggtgcttagtccaatctttaaacaagtgggaagcggagccaaaaaattaaaaaagtcatgggaggaagaagatcagcatgagcgaaaataagcgcggaaacacaaaaaaaattctcggcggtgtgattataggtgcagcccttttaattgcgggcgtcacagcgtcactattcattgaaaaaataccgaacggttatgtcggggttgtatactcaccgaatggcggggtaaaatccgacacattggaccaaggctggcacttagtcggattatttaataaagtaacggaatatccggtgcgtatgcagacagtgaataatgaaaatataaaagtggcaacctctgacggtaaaaatatagaaatggatatcgcttacaactatgtcgtgcagcctgataaagtagtcgatctgtttaacaaattcggggcggtagacgttgaaacgattgaaaatacatatttaaaaacaaggctgtgggatgcggcgcgaaaatcaatcagcaaatactcggttattgacacatacgggcaaaaatctgctgaagccgcggccgatgttcaaaagagatttgctgatgatatgaagagtcttggatttttaattgatgatctgacgcttggcgtaccgaagccggataaagccacacaggaagccatcgatgcaagggtgaagtcttcacaggaactagaacggacacaaactgaaattaaaatagccgaagccgaagcgaaaaagaaaaaaattgaagcggaagggatcgctgactataacgaaatcattaagaaatcaatgtccgatgaaatgatcaaatataaatggattgaaaaatgggacggaaaaacgccgaaagcgacaggcacagactcactgctgcagctgccgcttgacgatcagaagcaaaagtaaaaagagaaggaggcgattgcctcctttttatgttttttcctgagggtctttttccggcactaattcttcagacgcctcggtttgatagctccatagcgtgctatccgtctctgttgtgtccttataatcttcgggaagtacaaattgctgcaaataccggtgaaaaaatgcctcaaaaacagaaatgcaaagtgcagagataaccgctgccgcggcaggagagacattaaacctgccaatgttcatcaggaatatccataatataatgaatgaaattccgaaatcagctgcaacggctgtgaaattgcttgttctcggcagaatcatgcaatcacccgcaaaataagtgattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttagtcttcattgtaagcaatccgcaaatttttaaactggtatatagtggttataaagtaaaatgtgaatagacatcacaggattcacaagttaaaatatgtaaaaaggggggtgcaaatgaaaaaatactggatatgtattgctgtttttttattatgttttagcggaatacactcagctaaagcggctaccactgaattcggatcaaaaacaagcttcactttggagggaaacgcaaaagagtttcatattgaaaatccgggtgctgtagctgccgacgattactttttaggatataagttcaccataatgaacaactcttcgtgcggtttaagcatgaaactccagcggatggcgctgaacggaaatttttatacattaagttctaaaaactacagcggcagctggttaaacctcagtgcccaggataaaaaatcaattgatccgtatcacaaatacaggattctggttgaaagttcttcaaacgtctgtggtcccgtctatattaaagggttctacggtgtagaatattatcattttgattgaaaatagatactcgctaaaggcagcgggtttttttatatctatatttaacttattacactatgtactaaatattcatatataaatttttgacgtgcccgcccaaagaaaagataaaaaagcaaattcatcacgcacaaatatataaaaagttgaaaaatggatgaaaagtttcttgagggaaacattattagttgacttcaaaagtgagatgtcggataataagaatgtaagtttttcctccttagcaggttcgtttcttaagccagggcgaatctgctttttttatgcaaaaaaaccccttacagaggggttttttacgataaatgaagtttaatagaattaatggacggctctgaatacgccgatcactttccccaaaatgcttacgttttgcaggataatcggctccatcgtcggattttccggctgcagccgcacataattgtcttctttatagaagcgcttcaccgtcgcttcatcatcttcggtcatagctacgacgatttctccgttattggccgtgttctgctgtttgacaatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatatggacttcttcttcatccaatacctcaatcgccctcggtttcgtagggtcccgtctgatcaggccttttgtctccagccgtgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaaaacgattgacagaaacatttgttcgtatatactgaaagatataaaaagcgaacaaacattcttatcggaggttgtttacatggcgaaagaatctatcatatttgtcgggctgtttactgcgattttaagtgccgctattttacttgtttcatgtgcgggaaatgatcagtccctcagccaatatgttaaaataaaggttcaggacggcgatacactctggtcacttgcagatcatgtagcagaaaagaaacacattaataaagaagatttcattgagtgggtgacggagaataatcatctccaaactgctgatataaagcccggagacgaacttattctaccggttaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaggagctcagtgagatcgctgctgcaaacggcatggaagtcgtgaaagtcatttctgagaaagccagcggttacgaaatggaccgcgacggagtatttgaaatgcttgatgaaattaaaaaatcacatattgacgcgatattggtgcaggacgaaacgagattaggaagaggaaacgccaagattgcgcttttgcattgtatttacagggagaacgttaaaatatatacgacggctcataaaggtgaactggagctttccgaagctgattcgatggtacttgaaatcgtcagtattgttgaggaatatcaaaggaaaattcacaatatgaaaatccggcggggaatgaaaagagccgtgaaaaacggctacaagcctgaacggaatctgaaaaacagacatgaaaacagcggaaaagaaaaaaaagaggttccggtttcggaaattatcaggctgagagccaacaagcttacctttgcagaaatcgcagcgaccttaagaggattcggctatgacgtgtccaaagccacggttcaccggcggtttcaggaatataccgcagacacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacaataacggatgaggaaaaagctgaacagcaaaagcttcgccaggagtatttgaaaggattccgctcctcaatgaaaaatacgttaaagagcgtaaaagtgattgatccggaaggcaacgatgtcactcctgaaaaattaaaaagagaacaacagaaaaataatcttcactaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatacacgctgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcatacagccggagtagacgcaacgaccgggccgcttggacaggggattgcaatggcagtgggaatggcaattgcagaacgccatctggctgagacatataaccgtgattcattcaacgtagttgatcattatacatacagtatttgcggagacggcgatttaatggaaggcatttcttccgaagccgcttctcttgcaggccatcttgaattaggccgcctgatcgtattatacgattctaatgacatttccttagacggcgatttagaccgttctttctctgaaaatgtaaagcagcgttttgaagcaatgaactgggaagttctttatgttgaggacggaaacaacatcgctgaattgacggctgcaattgaaaaagcgcgccagaatgataaaaaaccgactttgattgaagtgaaaaccacgatcggtttcggttctccaaaccgtgcgggcacatccggcgttcacggcgctccgttaggactagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgcgcatcttcaggtgaggtgctgaacgggatcgccaagaaaattcctttctttgtcgggggatctgctgaccttgcgggttcaaataaaacgacaatcaaaaatggaggagacttcacggccaaagactacgccgggaaaaacttctggttcggtgtccgcgaatttgcgatgggcgctgcattaaacggaatggcgcttcacggcggcctccgcgtattcggcggcacattctttgtattctctgattatttaagacctgccattcgtctggcatcattgatgggactccctgtcacttatgtattcacgcatgacagtattgccgtaggagaagacgggccgactcacgaaccgattgagcagcttgcttctttacgcgcacttcctaacctatctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggaaaaaggggcttatatcgtttccaaagcaaaaaccgattcaccggacgcccttcttttagcgacaggttctgaagtcggacttgcgatcgaagctcaagcgaaactggctgaagaaaacattcacgtatctgtagtcagcatgccgagctgggaccgctttgaaaaacaatcggccgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaatcatgaaagaatacgggtttactgcagaaaacgtggttgaccgcgtgaaaaaacttctaaacaaataacgagacaaaagaggatgagtcaaatcatcctctttttcctgtttatgcgacaaaaatagaaggggcggcgtaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcatctccagctgcatttaaaccgaatgagttacagccgtttggattccatttaccggcttacactgcccggagaaaagggccgcgccaccttcatgatgaaagacagtttaattgagattgcggcttcgggagattatgaggcggaaacgattttctttgagattctgcgtaaaatcagcccctgttttcttgcaatggatttcaagacacggcgctacgggtggttaaatccggtcagagaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttattttggcgtcatgtttcaccccaactgccggtgtgcagttctttttggtattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgttgtaccccgcctttttatcttacataactggtgtcagtatggacgaggtgaaaacagaaaaggtgatgctgcaaaagcgtggcctcgtgcatacactttgttttttgcttggtttctccgtgatttttatcgcattgggatatggaacttcgtttatcggcagtttttttacccaatatcatgaagcgatccgccagtttggcgctatcatgctgatccttttcgggctgattactgctggcgtgtttcagccgaaattcatgatgaaagagcggcgcattcactttaagcgccggccggaggggtttatcggttcggttctgatcggtcttgcgtttgcagccggctggtcgccgtgcagcgggcctattttaggagccgtgttttcgctggcaaatacaaatccttcttcagcagtgccgtatatgtttttatatgttctcggatttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggtgaaaatcagagagattctggaatcggcaaattacacagtggccggggaagcggctgacggcgaggaagccctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtaacgggaacgtaaacgtgttctcttttcaaattggttttttttatgtttttggagtatagtatatagtatcaaactccgtgcaagcaaaggaatgataaagatgatgattataatttcatccgttattgcagcggccatggccatttccgtgatgatcgtcaggattaaagcctccgacaagcccgcttcacctaaaaaaataattctcccgccgattttcatgagtacgggagcgcttatgttcctttttccgattttcagagtgacgggcgaagaatttttggaggccattacgctgggcgtgatcttctctatttttctgattaaaacatctaaatttgagattaaaaataatgaaatctatttaaaacggtcaaaagcgtttgtgtttatcctgattggtttgctggttatcagaatcgctatgaaatccattttgagcacgacgattgattacggagctttaagcggaatgttttggattctggctttcggaatgattgttccgtggcgcatcgcgatgtttatgtcttaccgcaaactttcgaatgaactgaagaccgctgatattcagatgaattaaaacctttccgtccgccggaaaggttttttatttgagaagggcctgataaggagtaagatcaatctgtttttcgcggagatgcttttttaaaaattgatgatcacgcttaggagtggccagtatgtaacccctgatgattaaatcacggtttatttgttcagcttcctccgctaaggaaagttcaccgatttttccggcgattttcgctttggctacatcccgaaagagctccggtacgggagcgaccaattcatccaaaaacgccttgtcacccgcattccataagtgcctgcttttttcaatataatagtcctgccaatccagttctgaccggccgtcttctttcggtaagcgttttaaaaattttcgaaacataaaaaatccgccgatagacagcaatccgatcatcacgatgacccaaaataaaataaaccacataaaccagccttctagcattgttctatctcctccttactttaaccatattgtaaacgaagacagaatagaagaacacatgaaaaaaagaatagaaaaaatgatagatgtccagtcaattcggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaatgaggcaggagtctcattaggctccttgttcatggagacggtcagaatatggttggtgaaatcagtgaaaatatgtttgtcattcagataaaaaggaagcaccatttgtttgtttaatgtccgttcaagcgttttaacagagagcataaactcatttcccgaaagagtgacggtgatcgcctgcacctgcttcagggccgtcaggtcggcttcaatgatatattgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttaaatgggtgaatggcacaaaaaaacagacaccggggtctgttttacatatcgtggcttgtattatgtttttgtcttgtatggttgcggtttttcacttttttgcttccgctcagcggttccggctggccggggttatggcccttcggagcatttttatgcatatctttactcgtatttttatttgtcatgttaaagcctcctttttaaggtgttccggctattggtttgtttttctttttttattgttctgccgttcttcttccgtcaggacgagctggtcattttctatataacccgcgcctttgccttggcttttcgcatcattcatgccgttaattacatgattggctttccgttttaccatgatcatcacctcaacattaatatggctctttacagcccgttgtatgaggcggaaaatcggacaaaatttaccgaaaatattctcataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactactattcattaaaagcattggaagacgcaggggtcggcaatgtttcaaaacttccttattctattaaggttcttttggaatccgttttgcgtcaggtagacggacgcgtcattacaaaagaacatgttgaaaatttagcaagatggggtactgctgaattaaaagatatcgatgtgccgtttaaaccgtcacgggttattctgcaggactttaccggcgttccggccgtagttgacctggcatctttaagaaaagccatggcctctgtcggcggagaccctgataaaatcaatcctgaaattccggttgacctggtcattgaccactccgtacaagttgacaaagccggtacggaagatgcgttagccattaatatggacttagaattcgaaagaaatgcagaacgttataaatttttaagctgggcaaagaaagcgtttaacaattatcaggccgttccgcctgcaacaggtatcgttcaccaggtaaaccttgagtttttggcaagtgttgttcatacgaaagaggaagacggagaacttgtgacctatcccgatactttggtgggaacagattcccatacaacaatgattaacggaatcggcgtcctcggctggggtgtcggcggtattgaggcggaagcgggaatgctcggccagccttcatatttccctgttcctgaggtcatcggcgcgaaacttgtcggaaaattgcctaatggaacgacggcgactgacttggcgctgaaagtcactcaagtgctgcgtgaaaaaggcgtagtcaataaatttgttgaattcttcggtcctggtgttgctgagcttccgcttgcggatcgggcgactattgccaatatggcgccggaatacggagcgacttgcggattcttcccggttgacgaggaagcactttcttacctgcgtctgaccggccgtgaagaagagcagatcgatattgtggaagcatactgccgcagcaacggtttattctatacgcctgacgcggaagagccgatttttacagacgttgtggaaattgatctgtcaaaaatcgaagcgaacctttcaggcccgaaacgtccgcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgtgaagacttcacttgcaccggggtctaaggttgttactggatacttagtcaactcaggtctgcttccttacatgaaggagctcggctttaaccttgtggggtatggctgtacgacatgtatcgggaactccggcccgctttctccagagattgaagaagcggttgctaaaaatgatctcttgatcacttctgtcctgtcgggtaacagaaactttgaaggccggatccatccgcttgtcaaaggaaactaccttgcgtcaccgccgcttgttgtcgcatacgcattggcgggcactgtaaacatcaacctgaaaacggacccgatcggtgtcggaaataacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtataagtgggaccaggattccacttacattcaaaacccgccgttctttgaggaaatgtctgtagagccgggaaaagttgagcctttaagaggacttcgcgttgtcggcaaattcggcgattccgtgacgactgaccacatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggctacacaacacattggcctaccggggaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagttattgccgaaagctttgaaagaattcacagaagcaacctcgtcttcatgggtgtgctgccgcttcagttcaaacagggtgaaaacgcggatacactcggcttaaccggtaaggaagtcatcgaggtggatgttgatgaatctgtacgtccgcgcgacttgctgactgtcagagcaatcagtgaagacggtacggtaaaaacgtttgaagtcgttgtccgttttgacagtgaagtggaaattgattactatcgccacggcggcattttacaaatggtgcttcgcgataaaatgaaacagtagcagaatgaacaaaggagagaaagcagtctgctttctctctttttatgcgggaggccttaagatgcttgcgaaatggctgggcggaatgttacttatcgggttgttagtatatgcgggctggaacatttattctgtgcaaaaaagtccgaaagaagggacagaagaagggatgaaagcccctgactttacacttgatacattgtcaggaaaaagtatctccctttctgattataaaggaaaaaaagtgctccttaatttctgggcgacgtggtgcaagccgtgccgaatggaaatgcccgatatgcaggagctgcagaaagaatatcctgatattgcggtagcagccgttaattttacgtcttctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtgaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttgcacctccttttgcaaaatatactcttaaggagggatgaacatgggcataaacaagaaagacggccagccgcaatacgctccgagccacttagggacaaaacccgttaaatataaacgcaacaaaggggaaaagtttcatgacaagtcaaacggacatccgattgtcatgcagacgaaaggcgaataacatcatcaaaggagagcagacattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagaaaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcatgtgtcaaaaaaagaaatagaagtgcgttatgcggaaacagatcaaatgggcatcgtctatcatgccaattacttagtctggatggaggtcggcagaacggcgctgattaaggaactcggattcctttacaaggatatggaagatagaggagtgctgtcccctgtattggatatcagcatttcttataaaaagccgctccgctacggtgaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcacttatggcatttggaattacgcgtaaggaactggaaagatggaagcgggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcacctaaaaaggttcaggctgtaaaaaaaagaacgcatccgctgcgttcttttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggcaggtcttttaaaatgccgagagaaaagcctttctgaacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttcggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcccttaaactttgcgaacacggggaatacatggccgatcactgctgccacccctgcgagaagaggatgaatggggacgtgcagtaaatatgggagcgccgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattgcataggccaaaataatcaataaagcaatcaacatctacatttctccttttcaatgtcccttcactctattttaacacgagttgttaccgtctgatgacaagttttttgagaattaagctgacaaatcgctttttttgattccggcgaagcggtcatgtacaatatatcaaaaggagatggtaaagatgcaaaatccttcaaaatcagagattaaagaaattctggaccggagcaaacggatcgcagtcgtcgggctgtcagaccgtcccgaccggacttcttacatggtttccaaagcgatgcaggatgaagggtatgaaattattcccgtcaacccaacgattgatgaggcgcttggcgttaaagccgttgcttcattaaaagacgtggagggaccgattgatatcgtgaatgtgttcagacgctctgagcagcttcccggcgttgctaaagaatttttacagacggacgctcccgttttttgggcgcagcagggccttgcaaatgatgaagcgtatcgcatgattacagacaaaggacggacggctgtaatggatttatgtataaaagtcgcccgcgctgttataaaataggaacaaaaaaggcaaaaatccttggtaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaacgagccattcgcttaaatatgttgcgaaatcaagcatattggttataattgtgagtccgaggagaattggaccgaagcttgcgcatactgaaaaacaaagacatgaaaacacttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctccgttcaggatagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcattatcggagtggctgacagttactattgagcgtgacggatatgtctataaacagcggtttgaaaacggcggcaagcccgtgacttcacttgaaaaaatcggaacgaccaaaaaaacgggaacgcttacccattttaaacctgatccgtcaatgttcagcgcaacggtttataattttgacacgctgtcagaacgtctgcgcgaatcggctttcttgttaaaaggtttgaaaatagaattaattgatgaacggaaaggcgtaaaagaagtattttattatgagaacggaattgaagcatttgtcgcttatttaaacgaggaaaaagacgctttatgcgaagtggtgtcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggtcgcccttttaaaagagaaagacaagaaccttgaaggcgccgatatcagggaaggtttgtccgcaatcatttccgtccgtatcccggaggaactgctgcaatttgaaggccagacgaaagggaagctcggcacaagtgaggcgagatccgccgcggatgccgtcatttctgagaatcttgcttatttcttggaagaaaaccgcgatacggcaaccctgcttgtcaaaaaagcgattaaagcaagccaggcccgtgaagcggcccgtaaagcgagagaagaagcgagaagcggcaaaaagcgcaaaaaatcagaagcgacgctgagcggaaaactcacaccggccggttccagaaatccggcgaagaatgaattgtatctggtggagggagactctgctggaggttctgcaaaacagggaagagaccggaaattccaagccgtgctgccccttcgcggaaaggtcatcaacacagagaaagcaaagctagcagacatcttcaaaaatgaagaaatcaatacgattattcatgcgatcggcggaggagtcggcgcagattttgatatagaggacatcaactatgacaagatcatcatcatgacggacgcggataccgacggcgcgcacattcaagtcttgctgttaacgtttttctaccgctatatgaaacctttaatcgagcacggaaaagttttcatcgcccttccgcctctttacaaagtgagcaaaggaagcggcaagaaagagattattgaatatgcttggtccgacgaagaaatggacggcgttttaaagaaagtcggcaaaggatataccatccagcgctataaaggtctgggagaaatgaacgcagaccagctctgggaaacgacgatgaatcccgaatcgcgaacgctcgtcagagtcaagatcgacgatgcggcacgggtagagcgccgtgtaacgacattaatgggagacaaagtagaaccgagaagaaaatggattgaaaagaatgttgccttcggattagatgaggaaagcaatattttggaaaatgaaaacttgtcggtcgctgaggaggtttaatagtggcacagccagaattatttcatgatttaccgttagaagaagtaatcggcgaccgtttcggacgctacagtaaatatattattcaagacagggcgctgcccgacgctcgtgacggtttaaagccggtgcagcggagaattttatacgccatgcacgcagacggaaatacattcgataaaaatttccgtaaagcggcgaaaacggtcggaaacgttatcggtaattatcatccgcacggtgacagctccgtttatgaagcgatggtgcggatgagccaggattggaaagtgcggaatgtgctgattgagatgcacggcaacaacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgttaacggatcaaccgggatttcagcgggctatgcgactgatattccccctcatcatctgggtgaggtcattgatgccgtcattaaacggattgaatctccggattgcaccgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcagatcgtcattacagaaattccgtttgaagtaaacaaagccaatctcgttaagaaaatggacgaataccgcatagacaaaaaagtcgaaggtatttctgaagtcagagatgaaactgaccgcacggggcttcgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattacaaaaagcaaaagagcggcatcacatcgttgaaggactgatgaaggcactgtccgtgttagatgaggtcatagcggtcatccgggcaagcagcgacaagaaagatgcgaaacaaaacttaatttctaaattcgcatttacggagccgcaagccgaagcgatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacggtctgtcattgaagaaaagattgaggaaattaaaatcaatcttgaagtcatggttgcctctgaggacgtatatgtgacagtcacaaaagacggctatgtaaaacgaacaagccagcggtcatttgccgcttctaacggccaggatttcggtatgaaggatactgacaggctgattcaccaatttgaaatgaatacaacggatgttcttctgctctttaccaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttattgttcatgacgaaaaacggcatggtgaaaagaactgaaatgacgcattacaaagcgcagcgttactcgaaagcgcttgttgcccttaaccttaaaggggatgatgagctgattgatgttcatgtcacagacggcggcagccagctgtttatcgccacccgcctcgggtacggtttatggttcggtgaagatgaagtaaatgtagtcggtgcccgtgcggccggcgtaaagggcataaatttaaaagacggtgataccgtcgtatcagggcaaattctgcatgaaacagattcgctcgtcctcgtcacacagcggggagcgatcaaacggatgaacctatctgaattcgaaaaaacatccagggcgaaacgcggtgtcatcatgctgcgtgagcttaaaaagaacccgcatcgcacagtcggcgtattcgcgtgcgctttagccgacatgatcgctgcggaaacagaaaaaggcgagagaatcgaaatcgccgtgaagtccttgcggtcgaatgaccgatacagcaacggctccttctttaccgatgaagatgagacagggccggtaacagatgtatggcgtatccctgcatacgatgtttaagagtaaaaataaaaaacctccgctcattgagcggaggttttactatttagctttcatggctgccgaataagtcagtgatagcgtgaatgacttcgattccctgccatacaaataaattcaacgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtctactccgggaagcggggcgtctcctgtctgatatcacgatcagtgagacagaagcggcaaaaagcgccgtcaagatatatgagcccgtcagcgattttttctcatcatcagcattttggccggccttcatttcgtgcatttcctgctggtcggctaccgctttaaaatgatgagcggtatcaaacgcatggggaatggagagcaaatgaaagcttgcaatcgctaaaaataaaatagaagcttttaaaaacaagatttttttcaaatgttctccccccttcataagtctgaatatttttattataataccctaatttaaatgtaaagtaaacacatttattaaatttaaaaaattattatcctggttaagtatataccattccatccatcttttcatctcttttttcttaaagacctatttgttatgatatgcacgcattccttataacgtgacaacatttttcgggctgtaagataaaaaacggggcatgacagcaaaagatgtgatgaagaaaccgaaacattttcttaaaaaaacttctcaaccactgttgttgtgatataataatacccgttgtgttaaaagatctaacatatgcagcaaaaatgacagtaaaagatatgtaaaagggaggttaaacatggaggctttcatcagtgaaatcataaatgttccaaatgattttatttggaagtatcttgtttatattttagtcgggatcggattgtactttacgttccgttttcgctttattcaattccagtacttttttgaaatgttcagaatcgtcggggagaagccgcaaggaaataaaggagtgtcttcaatgcaggcattctttatctcagccgcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcacagctgtataaagtgcgttccggtgacgaattccgcggcggtccggcatattacatggcaaagggactgggcgcccgctggctcggtattttattcgccgtattgattaccgtttctttcggacttatctttaacgcggtgcagtcaaatacgatttctgtggcgtttgacgaagcattccatgtgaataaaacagttatcgcaatcattttagctgtattaacggctttcattatattcggcggtctgaagcgtgttgtttccgtctcgcaattaatcgttccggttatggcgggaatgtatattctgatcgcgctgtatgtcgtgattgtaaatatttcggcggtacctgagctgcttgttacgattgtgaaaaatgcgttcggtcttgagcagatcgtcggcggaagcttaggaagcatcattattatcggagcgcagcgcggcctgttttcaaacgaagcgggaatgggaagcgcgccgaatgccgcagcagctgcacatgtgtcgcatccggctaagcagggattaattcagaccctcggcgtgttctttgatacgtttatcgtttgtacatcgactgcttttatcattttattgtacagcgttacgcctaaaggcgacggcatccaagtgacgcaagccgcactgcagcaccatctcggcggatgggcgccgacatttattgcgattgcgatgtttttattcgcattcagctcagtcgtcggcaactattactatggtgaaacgaatattgaatttattaaaacaagcaaaacatggcttaatatttaccgcgtattcgtcgtagtgatggtggtatacggatgtttggctgacttccagatcgtctgggacatggcaaacttgtttatgggtctcttggctctcattaacttagtggcaattttactgctgagtaatgtagcctacaagatctataaggattatgccgctcagcgcaaaaaaggtcttgatcccgtattcaaagccgagaatactccggagctcaagcatattgaaacatgggcggaagaagaaggtacaagccctgaacgtaagactgctaactgaggaacatgcatacaattttcaaaaaacccccttacattttgttgtgagggggttttttatgtgaaaaaccgggttatttttactgaaaacagatttttttgaatttattgtatttttctcttgtatatgtaagtgctttcatataaagtttaactaaaccggtttaccaaaccgatttagtcttaaaggaaaggagtattgatgtggcttctgattatggcatttttacgatcggtgatgcgatgatcaccttaaatcccgcaagcacaggacctttgcgttttgttacccattttgaacgaaaagcaggaggagctgaactgaattttgcgattgcatgcgccagattgaacctgcactcaaagtgggtcagcagactggggaaggatgagttcggcagagtgatttatcagtttgccaaaggagaaggaattgatgtgactgacgtctcctttgttgaaggctttcctacatctttaaatgtcaaagagatcagaaatgacggttcaggcaagacgttttattatcgtttcaattcaccaattctgactcttgcaccggaagatataactgagaatatgtttgacggcattcacatcgttcatcttaccggtgtgttcctcgcgcttgataagaaaaatcttgaaattgctgaaagggtgctttctatcgccaaagcaagaaagattcccgtatcttttgatccgaatatcaggctgaagctgtggacgattgaggaggcacgtgcggcatttcatcaaatctttccgcatactgatattcttctggcgggccgggacgaaatgaaacagctgacaggtataggagaaaatgaagcattagcccggtttgcagagagctattcaatcagtcagcttgtcataaaagacggtgaagcgggttctgcgctgtatcatgatcataagtgggttcacaaagaggctttcccggttgcgcctgtcgacacggtaggggcgggtgacggctttaatgccggctacctgtacagttatctacatggttttgaaccggaaaaacgtctggagtttgcaaatgcagtcggtgcgctcgtcaccacagtttccggtgacaatgaagggcttccctgcctagaagaggttttgtcatttgtaaacaaagagactgtgattgaacggtagcaagcacaacttaaaaagcgggtgaaaaaatgaaagcggttcaagtacggaaagcatttgatctgatggtgacggaatgtgagaaaccgtctgttgtccacgcggatgatgttcttgtcaaggtgaagcgggtcggaatttgcggatcagatttgcatatttatcatgggacaaatccgttagcgtccctgccgagagtaatcggacatgaagtcacaggggaagtcgcaaagaccggttctcatgtccggcgtttcaagccgggtgaccgggtagtgattgaaccgatatcttattgcggaacatgctatgcctgccggaaaggacgtccgaacgtctgcaaagcgctttcggtgttcggcgttcatgaagatggcgggatgcgggaatatatcgtgcttccggaaaagcagctgtatgctgtttcgcccgatctgccctgggaggaagcggtcatggcagaaccatatacgatcggcgcccaggccgtttggagaggccgtgtcgagaaggaagataccgttttgattcaaggagcggggccgatcggaatctgcatattaaaaatggcaaagttcaaaggcgcttccgtcatgataaccgacttgaatgatgaacgcttggccttcgctgaaaaaaacggtgcggatgttaccgtcaacgcgcaaaaagaagatcccgttttgcgggtgaacgaatggacaaaaaatgaaggcgctaatgtcgtcattgatgccgtctgtctcccctcaacgtttgaaacgtcaattgacgcagtgtctccggccggtcatgtggttgtgcttggttttgatgagaggactgccggcatttctcagcttccgatcacaaaaaaggaagtcacgatcaccggttcaagattgcagacgaatcagtttccgtacattacagacttactgaataaaggcctgttaacgcacggcggtcttattacacatacattttcagcagatgacgtccatcgagcatttcagttgatcgaacagcacccgggcaaggtgggaaaagcaatcattacgtttgattaaaggaggagcgagaatgctgcctaagtacgccatttacgaaaaacttctgcatgcacaagtggtggctgtcataaggggacaaaacagccaagaggcgcttgaagtttcaaaagcggccatttcaggaggtatcagcgccattgagcttacatacacaactcctgaagtggaagatgtctttaaggaactccggcatcaagatattcttcttggagccggttctgtaatggataccgaaacagcgagacacgccattttatcaggcgcctcatttatcgtcagctctcattttgtaaaagagatagcatctctatgcaaccagtacagcgtaccgtatctgccgggatgcatgagcgtgtctgatatggctttggcgctcgaagccggatgtgatgtggtaaagctgttccccgctaattcgtttaatccctcatttatcaagtcggtcaacggccctctgccgaatgtccgcattatgccgaccgggggtatctcattaagcagcatgaatgactggctttctgccggagcggtcgcggtcggagtgggaagcgacttgacaaaagcatatcaaaagggcggctatgaagctgccgtatccctcagcaaagaatacgtctgccgaaaaaacgaatatacgggggtgtaagatgaatatcacgtttcgctggtacggccaaggtaatgatacggtgacgcttgaacatgtcagacaaattcccggggtcaaaggcatcgtctgggctcttcaccagaagcccgcgggcgaagtatgggaaaaggaggacattgaagcggaagtcagattcattcaatcctatgggtttcatgcagaggtcgtggaaagcgtgaatgttcatgaagccattaaactcggccatgaagaacgcggacaatatattgagcactataaacagaccattcgtaatctgtctgaattcggcgtgaaagtcatctgttacaatttcatgccgatttttgactggacgcgtactgatatgttccgcgcactggaggatgggtcaactgctttgttttttgaaaaagcgaaagtggaaagtctcccttcggaggaactgatccgcacggttgaagaatcttctgatttgacgcttcccgggtgggagccggagaaaatggcccggatcaaggaactgtttgaagcctatcaaacggtcggtgaaaaacagctttgggccaatctagaattctttttacatgaaatccttcctgttgcggaggaacacggcattcaaatggccattcatccggatgatccgccctggtcaatttttggcctgccccgtattatcaccggtgagaaaagttatgaaaagctgcgagagatttcagattcacccgccaactgtattacgttgtgcacgggttcgatgggagcggatcccgccaatgatatggtgaagatcgccaaacactatgcgggagctgcgccgtttgcccatatacgaaatgtgaaaatctgcgataacggtgattttacggaaacttcgcattttaccagtgatgggtccattgatattaccggtgtggtaaaagaattgcacggccaaggctacaaaggatatgtacggcctgatcacggccgtcatatctggggcgaacaatgccggccgggctatggtttatatgatcgtgccttaggaattatgtacttgagcggactgtgggatgcgttctcgtctcatgagaaagaggtgaagagatgagaccgattcatgaacgtttatcaggaagaaccgctgtcataacaggcgggagcggtgttctctgttcagcaatggcaaaggagctttcacggcaggggatgaaaattgcgatcgtcagccggaatgctgataaagcagagcgtgcggcgggcgagattgctgacgctggaggaaccgcggtttctgtaccggctgatgtttcagcccgtgattcgctcgaaaaggcaaaagacgagattatcagccggttcggctctgtcaatcttttaattaacggagccggaggaaaccacgctgatgcgatcactgccaatgagacgtatgaagaggatgagcagggcccatcattttttgatatggacgaaacgggattttccagcgtattttcaagcaactttaccggtgcatttctggcatcgcaagtgtttggaaaagaccttttgaaggcggaatgtcccgcgattattaatatttcttctatgagcgcgtatacaccgatgacaaaggtgcctgcctacagtgcggctaaggcggcggttcagaattttacgatgtggatggctgttcatttcgcgaaaaaagggctgcgggtgaatgccatcgctccgggtttctttttgactgcgcaaaaccgtgagttgttattacaggaagatggaagtctgacagaccgatccaataagattatggcacatacaccgatgaaacgtttcgggaaaccggaagaccttctgggaacgctcctgtggctttcggatgattcatgctcaggctttgtcaccggggtcaccgttcccgtcgacggaggttttatggcttattccggagtgtgacagaatccatgtccctgtcagattgtaaacgatttacttctgtcttatactagtgaaaaatgaagacagacggggatgagtctatgaaaaccattacaatttctgatgtggcgaaatatgcaaacgtatctaaaagcaccgtatctcaatttttaaatcagcgctatgactatatgagcgagaaaacgaaacaaaaaatagaagcggccattcaagagctgaactatcagccgaatttcgtcgcccgcagcttaaaacagaaatcaacatttacggtaggtgtggtggtggctaatattcttcacaccttttccactcaggtcatcagggcggttgaagactattttcatgaacaaggatttcatattattgtctgcaatgcggatgatgaaccggaaaaagaaaagaaatatattgaaatgctcagggccaagcaggtggacggaattattatttttccgacgggcgaaaatctctctttatatgaaaagatgaaacgcgatacgtttccggttgtgtttatggacagaaccattgaagaactcgggattccgacagtgatgcttgataaccatcatgcagccggtcttgccgttgaccggtttatcgagagcggcattaagagaatcgcgattattacgacgtccattattcgggaaatcagtccgagggtagagcggattgaagggtataaaaaggcgcttgaccgccacggaatgatggtgcggaatgaatatatcaaaacagccgatgcggctgatatttccaatattttgtcagagctgttctcacttcaggagcctccgaaagcgatattggcggcaaacgatattgttcttgttgaggtgctgaagtatatgaaggagcatgatatgacaattcctgataaggcagccgtcatcggaattgatgaagttccttttgcgggtttttttactccgccgattacgacgatcgtccagcctgcggcagaaatggctcgaaaagcgggaagccttcttcttcgccagatacaagaaaaagatagcggtgaaaaacggattcaccgctataaaccggcgcttctcgcaaggcaatccggataaccggtttcattgcattgcataaaccggtttactccggcaatttaaattatgaaataagagggagggattttatgttctcaaaggatagattccctattattcttcttttattttcagccggggtgattaactatttagaccgttcagcgctgtctattgcggcgccgttcatacagcaggatctcacattgtctgcaacccaaatggggctgattttcagcagtttttctgtcggatacgctgtgtgtaactttctcggcggtgttgcatctgaccggtacggggctaaattgacattgtgtacggcgatgatcgtttggtctcttttcagcggggcggttgcgcttgctttcggatttgtaagtcttttgattatccgtgttttattcggtatgggagaggggccgctgtcggctgccataagcaaaatggtcaacaattggtttcctccgtctcagcgcgccacggtcatcggcctgacaaacagcggcacgccgctcggcggagcgatttccggcccgattgtcgggatgattgctgtggcattcagctggaaggtttcctttgtcctgatcatgatcgtgggtttagtctgggcgtttatctggtttaaatttgtcaaagaacggccggcacagacggaagacgccccggcaatgaaagcggcgattcaatcgcatgagcagcatatcccgatgaccttttatttgaaacaaaaaacggttctcttcacggcttttgcctttttcgcctacaattacatcttatttttcttcttaacatggtttccgagctatctggtgaaagaacgcggtttaagtgttgaatttatgagcgtggtgactgttattccctggattcttggatttatcggtttggcggcaggcggaatgatttctgattatgtatacaaaaaaaccgccggaaaaggggttttgttctcacggaaagtcattcttgtcacttgcctgttcgcttccgctgtactgatcggacttgccggacttgttaccactaccgtaagtgccgttattctcgttgctttatcagtcttctttttatatataacgggctctatctattgggcggtgattcatgatgtggttgatcaaaggaatgtcgggtcagtcggtggctttatgcattttcttgcaaacacggccggtattatcgggcctgctttaaccggctttatcgcggataaaagcggatcattctcgggggcgtttttgcttgcaggcggattagccgttttggcctcggctgcggtaatccgtttcgtgcgcccgattatcattcaaaccgcttctgaagataaaaaagatacgataccttattcgtaagtcatcaaagccactgaggctgtcctgccgataacgggatggccttttcgttctgccgcttgatctgttcctatgataatataggaattgtttacaaaagaagggaagaggagggggcatgaaacagaagccgatatatgtcgaaatcaatattgcatctgatatagaaacgctttgggaatatacgcaaaacccgcatcttcataaggaatgggatctgcgtttttctgacattacatatcttcataggctgccagatgaaccgcagagatttctatatgaaacacgaatcggttttgggctgaaggtatccggcacgggcgaatcaataggtgacataaggcctcgcttgtcagaaagagtgtcttcgctcgcttttgcctctgatcatccgctgtcacttataaaagaaggcaggggctactggaagtatatagagcgggataacggacaaacctcatttttgactcaatatcaatatgaaacggcccgcggtctgccgggaagttggatagaccggtttttatttcgtcctctgctaagctgggctaccgcatggagctttgatgcgttgcggctttggatagaacaaaacagacatccgaagatatcggtccgtttcggatttgtctatgtctgtatgtgcctcgtattcagtctgtattggttttttcaaggctttcatgatggctgtgccgatgcagagatcgtgaggggaacgctggagacagggttaggggtattatggctgcttcccatgcggagaaagtggctgattcacgccgggcagtcagtcttcttttgtgtaacggcactgttatattccggcggcggattcttgatttcattaggagtccttacgatagccggcatgattcttaagctcaagctgccgagcgcctggcatacaaaacgaaagagagaagtgaaatgacggattcaatgtatgaaaaaacgattactcattatcaatcactgcacccgatgctgcagaaacggtacagatttgacggatcacgcacgttttgcggagaaggcgttatgtcagaaataaagggaggttcttttcttgtcagaatgcttttaaagagcggtgtttttttcagatgttttttctcagagaggggaaacgatatccctttcactatcgaaaacaaaaacaggcaaaatggcgtggaatggaatcgtacctttttctttaaaggcaaaacgcgtttttttgatgcggtcatggaatatgatgagcgggaaaacagaattcttgattacttcggcaaacctcacatcctactgtctgaactgcatttagaagcgtcttcagacggagggcttgttattacatccggaaggcagtggctcctgataggcggaaagaaaatcccgcttccggcatggctgtgcggtaattcaaccgtttatgaggcttatgatgaggaaatgaattgcttcagcataaaggttcatgtgaaaaaccggatactcggcacgcttttctcttaccgggggactttccgggaaacagagggagaaacatgctgaagcgtcatctcatggtaagcgttgtttgctttttgggatttgcggcggctgaagctccgcatatatcagcggctgagacgtttgttttattttccgtgctttttttcgttcccgctgtattctgctttgcttttcggccgtcaaagaccttagagaatgtgtggttacggagttatcctgttgccgctatatgtgcggcgcttgcgcttgtcacaggcttcagcttttttgcctttgtgtggttcatttatacgcttggactggcactgtatgctgtccgccggctgatgaaaacaaatattcacagaacagaagagatgtcagttatggcgggtttcatttatttggccgggggcggattctggttcttcgcatatgtccttgagattcccgtcctgaatttcggcccgcttatcgttctgctgacggcggtgcactttcactattccgcttttctcattccgatctttaacggcttgctcggcaggatcatacgggagaaacgcggactttaccggtggagcacggtcattattttgatttcgccggtcctaattgccttggggattacattttcaaagacacttgatgtgattgctgtcgctctgtatcttgcgggtctgtatgtaaatgcatatctcgtctttaaggcgccgtttgttacgaaaacaggcaggatcttgatcaggagttcttcggctgtgttaatgatcacaattgctttttctttgatatattcgtacggtgtctaccgcgcggaggcaacgctcacgatcagccagatgatttggattcatggggccgtcaatgcattcggcgttatcctgccggctttggcggggtggagaatagaaaatcctagaccgttcgatgagaacagtgaaagaacgttcagcagaatttacgggaagggaacgataggcaaagattttttgactgacattcatgcagcaaatgatatccattataccggccttcaggatcagctgagagaactgcattctgaagacttttcaactgaaaagctggcgccggccgttatttccttttatgaaaagacaattgattatgacatcatggcgaaagtgacgtggagcggttggtttcgtccgttcgcgcgcgtgtacgagccgttcagcagaagagcggggcagattcatctgtccatgaatccgggttggtatatcatgcacagtgatattataggagttgactctgacaaagacggcagaaaaaatgtccgtgcgtggatcagaacaaatgaaaagcaggaaaccgtttttactgcgctgtattcagcgtacagggcaaaaggggaaggatacatgaatatctctcttccgctgccgtacggccaaatgacgggcattttaaagccttatgcgcgtaagcagaatcttgttttgacaagcagacggcgaaaaagcggagcgggagatgaagggatttatctgcagacgaaatgggggacgtgtcatcttccgctggcagagacatttcttatttcagcccagagcgaaacaagcctgaaggccgttcatcatatgtggctgttcggactgaaatttttaactgtgcattatcggatcactcatgcttccgcaggtaaccgaatggaataacaagctgcagagccgtctgttcattaggcggctttttctcatgcaaagattcctacattgagcggcatgatgaaggcagccgggcagatgtccctgctgaaaattcggtattttcgggggaccttggttgcgggatttttttaaaaatgattggctgggctcacagccggattttatttcgtggcagtgctctggctggcggctgttcaagcttgctgttgcgttaggtttttcagctgaatcaaaactagcgctgtaaacatttttatacgtgtaacgcaataactgcaataacacaatgtgcgattattgcagttataaatttctcttctttgtctcaataactaaagtatacttggttcatgagacttataattcatttctctttataacttcctagaatatatattatgtaaactagaaattgtgaagagaatataaaagtggatccatatattctaacagcttccccttttagtaaggtaatattaaaaaacctctacgtccttaataaattaaattgcattcatgttatagttcggttcacaaaacagcagtaaaaagggtttcttaaggtcgctgccctgaaggccgaacgctccgctatccaagccaatcccgcaggcgaaccggtcgtcgtctcggcaaacaatcgccgtcgtagccccgccataagaatgtccgactatgcccgtgccgatgttaagcaacaatctgtccttaaagatggaattttgacaagataatcggctgcataccttacatcttctgcctgtaattcactatactctgttaacttgtcaagtatcggaagtgtaagcacgttttggcacatctcaatggcagtttcatcgtcaggacgcatcaccatcttaccagccaacgccatcatctccggatcttcagaaaacgccataataacatccgaaaaatcctttgataatatctactccttcacgtaaacctccatgtattgctgtttaagataataaaagcggacatcgttgctgatgtccgcctaaagcttaactaatggggttctgttccccaaatcagttttccttgatgatataatgtaatttttttcgttgttttaaacgtatttgattgaaaaaaggaataatcgccgctttgtgcataattactccagtcatcattgtgaagacgaagctgaatattccctgtgcttgctcccggtgacagcgttcctgttttaaaacccagttccagataggtatctgcaccttgcttaggtttatgcagcgtcacaaatttgtgggtcagattgccgcatccaatctgcgcgtagtcacagtcaaagttttggcccttgtttttcgcgttataccagtaacgggcagtgacatcttttaaatcaaccgtcgcattgccgttattttttatgtgaagctgcgggcggatttggttgctgttcacacccccatcccctgctttgtattgtacagaaatgccgttttcctgtgcggggttatcttgtgctggcgtttcagggcgttctttcgttgaatctttgttgccgagaatgttttctcttacgaatgttcctgaagcagttaaatctgtaagcggccagccgcctgttttagatgctcccggctttaacgctgaggatgattcctgcttatcagaaagattccagttcacccagctgatgttcttgctgtcgagataattcagccattcccgcgactggtcaaggaatacaccgccatttccagacgcgtcgcttgttccccattccgtcacgaaaataggcgctcctttactgagtgcatagtttgctttatcccgtaaagattggccgtgtgtgccggcataaaaatgaagcgcgtacatgacgtttgcatcttttagctgatcatcggctgcatcattcacatcttggctccatgtaccggttccgacaatgatgatgttgtctggatcatttttgcggataacggaaatcacttcttccgcatacggtttaatatcacgcttccagttcacatcaccgtttggttcgtttgcaatttcataaatgacgtttggcgtgtttccgtaaagacttgacatttccttaaaaaattcttttgccttctctttatgttggtttgggttgccgtcatttaagatatgccagtcaatgatgacatatatcccaagttcttttgccgcttcaaccgcttcttttactttatttttcacggacggattatcaatataaccgccatctgccgtatacatcgccgcgcggaaaacggttatgccccaatcgtctctcagccattttaagctgtctttattgacaaaatcgccataccattgcaatccatgtgaactgatccctttcaattgtaccgctttgccgtcccggtttacgagctgtgttccttttatgctaagctgcccattcttggctgctggcgtttttgtccctgctgcagatgcctgggaagcctgcaagccgcccattgtcaatactgtaatcaataaacacgtaataaaaatagaaattgaccgtttcatatctgatcttttcctccttcgcattattttggctcttcacttcttatgagctcgaactcattgtaaaaatctttctcatgattgtctatcaacctaatttcttgtttttgggaggtttaaaagcctgtcaatttactctaactctattgaataagacacacctgacacatatagaacaaagaaaactggactgaatcgggactttacacgttatttttcaatcgaatcgaaaaattaaatgtatttccgacgtagacgctctaaatgtaatgtgatgagtctcaatatggcattgaatcttatgattgctgtaagaagacgagcccttacccgtccttgttaatttaaggttgatgtaaggttcggattaatacgggttaaggttggagttgtacaataagattgtacttcagtgtgggattcagccggaagaattcccccttcaataaatcatagaggtgaaaaggtttgagagaaaataaaattttgtcttcattatgttacttcagtatattttttgcgccgtttctgtttccgattatcgtctatttcttaagccgggacgatgtgaaagaacatgcgaaaaaatctttgtggacgcatctgattccttatttgatttttggaattggcatcatcgcttcaggtttacttggtatgaatgatatcagacatgccgggcctttcctgcttgcgacttatgctgttacattccttgtggcgatctattttttcatttggaacattgtcaaaggaatcaaagtgttttcggaacaataggaaaaaacggttctgttattaatcagcagaaccgttttttttgtatagccattatgataattgtatatctatcgttgtcccttctcccgcggtgctgtgaatggtgatgtcccctccgtgcttttggataatatcctttgctatggccattccaagaccagagcctgcatgcgtcgttcctgtatttgtccccctgtaatagcgatcaaacactttttccagctcctcttcttctatccctttgccgttgtccttaattgtcacatgagttcgttctttttgttcaagctgtacaacgatcttcacatcgggatcattgtgaacgagggcatttaaaatgagattcgtgaccgctctccgaatcaatatcgcatcaaggttcagcatcagtttttccaggttcgtttgaagctcaatggacttatccgcatatctcgaatcgtttaaattatcaattaacgtttcccgcagcagcgatacaaggtttacccgttctttatttaacatcacatcgttgtttttcagccttgtcgttaaatttaaatcttccatcacatctttcatatagagcgatttactctcaatgatccgggcgtaatctctgatctgttcgactgtgagatgataattcggatctttgatgatttctgcatagccttgaatagatgctaatggtgttttaatgtcatgagaaatatgactgatccactcttcacgcatttgctctaatttatctttttcttttttgcttaaagatagttgttccgataagtgattgacattatagaacacatctttataaatgcctttggatttcattttgatcgtataatctccattagctaaccgctggattccttggatgacacggccgagcggttttgtgagctgccggctgaatagatagccaatgagtaacgcgatcaatgcatctattgataataatatgatggttcctgtattgaacttcgtcacaaattccttggtatcatatgagaggacaaattttccgagagatggatttttaaaccctataaagtaactgtactccttgccgtttactttttttccgccggcgtaaatggttgataataattgttcatccttatatttatgtaaatttacaatttcaataggcgtatattttttcttcagtcctttaggttctctatcatgataaacatcctgtccgttttcatctaatatttgaatccatgcattctgctcttttaaagctttttggccctctttgtttactgtgatacccttgttcgataacgtgacatattgtccgaatgatcttgtgaaagtttccggtgtactttcttcgtcatgttgggtgttcgcctggaaaacgagccaaaacataaaaataaataaattaatgaagactgtaatgatggtcactatgatgacagataccatgtatctgcctgttaatcgccaattcatccttacgcatcctttacaacaaatttgtagcctaaccctttcacagtgacgagaaagtctggttttgatgggacagtttctattttctcacggagcctgcgtatatgaaccatcaccgtgttgtcagaaccgaaaaagtcttctccccatacagcttgatagagtgtttctttactgatcacccgattgggatgctgcagaaaataggccataagcataagttctttaggtgttaactcaatagccgctccatttttggtgagctcggcttgttgttggtttaattcaaatggccctttttttatcacggtaccggtttgagaaggctgtaagtaagagacccgtctcagctgcgctttgacccggtatgcgacttctttagggctgaaaggttttgtaatgtagtcgtccccgccgatggcaagtcctacaattttatccgtttcctccccctttgcagacaaaaagataataggaatgtgtgaaatgtcccttatttgcttgcagatatcatagccttcaccgtctggcagcatgatatccaatatcacaagatcgggattttcttgatgaaattgagccaatccgtcacgggcagttgaagcggtcactacgcgatcaatgccttctcttattaatacggttttgatcagttccgaaatttctttttcatcgtctatgattaatactttgctgtgaagccgtgacatatattgatcactccttgaagtcattgtcattattatacccaatgtccgtgtatcgttaaaaaatcaacattctctcccacagaaaataagccaattttcttttccgagtaagaaaattggcttaatgcaatgctgatgcctttaacgctttacaacaaatgttgtcacgctttgagccggcagatgggcccaaaaatgattatccgttactttgagatccgttccaggttgaagattgctgctgctgctcgtgatccatctggatacttgcgaagcagatccattctgcaacacgaagttttggttgacccctgtgttatttttattaatggcaacaatcacgactttattgtctcctttataggctgacacgtaaacattcggttcaggatttttcgttgcatcaatccttacatagccagggcgcacaaattttgagaaatgagccatattgtatccgcgtttgctgatcatcccatcttctttcatagggccgtatgatctgcggatgtaccaccacacataagcttgaaaatctccctctaccattgaatgatgaatatgctctgaaacacctaaagcctcaggccagcgatccgctgaattgttgtcactgttcggatagtatacctccgtcatccatagctctttccctcctcctttttgtttgaaaagaggataaggaaactgactgacctgagtgccgtacaggtgggttccgaggatatccatattcctaagcgcctgcggatcgttcaaaatgggatccgatatatttttcaggtattgaaatgattccggcgcaatcacacgggcattaatggaaccggcattctctctcatgaaacgcaggatttcttggggcgtccaccatgtccattcgtgagcgtaatcaggctcattctgcatagaaatcgcatacagattcacaccattactcttcatgaaattaacgaaatcgttaagatgctgcgcgtatgcggcgtacttatcgtatctcagccgcttagctgatgtgtcaccattatgattgaaagtctcaaccatatcgtttggcggattccaaggggaagcaaaaacgattgctccgtgtttgattgcactctttgcagtctccacttccttgtaccaattatttctattttcatctacatgaattcttaagaccgaaaaacctaactggttctgtccattgccaaaagcggtctcccgttgagccgcagtcaagtctccaatccaagccgggtggttcattcctccaaaaccgcgaatcacttgtctatctgcagatatattaactgttgcatcactcgctgctgaaacttcagtaactcccggtcctaagagcatgacggacagcattgtgaaacataccaataatacacaaattggtttttttacgctcgacatcattttttcctctccttcatttgtcttttatagacttagaaaacgtacctttgcttatctttgtgtaaactgccagtaatcaacattaaacaagtttcctgtaccagttccggtaaatacaaagaatacgttgtgaacaccggatgcgccgcttaccgcagtttctatttctctccaggattgcgttccgcctgtggaagggacattcaaggttccgacaagcttaccgtttgcactgtctagtcgcacttctatttttccgccgagagcggacgctacatttgctttaaacgtcctggcaccgcctgacccgaaatctgcatttcctacagcaatccagtctccgttatgaatgtttgtgacatgttgattattgaccggcccgccgggtgctgaggatgcctctgtcaaaatccgtccgttccaggcaaacgtttccgcttctacccggttatatggattcaagttggatagctgtttgacacctgcaaaatttgccgctacctcttgcagggagccatctggattatgcacaagcttatttatatggggagaacggtatcctttgccggccccgtaaagagcggagctgacagtttgagtatgatacaccacataccactcgtttttaaaattgaaaacagcatggtgattgttcccgccgcctccgaaaaatgctcccggatttttcagaaagtgccctctatacgaaaaagaattcataggacttgagctggtcatatagccgatctcacctggaggtttatcggccgggtgcgcgcccccgaaattgatacaataggaatagtaatattttccgttatacttatgcattcccgaatcttcaaacataaaaggcgcatcaatcgtagatgcacttccggcaacactggtcatatcaggccctaatttcatgactcttgctgttttaggattggcccattgtccctgcgttggatttgaaccgcccggaacgcctccgccggcatataggtaaccggtaccgtcatcatctacgaatactgccggatcaaaaagccatacaacaccggacattcctggtgtacttggcgtcaccagcggttttccgatcggatctgtccacggaccggtcgggctgtctgcggtgagaaccccgatacctccgccgccgtttgcgaaataaaggaaaaatttatccttaccgttgatctttttcaccgcggctgacggggcccatgatgctcctgcccatttggcaatcccccggccgccattcaccccattggcacccgctgcgggaatcgctccgtgatctgtccagttcaccatatccgctgaagatatgacggatattttattcaaattggcaaatgaattatccttaatcgtgccgtcgctattatattcatagtcatcgcttgacatatagatgtagactcttccgttataggtcagcgcaaacggatccgcgcccagatgatggtcgataagcggatttgaattcccaacatgttttgcaattggagtgctggcagcatacgcagacttcccagtgaagcaactcaataataaagcaaggacccataggcatacgcaacattttttacacataacttaacgctcctcctttttctttaaattcggggaacttttaccatttgagaacaaattgcagtaccggcagtaaaaagcagactccgcagtgaagcaactcaataataaagcaaggacccataggcatacgcaacattttttacacataacttaacgctcctcctttttctttaaattcggggaacttttaccatttgagaacaaattgcagtaccggcagtaaaaagcagactccgcagtgaagcaactcaataataaagcaaggacccataggcatacgcaacattttttacacataacttaacgctcctcctttttctttaaattcggggaacttttaccatttgagaacaaattgcagtaccggcagtaaaaagcagactccgcagtgaagcaactcaataatagagctagtacccataaacatacgctacacttttttctaataacttgacatccttctttttccttaaaatgtatgatgatttttttaccatttgatgacaaccggtcatggagaacggctctggagtaagccttgcgaacacaggagtatgactctcgcctttttaataaaaaacgccgctgagtgccaggccagcggcgttttacacttgatcatttacattttgtcaaacttcgtgtcgccagcaaacgatcctattgacagttgttcttcaagaacaagtccgtgatgatgccgttcttcaatccgtttaataatagatcgaattgcatccgtattttcttcgatattgtgaggttcaaagatcgtcacgtgatctccttttaatttgtactcaagataatgctgtgctgttgattgtgtccagcccctatcatcggttacatcgccgcatagcaaatgatggatgttggcgttaacggcgccggaattgatcagttcattgtgatacgcaagatagcctctgattttatccttaatcgaaggaatggttaatatttctctgtagtagtccggaataatgtccatattcagatggacgatctcttggatttcctcttccgataaatgagttaccgaatcggtgattttagaatccagcataatcacatcagatacggtgcgcccccgcttttctaaggctttggcaacctcaaaagccaaattcgatccggaagagtaaccaagcagaacaaaaggcccttgttcttgaatgcttatcatgctctctgcataccggtcaacgatctctttcccatgagacggctcttctaagaaatcagcggcatagatggtgctgacgccgtcaagtcttttcgccatttcattataaacgagtccatacccgattaaaggcgggaaacagaacacagggattgaatcttcctgattcagcttgacgaatacgttatccgtctcggattcgaaaacggccgcttgaatggcgggtgccattgtttcgatggtaggaaaatcgtatacggcttgataatgcatgttgattcccatactggcgttaatttgatgaatgagctgcaatactttaagtgaatggccgccaacgtcaaagaagtgatctttaatcccggggtcaggcagagctaaaatatccttccatatatcggccagctgcttttcaattaacgttcctggcgctgcgtattcggttccggtaagcctatttccctcaggagccggcaacgcttttcgatcgatttttccattagcggttatcggcatattctctacttgtacaaaataagccggaatcatatacgtgggcagattgttcagcaaatgacgcttcagttgcgccgtatttaatgactcgtctcctgacaagtaagcgcacagctgttttgagccctctttttcaatcgcgatgacgaccgcttctttgacagcatcgagttgtagtaaagatgcttcgatctcgccgagttctatccggtagcctcggattttcacttgatgatcaattcttcccaaatactcgatattgccgtcaggcagccatcttgccaagtcgcctgtacggtacatcagcttccctgctttatatgggtgagctgcaaacttctcagccgtcagctccgggcggttcaaatagccccgtgcgagcccgtctccggcgatacacagctctcctgccacaccgagcggttgaaaatattccgattcggggtgtacgatatacaattgaatgttggaaatcggtttacctatcggaactgagttaagcgtttctcccgcttcgcattcaaaatacgatacatcgatcgtcgcttcggtcggcccgtataaattgatgatttgagcctcacccgccggtgtgatcaagcgatgaaacccggcaacgtgcgcaggcgtcaaagcctcgccgcttgcaaatacatattttaatgacgccagctttctctttaattcctcttcggatttctgctccatggactcaagaaaagcatgcagcatcgcaggcacaaaatgcataacggtgacatttttctgcgcaatcgtatctaagatgacgtcagggttcttttctcctccgtttggaagcaataccgctttagaaccagtcatcgaccaccagaacaattcccacaccgatacatcaaaggtgattggggttttttgcagaatgacatcctgcttatccagcgggtaatgtttctgcatccaaacgagacggttgattacggatcggtgttccaccataacccctttcggtcggcctgttgatcccgaagtatagataacataagctaagtgattcggtccggcagtctgtttcaagtttgaaccatcttcccaagagaatcgcggatcttccaggtcaagcacttttcccgtaaaaggcacgcttttcctcaagtgactctgtactaacaacagcttcgtatccgaatcctccaatatatagtgaatccgttcttccggatagctcggatcgatcggcacatacgcgccgccggcttttaagattccgaagagtcctacgatcatttccaaggaacgttcggccataatcccgaccggctgatccggctgcacgccttctgattgcaatgtccgggcaagttgattggctctttcattcagttcccggtatgtcagctggctttccccgtatacgacagccgtttgatcaggcgtacgctgtgcttgttcctcaaacaatttatgaagcgtcttttcctttggataatctgcttccgtatcattaaatgcctctataaggagcgaacgttcatcccccgtaagtatatccaagtcttggacgcgaatcgcctgactgttcaccatctgcttaatgatttgcataaaatgctcttccatccgcttgacacttgcatgatcatagacgttgctattgtatacaaaatgaatgtcgatttctcccgcgggcatgacaatgaaattgaaatcgtaatgggtatgctcttccatatggaaattgataatgtccagtgcgtcacgattcggtttcatatgctccatttgtttctcgaccggataattttcaaataccatgatatgactgatcagctgctgcttttgttcagtttgagcctgaatttcatataacggaaatgtatcatacccttgagaagccaatgcctgctcctggctcattttcaacacttgttccacagtcattccaggctgagcggtaatacggacgggaatggtgttgataaataagccgaccatggactcgatacccggaatttctgccgggcggccggatacaaccgacccgaaaacgacatcctgactgttgttgtacctttgcagcaatagtccccacgcactttgaatgaacgtattcacggtgacgtgatgcttgcttgcagtctgtctgatttcttctgacagctgttttccgagccggcatgcaagcctttgtttttgatatcccttggcttggtttgagacaggttctttcagtaaaacagtttgtccttcataaccgtccaaatatttttgccaataggctgaagcgtgcttatgatcctggtcttccagccattcgatatatcggctgtacggggtgacgacttcccgctccgcttttcttctatcaagaatcgcataataggtttcaaatacttcattcgtaataagaggcagacaccagccatccattaaaatatgatggaagctccatatcaatcggacttggtcatcctctgtacgaaggattgatacgcgcattaatgcatcttgggtaaggtcgaatcctcttgccttatctttttgtacaaagccggcaatgaactcgtttcgttgtttattcttcatgcttcgaatatcttcaacagttatttcgatcggtttttttcggaatacgatctgcaaaggctgatctttccattccgtataaaaatgagtccggagaatctcatgtctttccgccagctgcgacaaactcattgtaaatgcctcgatatccaagtcgcctttgagatcaaaaacggcttgttcaaagtaagctctggaagccgaatcgattaaactatggaacagcatacctttctgcatgggagttaatggatatatattttcaatctcgccgatatgctgtgtttgctgaacaaattgatctaattcctcgattgttatgtccttcagtgagatatcgcttggcgtcaggtgaatgtcttcttgagctgcgcaatgttcgatgacttcttttaggctgttctttaagagagctgcacatgtttccatcgtttctcttcgatattgtttaccgctgtaactgatggccaatgacagccggccgtctgagatcatgccgttaatgtcaagcgtataggcaatgggatgtctgtcgcttgcaattttccctccggagtaaggagatacttcgattcctccattttcgaaatcttgatcaaattgtccgaggtaattgaagctgatttccggatgtccggtccattctgatgccttcggatgatcggacgaatatttcatcaggccatatcctattcctttttggggaatctgacgcagctgttctttcaccgtcctaatccgctgggagatgtcccggtctgcctggatttgaagagaaaccgggtattgggttgtgaaccagcccactgtacgtgaaatatcaacgtcttgaaaaatagattccctgccgtgtccttccagatgaacatgaatttcttcatgccccgtccagcgatgaacagccattccgagtccggtcagcaataaatcattaatgtcagtcgtataggctcggttcgatttttttaataaatgctcggtttcttcctctgtccattggacgatgatcgtttcccggtcttcggccagaccggtctcctgctcattatcctttggcaatttgtgttgcgagatatgtttctgctcaagccaatattgattttctgcttcaaattccggactttctgcataacgtttcaatcgttcagcccataacagataggaatccgtcttcttagggagcgtgagcgcttctccgttttggagctgctcataagctgacgttatatcctcaagtaaaatcctccacgatacgccatctacaaccagatgatgaatcgcaatcagcaaatgatcgccatcctgacattgaaacaatcccagtttcatgagcggtccatcggctaaatggatggattgctgaatgtcatttgctatcgtttctatcgtttcggcagggttgttttcttcgagtaaagagaacacgtcgaggctgaataattctccttcactgatcccgcgggttctggcttcgtattcatgatctccctgaacatagaccatgcgcaaagcatcgtgatgctcggcaatcttcttcatgactttctgaagcttcgattcgtccaaaccccctttaaaataaagcatgacagattgattataatgatgcggatcagggtattgccgggcgaaaaaccaatgctgaatcggcgtcaataaggtacggcctttgatctccccttgttctgcgattcgggtaatgggctcaataaaaggagcaagcccggagatcgtcgggtgtttgaacaagtgtttgatgtcaagcttatacccggcttgatataagcttgaggtcacctgaatcgacttaatcgaatctcctcccagctcaaagaaatgatcatcgattccgacctgttctgcgcctaataccgattcccacaccccggccagtattttttccagttttgtccgcggagctgtataaggatttccagtgagatttcccgttggagcaggcagagcctgacgatctatttttccgttggaagtaagcggcatcgctgccagctgtacaaaataagcagggatcatataggacggaagttgccgggacaggcgctcccgaatttcgcctgcggttaaagaatgctgtgcggtataataggcgcacaaggatgtttccccgttggtttcttgtgccgtaacgagagcttcttgaatcggcggtatttggaaaaatgcggattcgacttccccgatttcaatgcggtaaccgcggattttcacctggtggtcgatccggcctaaatattcaatatttccatccgggagccgccttgctaaatctcccgtccggtacattttcacctctggcacaaaggggtgctgcaaaaatctttctgctgttaattccgctctgttcaagtatcctctggcgatgccgtccccgctgatatagatttctcccggaacgccggccggcaccggcttcatgctcttatccagcacgaaaatgttcatgttgtccgcggcggttccgatcggcactgattcccgtctgtcgttttgcggatcaaaggaataaatcatacagccgacgactgtctctgtaggcccgtattcgttaaaaatttcgattttcccgccgaatttcccgctgatgctacgggcgagccgcgtgcttaaattgtcaccgccgacaatgaatttccgaatggtgcactcagcagggatattcatctctttcaataactgcaagtgcgccggggtcagcttgataatatccgtccttgaatcctgaataatgcaatcaagcaaggcagcactgttttctcctccgtagacaataatggaatttcctgtaataagcggagtgaaaacagacgttatcgtcagatcaaaagcgatggacgaatataggggaaagttggttttttcccctttgacatagacccggcgggcccaccaaatataattggttaagccctgatgctcaattgccactcctttaggcttgcctgtggagcctgacgtataaatgacataagccaaatccttcgtattgctgatcagttccaggtcagagccgtcttcgtggtaagagctttcctgatcgaggaaaaccattgtgcccgcaagttccaactgtttttgaagatggctctgcgtcaggatgatatcagcttgggagtcttctactatatactgtatgcgatgcttcggataatccggatcaattggcacataggcccctcccgcttttaaaacggccagtattcccacgaccagttcgatctcatgctcgcaaataatcgcagtgagccggtccgtctttaccccctttttccttaacgttcgggctaattgattggcacgttcattgagctgacgatatgtgaattgcttttctccgtaaataacggctgcttgatccggtgttcgtttcatctgttcttcgaataactgataaaccgtcttatcccgcggatattcagttttcgcagtttgaatgtcaacgagaagtgtatgtgtctccgattctggcaaaatatccacttggccgagggggaggtcaggctgaaataatatgacagaaaatagccggtttaaatgtccgagcacctgcatcatatactgacggtcatagacttgttcattaaaacataattttaggtcaatcaagtcttcacccatagcaaactgaaataaagcatctgcagcagccgtttctatgaaaccatcagaatgaatttgctctagtgaaacgactgtatggatgatcggtaaatgatttgcattgtagttcagcctcagctgtccggccattttatcaaagggaacgtcctgatataagatcgcttcgtccagcgtatgtttcaattcatggaaaattgatttaaacgtactgccggaattgatatgctgtttgattaacatgagctggtctgaacgaagatcttcatcagtttcgtcttcaaaggttggaacccctgtaatcactccctcatcccccgtgtatttgtataaaagggattcaattccgaccaggagaaccagatagacggccattggcgtttggttcgtcatggtcaggatgcgccgtgatacctccgcactcaatgaactgtgaatacagtcagatccgcttgttatatcacgctttactgttgagtcggacacttgaaacgaagggaatgcaccgggacggtcttccgtgtgaaacattcggccccagaacaactcctgttgtttgaattctgacattcatatccctccagttggtttcattcctgttttcaggcagctggcggcagccgcggcattcatgccgggacagccgctgcccccgtgattagaaatccaattcgattgtgcttgcgagatgtttacttttgtttactttttcgcttaattgaatgtcttttaaaggaatggatgggtttctcataatcgccgaaaggatcatgacgtaatccttggccaatacagcaatggttttctttttaaacagttttgtacagtaatcaaaactgccctgaatctcatcttgatctattaagaagttcagctgtaaatcaaacttggctgccgtctctgtttgttcataaggcctgactgcgagagagtccacttcaatatccgtttgttccgtattttggaggacaaacatcgtatcaaacaatggattgcggcttaagtcccgttttacacccagtttttcaactaattcttcaaaaggatactcttgatgttcaaaagccttcagcatggtttctttcgtttccgttatataatccaaaaatgtcttttccgccatcggagcggtgcggatggctaatgtattgacaaacattccgataatgggttccaaatccgcatgcggtctccccgcaataggtgtgccgacgacgatatcaccctgaccgctgtatttagccagcagtatggaataggccgagaacaaaatcatgtaagcggtcgttccggtcaattcttccagctgctttatcccttgggtgacagtcttatcgagcgtaaaattgtgccttttcccatcaaagcttctaaccggcggtctcgcaaaatctttcggcagctcaaatgaaggcagctcttcatgaaatacaccaagccaatacccttcctgcttcttgattcgttctctttgctctttttgatgtttccattccgtaaagtctttgtactgaatacggagcggagctaactctttgccgtcatacaattgaatcagttcttcgacaaaaatattcatggaggcgccgtccgtgatgatgtggtgcatgtcaaacatgaaaatatgcaggtcttgttctaactcgatgagtccggccctgagtaatggagcctggctgagatcgaacggccgcacgaaggtgcggaaacattcctcaacctcgtcagctgttgccttgtatctttccatcgaaaactccgcttgcggtttgatcacctgcaccggttctccgcggaccagctcaaaaccggtacgcagtgattcatgacgctggatcagtctttggaaagcggtttgcaagcgatttatgtcgagttttccttctaatgtaaggattcccggcatattgtagctcagttctccgccttctatttgtgttgacaggtaaaccatcttctgcacggaagatacaggatagacatcttttgttttggctttcggaatgtaatccggcccgttggtttcagctcctgcaattgcctttgccatttcctcaactgtcggacattgaaagacctctcttaatgaaatgtttttgctgaattgcttatgaattttggcgatgagcgtcatcccccgcaacgagtggccgcccaaatcgaaaaagttatcttttacacctatttctttcaccttcaaaacgtcttgccagatgcatatcagctgctcttccatattcgtccgcggagcaacgtagtcggttcccgtttgtaaacctgcttcaggcatcggtaatgctcttcgatttacttttccattgccggttagcggcagtttctcaagctggatgaagtatgaagggatcatgtatcccggtatttggccagcaagtttttctttcagctgactgatcgagagtgattgctccgctgtaaaataggcatataaatcgatttggccatcggtattttcttttgataggacaactgcttcctgtacgtgcttgagaagagcggcctccacctcaccgagttcaatccggtaaccgcggattttgacctggtggtctctccttcccgcatattcaatgtttccgtcaggaaggtaacgggccagatcgcctgttttatacatccgctgattcgagtcatatgggtgcggaacaaaagtttcgagtgtcaaaggctccctgttatgatagcctctggcaaggctcgctcctgaaatacaaagttcaccgacgattccgacaggctgaagcgttccggcttcattcaaaatgaaaatctccgtatttgaaatcggtttgccgatcggctgaagctcctgatctgtatcaggatcgacggtatacatggtcacaacatgcgtctccgacgggccataatgattatgcaatgtgacttgatggcgtgccagcatgtcacgcagcatacttgttacgatgagctgttctcccgcagcgatgatgtgatccacgcacgcggcaaacggttcgaaatattgtttctctgaggcaaggagcttaaggaacgctgtcgggaggaatgctgtttgtatcccgtgcgttctgacaaaatcattgagctgacgtatgtcacgttttgcctcattgccgatgataaagagtgttcctccgcttgaaagcgcggagaacatttcttgatagcagacatcaaagctcatcgcggcaaattgcagcactctgtcaaagcgaagctgcgtatgatcctgctcataagcgagcagattcgtcatcgtcttgtgctccagctgaactcctttcggctgccccgttgtgcctgacgtgtaaataacatacattaaatcattttccgagcaggaaagattaagattgtctgctctgccttgatatatcatcggatcatcaagctgaagcacttctccttcaaagcgcggcggaatagcgtggcctgcacaagtcaaaagcacaccggcgccgctgtctttcagcataaaagcccgccgtttttcgggaagctccggatcaataggaagaaatgctgcgccggcctttaatatggctaaaatgccgatgatcatatgtgctgagcgatccgtgagaacggcaacaacctgatcagtgcaggcccccttatcttgaaggatgcgcgccagctgattggaacgctcattcagctgacgataagtcagtgtctgaattccaaacatgacggcttcatgatccgggttaagctcagcctgctgctcaaaaagctgatgaatcgttgtcggaattcgtttttccgcaactgcagtatcgttaaagagttgctgaatgtctccttcctcttccttggtcatcatattcagacgagccagctcggcatcaggctgtttaataatcgaatcaatcagctgcacaaaatgccccatcatgcgttcgatcgtttccggtttaaacagagccgtcaagtattccattgtgaactgaatacccgactcttcttccacagccgttaaggttaaatcaaatttagccatcgtatgttcgcttggatatggtttgaaagtgacgtcatttatctctaactgttcctgctccgtgttttgaagcacaaacatggtgtcaaacaatggattacggctcaagtctctggcgatattcagttgatcgatcagcgcttcgaacggataatcttgatgctcataagcttttaatgcattctcctttacctcggacagatactgagagaacgtcttccctttttcagggtaatttctcatggccaatgtattcacaaacattccgataatcggttccaaatcggcgtgcggtcttcccgctataggactgccgacaattatgtcttcctggccgctgtattttgaaagcaataatgtataagacgcaaggagcaccatatataaagtcgattcagtttgggatgccagctgctttaacccggcgcttttttgcttatcaagcgtaaactgcattgtggctcccgcaaaatcccgtgccgacggccggatataatcggtcggcagatgaaggacaggaacgtcgccgctgtacagctctaaccaataggcttcttgattttggatctgttttaaccgcgcttcgccggtctgccatactgcgtagtccttgtactggatgcgcaaaggcggtaatgtttctccttcataaatgcggataaattctttaatcaatacactcatggatgttccgtcagaaataatatggtgcatatcaaacatcagaattccgcggtcaggttgaagttcaatcagccccacgcgaagcagcggcggctcatccagatgaaatggacgaataaatttgcggatataaaggtccgcatcattttcttctgcctgataccactctgcttcgaactttgcgtgatctaagacatactgaacgggttctccgtcagccattttaaaaccggtgcgcaaagattcatggcgcaaaatcagcgtgcggaaggcttgctgcagcttgtcacggtcaagcttgccttcgacagccatcagtcccagcatgttgtaactgagttctccgccttccaagtgattcaggatgtacaaccgtttttgtgctgaggataccggataataaggtcttttttcaattgcaggaatcgcagcatatccggtcagctccgtcttcgtgatcgtctgtgcgagctgttcaatggttgggagacggaagacgtcccgcaaaggaatttggacatgcaattgcttttgtatttttgcaatcagcgccgttgcccgcagggagtgtccgccgatctcaaaaaagtgatctctgatccccacctgctctaatccgaggacatcttcccaaattgctgtcagctggatttcttccgaagtttgcggcgggacgtactctatgccgccgtcacgctttttgaccggagccggcaataactggcgattcaacttcccgtttggcgtcagcggcatcttatccagctgcacaaattgagccgggatcatatatcccggtaaatgccgggccattctttcgcgaagttcactgatctgtattgtcttatccgcagcaaagtatccgcacaagtaatattcatcatctgcatctttaagggcagctgcggcggcttcttgaatatcaggaacgttaagcatcaccgattcgatttcaccgagttcaatccgaaaaccttgaattttcacctgatgatcaatccggccgatatattcaatatttccatccggcagaaggcgggccagatcaccggttctgtacattcggtcctccggtacaaacggatcggcaacaaatttttcgtccgtcagttccggcaggtttaagtaaccccgcccgacgccgtcccctgcaatatacagctcgccttggacgcccgccggctgcagccgtttttttgaatcaagaatgtacatgcggtttctgcctaacggcttgcctatagggacatagttttggctgcgtgcccacgcattggaagaacattcaatgttgaacagagacgcgtctacgcaagtctccgtaggcccatatacattggtaatcccaggtgaagcgccatgatcgccgaataattgcatgagcttatttaccgtcgttttggaaagagcctctcctccgattaaaagatgctgaagcggaactccctgcaaatcacctgcagctatcaaaagctttaagtgggcaggtgttccgtcggtgatgtcaatcgaatgctgccgataataacggcataaggcagcaccgtctgacacaatctctttcggaacaataaacaaggtatgtcctgacagcaaggaagcatacatttgctgaacagaagcatcgaaataatatggagcgagcatggctacattcagctccgcatcgtaggcagagtaaatttggcgtcgaagtccttcaatcaggtgaatgacctggcgatgttcaattaacgtgcctttaggcttgcctgtcgtaccggaagtataaatggcataggccagttgactggactgataagagagtgcaagactgctgtctttttcgtgatagaaatgttcctccatgagatcgatacatgttcctgagaagccgatgtcatcctgcagcttcccgcggtaaagcaatacgctgatgcttgaatcatttaaaatataactgatgcgttcagacggagaatcaggatttatcggcaaatatgcgccgcccgcttttaaaactcccaagatgcctacaatcatctcaagcgagcgttcagtcataataccgacaagcttatcgttccgcacaccttttgcctgcaaggttcgcgcaagctgattggcacgccggttcagttctccgtaggtgagttgtttaccctcgaatacaaccgctgtattgtccggagtacgatgcgcctgttcctcaaacagctcatgtatcgtttgttcaagcgggtaatgcatgtcattagactgaaagcggctgagcaaatgttctttttcttgcctagagagaagctccaattcttctattttgacagacggctgctgtaatacttgctgcatgagctgttcaaaatgtccgcagatccgctccacttctgatttttcatattcgttttcattaaaaccgaaatgaacggccagctgtttgccaggtatgacaaccacattcaaatcatagtgggagtgttccagcatatgaaaattcgtaatgttcagctccgtactatgatgtcccgtctcttcgacctgctgaccgatcggatagttttcaaaaatcatgatatggtcaatcaggttctgcttttgttccgtttgggcctgaatttcgtataaaggataggtatcgtatgattgggaagccagagcgttttgttgaaccatttgcaccgtatcagcaaaagtgctgtcctcatcgcagcggatgcgaaccggaatggtattgatgaacaggccgatcatctgttccacatcaggaatttccgccggtcttcccgacacgacactgccgaagacaacgtctgcggacccgctgtatttctgtaataaaactccccataacgtttggatcaacgtatttaatgtaacctgatgctgatttgcgatctgctgtaattgttttgtctgttcgtgatcaaatcggcagatcacattggcataggcgtattctttttgttcatgctgctctattttatgaagaagcgtggtttcacctttatatccttcgagatacccgctccagtaccgctttgccgctccctgatcttggcggtcaagccactcgatatagttgctgtaaggagctgccgatgacgattctggttccctgtcttcttgtaaggcgcgataatgatcaaacacttccttcgtgataagagacaggcaccagccatccatcacaatatgatggaagctccaaatcaaatgatatttgcggtcttccatacggaaaatcgctatgcgcatcagcggatcccgagccaagtcaaatccttttgccttatcttctctttgataggctgcgattgcatcctctcgcaggtgctcctctatgtcacgcaaatctgcaaaatgaatttgaggtgtttgcgttttatagacaatttgtaaaggagtatcgttccagccgctgtaaaaacgggttctgagcacggcgtatgtttcaaataatcgttcaaggcttgctttaaaccaatcaatctttaattctccctgcaaatcgaacgatgcttgttcaaaataagaacttgtggcctcgtccagcaggctgtggaagagcattcctttctgcatcggagtgagcggatacacgttttcaacctcacctgcatgcggcagttgaatgaggagctgatccaattcgtcaatcgacatgccttttaacaaaatatcgcttggcgtcagttccgattgttctctatggacgcaatgcgtaatgattgtccgcaggcggctttgaatcgtttccgataaccgcatgatcgtttcttttgcgtactgtttgctgctgtagctgatcgtaagcttcagccggccgtcggtgatcattccgtttatattcaatacatacggtctttcttgatttccgctagagtctgaaccgcaagaataagaagataattgaaccccatgctgctgtaaatcttggtcaaactgtccaaggtagttaaagctgatctcaggattgagtttcgatggcattccgccgcttaagtaccttgctattccatatccgatccctttatgcggaatttggcgcaatccttctttggtcgtcttgatataatcagagatctctttgcccggatgcgcgtgcagcacaaccggatacagacttgtaaaccacccgaccgtgcgggagatatctatatcttgtataatctgttctcggccgtgtccctctaaatgaatcggaatttgttccagtcctgaccaatgcgatatggaaagaccgagagaagttaaaagcaaatcgtttatctccgtgttataagcgcgattcgcttgttttaatagcagctccgtttcctctttcgtccattccacagttgctgtttcactgtcttttgcagttgtatgggtttcatgaaaatctttaggcagctgtttgacttcggtttgttcgatctttgtccaatattcctgttcctgttttatggtttcacttttcgcatattctgaaagtctcttagcccataattggaaggaatctgttttttgcggcagttgaatcactcgcccattctcggcttgcttgtagccgctaacgatatcttccagtaaaatgcgccatgaaatcccgtctataatcaaatgatggatggcgatgagcagatgatctccatttgcgcattgaaacaacccggctttcattaacggcccatcacttaaacgcatactgctttgtatctcatcagctttggcttcaattgtccgtcccggatcggaatcttctttcagattcaggacttctaagcggtacagtccgctttgggcgatttcttcattctgtgcctcgcagccattttccgtagtccggaacgtcatgcggagcgcatcgtgatgttcagcaagtttttgcagggtttgacgaagctgcgtttcctgaaaaccttccggcgcatgcagcatgacggcttgattataataatgctgatctgtcgttatttgttcgaaaaaccaatgctgaataggagtcaggctgacttttcctttgacctcaccttgatcggctatacgcagattctgcttgatatgcggactcaattctgcaattgttgcatattgaaacaagtctttgatttccattttgtatccttgctgatttaatctggaggatacttgaatggatttaatggaatctccgccaaggtcaaagaaattatcaagaatactgacgttttcagcgcctaataccgattcccaggcagaaactaatatttcttccgcttttgttcggggagctttatactctgctctgtcctgcagctcgaaatccggagccggcagcccttttttgtttatttttccgttagaagttaaaggcatttcatcaagctcgataaaataagccggaaccatataacttgcaagggtatgagacaattgtttccggagccgggcagccgttgtttgcccgccgcttacgtaatatgcacacaattgtttaaacccgtggacatcctctctggctgtaacgacagcttccttgatcgcttcttcttgaagcagtgccgcctcgatctcgcctaattcgatacgatagcctctgattttcacttgttcatctattctgcccgcatattcaatgtttccgtccgccagccacttcgccaaatctccggtcttatacatcttcgctccgggttcaaacgggtcatcgacaaatttctctgccgttaattcaggacggttcaaatatcctcttgccacaccggcgccgctgatatagatttctcccggcactccgatcggcgcgggtttcatattctcatcaagaacgtaaatgctcgtgtttgccgcagcggttccgatcggtaccgattcccgtctgtcctttgcggcatcgtaacggtaaatcatgcagccgacaacggtttccgtcggtccgtactcattgcatatttcaacccggccttcgaactgttcatgaatgctgcgggctaaccgggtgcttaagttttccccgcccacaatcattcttcggacagccgtttgatcggcaatgttcatttctttcaaaacctgcaaatgggccggagtcaatttaatgatatccaccctcgggtccctcacaatcgattcaagcagagctgttttatcttctccgtcatagacgatgattgcatttcctgtgacaagcggcgtgaaaatagaagtcaccgtcagatcaaaagaaattgacgaatacaatgggaagttggctttctcgccttttacataaacctctttcgcccaccaaatataattggtcaagccttggtgctcgattagtacgcctttcggccggcctgtggaacctgacgtataaatgacatatgccaaatggctcacatcatttatcggagcaaggtcagagccatcttggtgataagaactttcatcatcaagtaaaaccgtgacgccttcataggcaagctgtttcctgacgtcccgctgcattaaaacgattccggcttgggagtcatccagcatataccggatgcggtcttgtggatattccggatctatagggacataggctccccctgattttaaaacggcaaggattccgaccaccgattcgatgctgtttctcgtgatgatggctacaggctgatccgtctggactcctttcgctcttaacgttcgcgcgagtcggttggcccgcttattgagctctccgtacgtgagctgcctgtccttatcaatgacggctgcttgatcgggcgtacgctgcgattgctcttcaaataattgatgaaccggcgtctgcggaaacggcgcggccgtgtcgttaagcgtctgcagaatggttcttctttcgccttccgttaacaattccgcttgatccacccggatatccgcatttgtcacgacttgttgcaggatttgcatgaaatgttcccgaacccgctctatgcttgcccgatcatacacatttgcattgtattcaaaagagatggtcatctcgtcgcccggtataacggtcaaattaaaatcgtagttggtctgttcttccatttgcacgttggagatcgtgatggatgttccgttctggcggcctatactttccatatactgatcaaccggataattttcgaatatcattaaatgtgtaattaaatcttgtttttgcgttgtgcgcgcttgaatatcgtacagcgggtgcgtctcaaattgttgagacgctacagccctttcctgcgcatctttcataagctcggcaaacgttgtcccggcttcgcaccggaaccggacgggaatggtgttaatgaataagccgatcatggtttccacgtttggaattccagcaggtcttccggaaacaacacttccaaacacaacgtcccggctgcggttatatttctgcagcaaaaccgcccatgccgtctgcagcagcgtattcagcgtgacatgatgctcgcctgccgtccgcttcattttcgaagtgagatcggagcttatgtcacacgtcactttttcaggaacgtatcgtccgtcttccgctgcatgatgatccttaggaaggccggtttgctcctcatatccctccaagtactgatcccaataagccgtggcctctttcgcatcttgccggccgagccattcaatatattgactgtacggagtaattgatgattgttcaggctgcttttgctgaagcaaggcaaagtaattctcgaatatttcttttgtaatcagcggcaggcaccagccgtccatcaaaatatggtggaagctccagataaaacggtatgtcttttcatccgtacgaaggatgaatagccgcattaacgcgcctttttctaagtcgaacccccgcatcttatcttctctggcatactgctgaatcatcgcttctttttgtgattccttcatctctcgtaagtcattgaattgaaaaccgatttttttcgttttgaatatgatttggagcggctgatccttccagcctctgtaaaaattcgtgcggaaaatatcatatttttgcgataagccgtccaagctttttgaaaatgaatcaatctccagatctccatgcagatcaaacatcgtttgctgaaaataagcacctgaattcggatcaaataagctgtgaaacagcatgcccttctgcatcggcgttaatggataaatattttccgcttcgcctaattcacgcgtctgctccacaagctgttccagttcgtcgattgagatatcttttaacaggatgtcacttggtgtgagagaagtctgctgccggcttacgcaatgcgcaatgacttcttgcagactttctttcaacccttgggcaaattgcgccatagtagatctttcgtattgtttgctgctgtagctcagtgtcagtgataatgtcccttcggtaatcatgccgttcaaatcaagcacggccgttctctcttggttttcgttcatcgataaccctgtggaatatggcgatatgtgcaaagcctgatgcttcaggttttggtcaaattgtcccaaatagttaaacgatatctccggatttagctgcaggctgtcggcttccggatgcccggatatatatttgatgatgctgtaattcattcctttatcagggatgcggcgcagcccttctttcacaatcttgatccgctgcgacaggttttttccggcttccattctcaggacgacagggtactggcttgtgaaccatcctatcgtgcgggaaatgtcagcatccggaataatcggttctctcccgtggccttccaaattcacgacaatgtcttccgtgcctgtccacttgtgaacggccagccctaacgaagtcagcagcagatcgttgatatccgtgttgtaggcgcggttcgcttgttttaataattgctccgtttcctcttttgtccattgaatcgtcacttcttggctgtctcttaataacgatccttcgctgatagtgtctttaggcaatggctgaggctttatgcttgaaagctcagtccaatacgcaatctcctcttccatatcggtttccgccgcatacttggacaattgatcggcccagaatggaaacgaatctgttttttgcgggagctggatcgtttgtccgcgttctgcctgctcataaccgcttgcaaaatcctcgagcaaaatacgccaggatactccgtcaatcagcaaatgatgaattgcaatcagcaaatgatctccgtccggacattggaacaaaccgagcttcatcaatggccctttgtctaataccatgctgctttgaatctcattcgccttatcggcaatcgcttgagccggatcggtttcccctttataattcatcacttccagatggtatagttcactttcatctgttcctgtaattcgcggagcgtatccatccggcgttttttcaaaaatcatcctcaaggcatcgtgatgcgacgcgatctgttctatcgtccggcgaagcggagcctctttaaagcattccgccgaatataacatgacggcctgattgtaatggtgtgcatgcggcatgttttgttcaaaaaaccaatgctgtatcggggtcagcttggttccgccattcacttctccttgatcagccaccctgctgaccggcgctacaaactgactaagttcagcaatcgaggggtgtttaaacaaatgcttcatatcaaccttgtatccggcttgatacaatctggatgatacctgaattgatttaatcgaatctccgccaaaatcaaagaaattatccaaaattcctatacgttctgcccctaatacttcttgccagatggacgccagcagttcttctattgtgttccgcggggctatgtattcgtattccgcccgcgtattttcgtcagcagcaggcaaagctttcagatcaatcttcccattggaagtgagcggaatgcgttccaatgggataaagcgggagggaatcatataattgggcagttcccgggataattcttttctgaactgcgctgctgtcaaagaaggctcgccgacataataggcatacaattgtttggacccgtctgcgtcttcccgcgcgacgactgcggcttcacgaacgttttccagattgaacatggctgcctctacctcgccgatctcaatccggtagccgcgaatttttacttgatgatcaatccggcctaaatattcgattcttccatccggcagccatctggcgagatcccccgttttatacatcttttgaccagggacatgcagatgctccacaaatttttcctccgtcaattcagggcgattgaggtagccgcgggccactcccgctcctccgacatacagctctcccggtacgccgatcggctggatttgatggtgcgctcctaaaatataagcttgatggttggccaccgggctgccgattgtgatctgttcatcagcggactgaacagggtgaaatgtagataccacgctgttttctgtcggtccgtattcattattgatccgaatgcgaggctgcagagaatgcagcttctcaactgtatctgtttccagctgctcaccacctacaacaacatgctgaacatggatgaagtcctctgcattcatctgttcgatcatcgttttcagaagacggggagaggttgagaaatgagtaattctctcttgttttatggcattttgaatggcgaaagtttctttattctcttcattaggcaataggtgcaaagttgcccccgagatgagcgggccgaagaaatttaaaatgaacgcatcaaaaacatacgggtacaaaacaagcacgcgatccgccggagaatgtttaaaaaacgccttcttccattggagcgaattcacaatgccgccgtgttcaaccatgactcctttcggctttcctgttgtacccgacgtataaatgacataggctaaatggctgtgtcccgctgctggtgataacaatgagctatcggcatggtatgatgtttcatcattcaaatcaatcaccgggccgtcaaaggtgagactgttttttaaatgacgctgaacaaggagaacgtctgcatccgcatcatgaagcaaatattgaagccgctcttttggatattcaggatccaggggcacataagcgccccctgccttccaaacggctataatggatacgatcatctctaatgaacgatcagcgagaatggcgactaacgtatcgggttgaaccccgcaattacgcaatgttcttgccaaacggttcgccttctcattcagttccctgtacgtcaaatggtcgtttttaaacttgacggccgcatgctcaggcgttctttctgcttgctcttcaaataattgatagactgttctgctcccggagaaatctctgacggtgtcgttaaaatcaaacaatagcttctgtttttccgcttccggtaaaatctctgccgtatggatcgcggcttgaggctgaaacaggatcacagacagcagctgatccaaatgggatacaatttgattgatatagcgctcatcgtacagattgccgttataaaaaagcttcaaatgaaccccgttgttctccaaatcaaagtgaaacagcgtatcggctgcagtatcttctttaaattgcaaggaatgaatttcgttaagcgaaacgacggtatgaatcaacggcagatgctcgtcattgtattgcacgctcagatgctgaaccatttttctaaacggcaggttttgatttttcagagaatcattaacggcttctttcagctgcccgaatacggttttaaatgtactctcgtttgaaagcgtattttttaagaggacaatgttgttaacggctgactggccggctttttgcttcgataccgtcggaatgccaagaatcaggctcgtttgatccgtatatttatataacaagcattcaatacccgccaataaaatcagataggccgccatatcggaatgattcgccattgtcatgattctttgggatacttccggagataaggaacggcagatgcatttttcctggtagccggtacgggccaacgacgctttatccgctgctttaaagtaagggaatgcgcttagtccgtcttcttcatcaaacaggttttcccagtacgtttcttggtttttaaataccgacattggagcacctcattttatataatttaaagaaataatgcttttccctaaaagttcaattgaatagaatcaagcgcgttctcttcttcctcattgctgccgctcaatccgatatgttcaattagaatgcttggctgttccaaaatcgccgatagaatgtgtaagtagtcgtttgataaaacctcgattctgcttttcttaaacagttttttcgaatattcaaacagtccgtgatagttgtcttggtccgcctgaatcgacaaggtcaaatcgaatttggcaaccggatgatgaaatgaatacggcttgagttgaagagaatcaaaagtcaattcagcatgatcgagattttgcagcacaaacatcgtatcgaataaaggattgcggcttgaatcttttggaagatgcagatgctgaattaattcttccaacggatagtcttgatttttataagcgttcagcatgttttcttttacttcgtttaagtaggcatcaaatgttttacggcccgccgggtgattgcgaatgactaacgtattgacgaacattcccacgaccggctctacatccaaatgagtccgcccggcagatggcgttcctacgataatatcttcttgtccgctgtacttggataaaagaatcgtataggccgccaataaaatcatatacagtgttgctcctgtgtcttcttccatttggcttaaacactgtttcaagtgttcgggtataagaaattcaaatgattcgccttcgtaatcgcgtatggcaggtctctcataatccgcaggcatatccagtacaggaatatcaccgtgaaactgatccagccaatacgcttcctggctcttgatgttccgtttctgaatgtccgattgctgccaaactgcaaagtctttatattgaatagagagcgggtccggttcgttcccctcgtagattcggcttaaatctttcatcagaatattgacggacacgccgtcagaaatgatatgatgcatatcaaccacaagcacgtgccgcgcaggttcaatttcaatcagtccggcccgcatcagcggcggtttggctaagtcaaacgctttgatgaaatcaagcacacggtcttccgcttcttcttcgcttgcttgaatccgttctatcgtaaagtcgacgttctgatgaatacgctgtgccggctcgccttcatataaatcaaagctggtccgcaacgcttcatgacgcgcgattaattttcggaaagcggcgtttaaccgttcgggatcgatcgtcccttccacattcatggcacccgtcatattgtaagtcagctcgccgccttctgtgtgacttaacaaatacatacgcctctgagctgaagaaaccggataatatggcatttcctttgcagccggaatcggtacatatcggtttttgtccatgtgtaacgccttgtcagccaattgttcaatggtaggaaacttgaatatgtctttgagagacagattcacatccagctctttgtgaattctggcggctaaggcagccgctcggatggagttgcctccgagatcaaagaaattatgtttgatccccgcatggcttattccgagcacttccttccataaatcagtcagtttggactccgtctcattacccggcggaacatattcagctgtctgctgcagactcgcttctggtgcaggcagtgccttacggtttattttcccgttggacgttaacggcatatgctccagatggacaaaataggtcggaaccatgtagtccggaagctccgatgacaattgtttcctaagctgcgcagccgctataggcttgtcgcttacgtaatacgcgcataattgttttaagccgtcttcttcttctttcactgtaaccgcggctttttgcaccgcttccgcgttatgcattgctgcttcaatttcaccaagctcgattcggtgtcccctgattttgacttgttcatcaatgcgcccgatatatacaagatttccgtccttcaaccgcttagccaaatcccctgatttgtacatcttcgctcccgggacatacgggttttcaacaaatttctctgccgttaaatccggacggttccaataccctctggcaacacccggtccgctgatatatatttcgccgattaccccgatcggaaccagatttctgcttgcatcggccacataaatatccgtgttggcagccggagtgccgatcggtacaaattcccgcttgtcccgttctgcgtcgaagtgataaatcatacatccgacgacagcttccgtcggtccgtattcattgaaaatgtccagccggcctttaaactgctcgctgacacttttggccagacgggtgcttaaattttctccgccgacaatcattttccgtattgcggtgccgccagcgatattcatctccttgatgacgtgcagatgtgccggggtcaacttgatcatgtctattcttgagtcccgcataatctcagaaagcacagcgcttttgtcttcgccgtcaaagacaatgatggtatttcccgtaaccagcggcgtaaatatcgaggtcacagtcagatcgaaagagatggaagagtataatgggaagttggttttctcacctcttacatagacctctttcgcccaccaaatataatcagccagtccctgatgctcaatgaggacaccttttggatttcccgtggaacctgacgtatagatcatgtaggccaaatcatgcgcatcgctgtccgattcaagattcgagtgatcctcatggtatgagttttcctcatccaaaagcacaacgtcaccatcatacggtaattgatccagcaggctgcgctgtgtcaacacaacctccgcccttgaatctctcagcatatattggatccgatcttccggatattcaggatcaataggcacgtatgcgccgcctgatttcagaacagccaaaataccaacaatcaactcgatgcgatgcggagagatgatggcaacgaattgatccgcttgtacgccttttgtccgtaacgtccgcgccaatcggttcgcccgttcattgagctgtctgtacgtataccgctcattgccaaaaataacggcttcctgatcgggactctgttccgcctgcatttcaaaccatcgggttactgtttcgttatgcggatacggcgtctttgtgccgttacactccgtcagcagttgatgccgttcggtttcagacagcataggaacggaagacaatgtcatctccggctgctcaacaagactgtttaaaatgccggtatagtgtctggtgatctgttcaatggtgtcttttgtgaatcgtcccggtttataatcaaaatgcatctctatctgttgaccggcatcttcgatcgtgagcatcaaatcatacaaagagacccctggatttcgttctttcactttaaatgtacattcattgtgccggatttcatgaaattcaatgttttgaaacacaaacatcgtgttaaacagagactttccggttgtttcccgctgtacatttaatttctccacaagccggtcgaatggatagtcttggttttcgaaagcgtcaagcgtctgccgctttacttcttccagataatccgtaaacgttctattggcgtgcggcttcgtccggattccgatggtttgtatgaaaataccgatgattttttcgatatccggatgatttcttcctgaagcaggcgtgcctacgacaatgtcttcttgtccggtatatttatgaagcagcacattataggcggccaggagcactgtatagagagtggtttccgccttttgcgccaaatcttgaagcgaacggatgacatccggctgtaaggagcatgtcactcgctgtccctcagaagagcgttctgccacttttgaaccgtctgtcggcaggtcaaggatgggaatttcgtcttgaaattgttccagccaatatgtctcctgccgcttcatggcatcctcattcagccgttggttttgccattctgcgaaatctttatattcaaattcaatgtccggtaatggtttctgatgatataaagccagcaattcatttgtaaggatgttgacggaataaccatccgaaatgatatgatgcatatcgatgagcagttcggcctgctcgttttcaatcttgatcagctccgcacgaactaacggagcttggtccaggcggaacggttttacaaaccggtctgaataggcatcaaattcgtcccggctcattgtccggacatgaacgttaaaatcaacttcgttttcaagtttctgaacgatatcgtcatctataatgtcgaaatacgtgcgaaacgcttcgtgccgctgcatcacttgttgaagagatgagatcagggcttgctcatcgtacttccctgttattgatatttggccgaacatattttgcgccagctgatccggttccagttggtgcaggaaatatactctttgctgcgccggcgatgtcgggtaatacgcttttttctcggcagccttcatcgggaggtgcacgacttttgtttcgttctgaatgaaatgtgctaattccttaacagtctggtgattgaaaaattgtccgatggaaaccttttgatgaaatgtcttctgaactttggaaagcataagcgtcgcctggagcgagtttcctcccagagccagaaagcgatctgatctgccgacccgttcaaggccgaaaagttcctcccaaatccgcgccagctgccgttccgtttcatttatcggcgcctcgtaggcttcagtgaaatttgctgtattgcttcctattgaagagacccgcttctggtgttcggcatacagtttttgtaaatcgtgctgttcttcatcggaaaacatcatcatggcgtcaagagggattgaatccccctcaaccattttttgcagcaaatttgtaaaacccgctccccactttttcatgatttccggactgatgacgttcgtattaaagtcgaaatcaagaacatattcttgatgcgcgtctgttatgttaagaaataaatcgtacagggtgcattttaccgggtatgcaacgggctccgcttccgcctttccgaaatgcagctttcgaaaaggcctgtctaaattaaagataatacgcatatccggcacttgatcgtgcggaagctctctggccaccagtgtcatcgggacggcttggtgccgcattgcaagattcacgctttctttcatactgccaagataaccggttaaagtgctttctgaagtagacgtgttcttcaccggaatcatattgacgcaatttccaatcagatcatgctgttttatatgcgattgacctgctgcggggatcccgatcacaaggcctgactgtttggtaagccggtgcagaaaaagatgaaatgcacccagcattgttacaaatacgctatttttcatctgaatgcttaatgaccttaaagcctcgctcaatggccgtccaagcctgacggtacaccggtctccctcatacccgttcggataacggacagaacctgtgctcggcagaattggctgctgaatcggttcagagaaatgacgccgccaataacggaccccttcttcataatggccgctgtcaatctgtgcctgctgccagtctaagtattggcgaaacgaaacatctgcctctttcggtgaaatcggttttccttgtacaattgccgcgtagttgctctccagttcttgaacaaatacggcgattgaccatccatcggcaatgatatgatggaacgtgagcacaatcagatgttcattgtgagccgatgtaagcacatggattctaaacaaaggcttttgttcatggaaatggaacggccgcttggcatcttctgtcagccatttttgaatttccgactcccgatgttcatgcgggtgaacggtaaaatcaatgactggtatttctatattcatccgttcctgcacttgctgtacctcgtcatcgggatgaatcactgtacgtaaagcttcatgacggccaacgatatgccgaacggcttgttttaatggtgtatgctgcagttcgccctccactttcagcataatggactggtttaaagcggcggacgcttcattcccgtaatgggatgccataaccaactgcttttgttcaggtgaaagctcgcgcgtcccggactttttacggcctccgccatcaggggagtccgggccttccggaataaatccgcctcggcgaagatcctccaccgtgtctttcaccgcttgaataatcttttctatatcatcagcggtatgcgccgcagacaagaagcagttgcgtccttcccacacatagacacctttatagttgagatggtaaaagaacaagtcattatcaagcgatgagacaaaccggaataaagaaccgaatcgaaccatgcggataggcacttgcgcttgttcgaagcagcgattcagctcatccaccaagtaggctgttttttgattaagctgctcatacagatgttctccctcggtttgtaaatgacgaagcacggctaatgacattctcatggtaagcggatgagtattgaaggttccggccacaaacgtgcgtttcgcctcgtcttgcgggtaggaatcatccccatactgccaggtgcccccgtcgatcgcattcatgaactcagcttttccggcaactacccctaacggctgtccgccgccgatgatttttccgtaggtcactaaatcagcctgaatgccgaaccattcctgtgcgccgccgagaccgatccgaaatccggtaataatttcatccataatcagagctgttccggattgctgcgtgatcgcccgcaattctttcaaaaatgcccgcggctgcaaatccggtctgcggctttgtaccggttccaccagtacggctgccaattcatcaccaagactgcggatcacgtccagcgaatcgggattgttgtaatgtaaaataatcaaatcatccataaagctctgcagtataccaggagccagcggattcgcagacgcagctccgccttttgtgccggcaacccctaatacgccgtcaaacgtgccgtgataagagcccgagaacgccaccactttctttcttcctgttgccgcccgcgccaaacgcagggcaaccatgacggcctctgttccggaattatagaaagcgaccctttctaccccggtacatgtgcggatccggtcggcaacttcaccggcgacatctgacatcggtccgagcggaggcaatgatgaacgggctgaatcatcgataacctgtgtaataaaggaaggatgatgcccgaaaaggttaaccccgaatcccatggtgacatcgatatattcatttccgtcaatatcccacattttagaaccgtcagaacgttcggcgataatcgggtatacgatttccttccaatatgaacggaagctggacaagttgcggttgtttgcatgagcaaatcgggtgttgtccgtatattgtttggaacctttcgttttatctgcgtatttcttgatgaaatcttctaagtattgtttttgccgtgcggtatagtgtccctgttcatgcaggttctgaggctggaaaggaacatagggtttcgcttcttgagccgctttcttttctgcagtgacggccggaggcccctgctggacagaaggaattgatctctcttgcgctttagcgtattctttctcatcggaatgatgtccgctgtttctcaacaaattaaagctatttaattgagcttgcaaggtatcctgaattaattgattctgagaagcgattattttttcgagcatatgctcttgatgaccttctctgcgatccgattcagactgtgcttctgaaatgacctgcatttcctgcgccggaacattctcttgaggcggagcggatgcaaaggacgatggaacggtctcagccaagtaatctatgacactttgaaggttgttcatcgtatcaaaaaaacgatccatcgggatgtctgccccaaattcgtccgcgatggcttttttgacctgtgacagcatgatagaatccattccgagtccgataaaatgagcattcagatcgagttcctccgctctgatccccgaagtattgctgattacagttttcaggaaggattcaatatgcgacttcgattgattgatattcaatgccgcttctcctctcttttcgtcctcgtttaagcgcaattggtcagcttcagcccagcatcggctccgttcaaacggatacaagggcaatggcgtcttttgtacagtttcacctgaataaagcgcgcgccaatcgataacggctccttgcacaaataattcggcggcgcgatgcagccatgtgatccgttcatcttgcgtacgtaaacgctgcttaatcagtgcggctgcttgtttattcagctcttctttatgagcgggcagcatttccttcatattcttgtagccgatgtatacaccgggaaggtttctgtctccctgaatcaggcgggtcagcttatccgatagttcttgtttaccggatacaatcatggcaatgccatgatccaaatgagccctgcccgtactggctgtatagcaaatggactttaatgaagcttggctgtcatccgatacatattgccggtactgctgtgcgagttcatagagtgatttttcagtatgagcggataaaacaaataggtgcggcccatgttcatcctcgggcgcatactcactttgagaaatatattcttccaataccacatgagcgttcgttccgctaaagccaaatgagctgactccgcctcgcagcggctcatcaccggatgggaacgctgcagcttcctggtttacgtaaaatggtgaagagtgaaaatgaatgagcggattaggttcattaaagtgcactaacggcggatttttcttgtgattcagcatgaggacagatttgatcagcccgacgatgcctgccgcttcaaacaaatgaccgatgttcgatttaacagaaccaatcgcacaaaattgtttttttgccgtatacttttcaaacgctttacaaagcccgttaaattcaaccggatcgccgagcttcgttccggtgccatgcgcttcgatgaaagacagtgtttcaggggcaatgcccgcgtctttccaggccgtctcaatgacctcagtctgagctgccggattcggtgctgtaatcccggcggttgttccgtcttgattcaacgcgcttcccttgattacgccgtaaatatggtctccgtcgcgaacagcatcctgcagaggtttcagcaggactgcggccgcgccttcacctgtgccagtaccgtctgaatctttgctgaacgttttcgtgtacccgtccgaagattccatatcaagtccgatacagatcggcaagagcgatgtccggataccgccggcaagagccatttcacaatcgccggatattaaagatttacatgccatatgaacggcggcaagcgatgaggagcacgccgtatcgactgtgaccgccggcccttttaaatttaagaaataagcgattcggctggctaacacggaagggagattgcccacgatatattgatgaagctcctccggataattcgcagaaaggagacgttcataatcgtagcccaccttcgagtaccctgcatataccccgacacggctcccgttcatgctgccgccggcatagcccgcatcttcaatcgcatgccatgcagactgcaaaaacagtctttggttagggtccataaactgagccgttttaggagctaaaccgaagaacgagaaatcaaagcggtcgatttcatctaaatagccgcccttcacaaactgattctcattgatttcgctttggatggactttaaataatccgccgcatctttcagccgggatgcagggtattctcgaatgctgtgctcacctttttcaagcagattccaaaaatcatttttagttgatgctccagggacattgagcgacatcccgataatggcgatatctttcggtgtcacatggcttggtttagctgccacgtcctgcttgatttcagcccggctttcagacagatacgccgctaaatcagtgatagaaggatacgtaaagagatctgaaacggcaagctcgcgtccgaatttctgttctatgcgctcggcaatctgcgataactgtaatgaatttgctcccatatcaaaataactgtcagcgaggtgaacctttttcccattgagcacatcggaaaagatagacagtaattccgtttcaatttcatgaatgggagtctgtccggacgtttccgggctgctctccaaatattcattgatggcggcagactctgttgaaaaattccctgcctcatactgtctggcaagttcgtagcgtttaacctttccgctggttgttttagggagttttcggatcggaaggacatcttttatgctccagccgccccgcttgagcaaatgcttttttatctctttgacaagcggtgcgaatttttcaggtgattttttgtaaacaacaaagagcacgatttctccgctttgtgtcttttgatcatatacaccgcaggcggcaacccttcctaagtcaacctcttccatttcaatcgctacccgttcaatatcgtgcgggtagatattttttccgttcacgaaaataatgtccttttctcttccggttacgactaagttaccactttcactaatgaatccgaggtctcccgtttttacccagccgtcagaagtcagcgctttttccgtactctcggggttgttataatacccttgagtcacattgtctcctttgatctggatatggccgatgattccgtcttctactctttcatttgcttcatcggagatccgaagctgacaatagtcaataggtcgtcccacttcgacgaatgaagcgcaattttgatcctctttgctgacgtttacagctctttcaccgagatttaaatgatcgcgatgcaaataaacgggaacgaattctttacctaatttagagaatgctgcgccgaccgaagcttccgctaaaccgtaaacattcaaaatggcggatcttttcagattgaatgctgcgcatcttttcaaaaattcgtcacagagctccggcaatatcggttctgcaccgtttgcgatgaccttgatgtgggataaatcccagtctggttcgtttttcagaaatttaaggaagtagttgtatccgaaattaggagaggatagaatactggctttatgttcatgagcttttttcatccaaagaataggtctgcgaataaataattctgtaggcatcagattttgattgattccggttatgaagggaacaaggtggcaggcgatgagccccatatcatgcgttaaaggcatccatgataagaaagagtctttcgaatgaacggctagggcattcccaatggcgcacgtgttatgtattaagttgtgatgcgttaacatgactccttttggatctcctgtcgatcctgaagaaaattggataaaggcgagttcattcgcaccaggttcataaaacgaagcggggtaatcgtaggtttgatcttgaatgatgtcagatttttcgtttaattgatgatggaaatcctgtaaatcgtgttctgcagcgtatttctttattttgtccaatactttttcagaggcaatcagaaacgggtgatttaatatgttccaaatgcgccagaccttcagcttatggtcatcatcttctccgatactgaccggcaccgggatcattcctcctaatatacaagcccaaaaagcaacgacaaatgatttgttttcttggatttgaaatacaatttcctgcttcggctgaatgccgatatgctgtaaatagccaagatatccttgcgcctcttcaaacaattggcgataagagacaaccgtctcgtttttatcggattcgataaaacggatcccgcggtcagagatattgcttctttcccgaatgacatctactaaggtttggaattgactggtatacataggtcccctcctgggcgctttattttaaaatccgcaattcttcccaatccggaagctgtttagcctcgcaaattaatttgcataaatggatcgaatgttcgagctcttgttctgagagctcattttcctgtctttccattctctctttcagctcttggatttgcgtaaataatgccgtcgtcatattggaataagccgctgaatccttgttgtaatttcgcgcaatgacggattgaatcatcaatttattcagttgttttttgcgtaaacggacaatatgtttctttctttctgctgaattggaaagcaagtgaacatcagatgtctgtcctaagggataaggtacaatgtgattcgttgtttttctcagcagaccggctaagacattgttcggacccatttcgatgacttccgtcactccgtgtaaaagcaagtaatgcatcgattccgtccatcttaccggcatcgtcatgtgctgctcgagatgttcgctgatcgaatttccgctgctgtaagggcgtgcagtgacatttgaaatgatcggccatgcggcttcccggaaggaataccggtgtaatacagtctggaattgttcagatgctgatcgtatcagcgaactgtgaaaaggcgcactgacattcaaataagtgtatgccgctcccttttcctccgccatcttgatgacacgttccacagcttgccggtgtccggaaatcacatgctgctgttctgaattcatgcaggctactcctgccggaaagtcttccgtcgacactttcgaacatatttcctgcaacgtttgaagagagaggtgagtcacggcggccatcgtcccctgctgctgaggatccgcattctgcataagaattccccgctgccttacaagtgtaacggcatcctgaaaagaaagggcgccggcacagacaagcgctgaatattcgcctaagctatggcctgccaggaagcggggcttcacccctatttcctgcatatacacttgaaaagcaataacactgaccgttaaaatagcgggctgcgcgttcattgtctttgtcaattcattcatatctccgttaaaacacagtttttttacatccaaggagatcgcatcgctcgcttcttcaaacaatctctttgcgagcacaaaatcattccaaaattgtttgcccattcctacaaattgagacccttgtccaggaaataaaaaggcaagattgttcatgagattcctccgatcatattgaacagaaatacaatatcctacaaattatccctttatctaacatcctagcatgattataacaaatgtgtatagaatactttcggaggagttattgttcgattttacaaacgaattagatatatttattcataaaataaaacatggggtttcaccgaaaatcagtcttaaagagagatgatgaaaagccggagtggagcctgttaccggctcttcttcacttaggtcgcgttcttcatgtttcatatgttttagggctattggcattattgtgtcagaaattacatattttctgtttattgtaaaaattcatttgtatatctgtgaaggattgtaaactgatggcgcttgattataaatgcggcgcagaaatggatctggatgaggaaaatctgcaaggacaaaatacgccgcagaacatgtgaatgacccagcccggataccggttgggcagtaaatcggcctattgagtgaacaagtttttcaggcataaaaaaacagccgttcagagcggctgtttttaaaaaaatataagaactattgagcggtatacccgccatccatgactacggcctgacctgtaaccccttttgctttgtcgctggccaaaaatacagcgtaatcagcgatttccttcactgacagcagccgtttttggggaacgagcggaaagatgacgtcctcaagcacccgctcgtacggtacattccttgttgcggaaatgtcctttaactgattgcggacaagctgagtgtccacatatcccggacaaagcgcattgacggtaatgccgtcagccgcgccttcaagtgcgccgactttcgttaaaccgatgacgccgtgcttggcgctgttatatgccgctttcccgtgaaaaccgatcagcccgttgacagacgccatattaatgattcgcccgaattgctgttttttcataatggggaatgtatgcttcattgcgataaatggcgcagtcagcatgacacgaatgagccgttcaaactgttcggtgggaaattcctcgatgggcgcgacatgctgaatgcccgcattattcacaaggatatcgaggcgtccgaattgtttctcgaccgtctgcagcatgtcggccacttgcttttcatttgttacatcgcatgtgatgctgactgcttcacagccttcttctttcagtcttgccgccgcttctttccccgcttgttcgtttacatcagagatgatgacggctgctccttcacgggcgaattctcttgcgatttcaagtccgattcctccggctgctcctgttacaacggctgttttttcaataagcaatgaatgcatgacggcacctcctcattttggtctgaccccgttttttaacgactggctgacagtaaaatgaccttctgttttctcaaagacctcctccattgttacaccttcctgcagttcggtgagcgtcatacggccatcatgaaaatcgaatacagccaaatctgtgatcagccgatcgaccacctgcctgccggttaaaggcagcgtacattccgttctcactttagattccccatatttattaacatgctccataatgacaataatccgttttgctccgtggaccagatccatggcgccgcccattcctttgatcatttttccggggatcatccagttcgccaaatctccccgttcggacacttccatcccgccgaggatcgctacatcaatgtggccgccgcgaatcatggcgaaggattcggcactgtcaaaatacgaggctccctttacctcggtaatggtttcttttcccgcattgatcagatcgggatcctccgttccatccgccggataaggcccgattccgagcaagccgttttcagactgaagcaggacgttataatcattcggtatctcattggctacaagcgtcggcatccctatccccaagttcacattcattccgtcctttatttcctttacagcccgtttgatcattcgttttctgctatctctcattctgtcagcctcctttatcatgcttgccttacggtgcggcgttcaatccgtttttcatgaatcccgccaagcagaacgtgctgcacaaaaatacccggcgtatgaatttgatcgggatcaagctctccggcatcgacgatttcttcagcctctgctatcgtcactttgcctgccattgcagcgagcggattgaaatttctcgccgtctttctgaacatcaggttgcccagaggatcggctttccaggcctttacgatggcggcgttccctgtaatccctttctccagaagataggtgcgcccgtcaaatgtcttatgttcttttccctcggctactgatgttccgacgcccgcaggtgtataaaacgccggaatgcccgcccctcccgcgcgaattctttctgcgagcgtcccttggggcaccaattcgacttccagctccccgcttaaaaactgccgttcaaaggttttgttttctccgacataggatgcgaccatttttttgatctgccggtttgcaagcaagaggcctaacccccaatcatcaacaccgcagttattactgacaacggtcaagtttttcacgccgctgtccctgatcgcgagtattaattgttccggaatgccgcacaggccgaagcctcctgcgatgagggtgtctccgtccttgatcagtgcagcagcatcttgataagagtccatcacttttccttttcccatattcgtttcccctttctgttttggctacacaaggcccgtcagactgtaaatggcgataatgacaaacacagcggctgttttaatgacggtaatggcaaagatatccttgtaggattggcggtgggtcaacccggtgaccgcgagcagtgtaatgacggcgccattatgcggaagagtgtccatcccgccggaggccatcgaaatcacccggtgcatgacctccggcgggatgtggaatgtattgattgcttctgtatacgctgctgacatcgtgcttaaagcgatgcccattcctcctgatgccgatcctgtaatcccggcaagcgcagtggtcgtcaccgctccgttgacgagcggatcagtaaacgtctgcgatatgccgctgctgaccattttaaagccgggaagcgccgcaatgatgccgccaaatccgtattcggctcctgtattcatcgacgccagcaaggcacccccgatgccctcattcagtccttctttcaaattgaagagcacttttttccaatcgaacaaaatcgttgtcatgattccgatgagcagtgcgagttctactgaccagatcgcagtgacggaggaaaggtcaatcttcccgaacgcttttaaaccgagctgcgcaaaatcaaatccgtcagggtaccaatgcgggagccacatcgtgaagcatttgttcatgatccccacaaggataagcggaacaaaggcgagcacttgccgcgcggggctgggttctgcctcctgcggtaaaacaggcgtatgtttttcattagccagacttgaggaatcctctgcagcggaaacttcagattgaaatccagcatagccttctccggcattggccgcttttttgcgccgggattctaaataaatcattccggccgtaagcacaaatgctgcgccaatcagtccgagccagggagcggcataaatgtttgttttaaaaaaagctgtcggaatgacattttgaatttgcggtgtgccgggaagcgcatccattgtaaaagtaaacgcgcccaatgcaatcgtaccgggtatcagacgcttgggaatatcagctttaataaataggtttttagcaaacggataaatggcaaacaccgctacgaagagactgacgccgctgtacgttaaaatcgcacccattaagacgatggcgagaatggctctttttgctcccacaagtctgacgattgtttttgcaatcgactcggcgagcccggatatttcaacaaccttgccaaaaacggcccctaaaagaaatacgggaaaatacagcttaataaatcctaccatcttctccataaatatattcgagaagaaaggaagtacgaagcttggatctgtaagaagcacggcaaacagcgcacaaatcggagcgaataaaatgactgaaaagccccggtaagccgcaaacatcagcatgcctaatgccaataaaataataacaatgtccacaaatccccctcttttctgctcaatattagtaagcgcttacaaaaatcaagaaaataaagcaaaaaacatgccgattttgcaccgtttctgaggctgaaaaaatgtgcatcatggtgaattttccgttttggcgaaagaaaaggagattcttgctgcatgatattgaacggctgagcagcgagtttttttagggatagtgagatggatcagagaggatttttgctttataaatatgtattcttttttctttcatttatttcctgcaagaggaaccgataaaatccggccctcctgcatggtcattcagccaaggacaaccggaagctctttgagcgacctaaaaccaatgagcttgcggtattcaaggcggtgtgcggccagccgaagcttaggcatccgctcaaacagtgtgagaattgcaatttgtgcttcgatgcgcgctaatgaggagcctatgcaaaaatgggcgttctttccgaatgcaagatgcggattcggttttctttggatgtccattttatgaggctgatcgaatatgcttggatcgcgattggctgcccctaaaaggatatatacctgctctcctttttttatggtcttcccatttatttcacagtcttctgaagcggtgcgtgccgtcagctgcgcggggctgtcgtagcgcagacattcctcgacagcagtttcaataagcgaggggttttctctcagtgcgctaagctgttcagggtgtttcaataaagtaaacacaccgttgctcatgaggtttaccgtcgtctcgtgtccggctatgacaagtaagatacatgtcgcgagcacttcgtcttttgaaagctgttcccccataataaacctgctgattaagtcttcctgaggatgtgctttccgctcgtgaaacaaatctctgaaatatgcagtcagcctgcctgcggtgtcgcttgctctgactaacatctttcttgaccgggtaagatcaatggcctgaatgacgtctgccgtccattgtctgaattgatatctctcctctttcggcactccgagtatctccgcaatgatgaggcttgccaatggaaaggcaaactctgaaacaaggtctgcgttttttttgttttggatttgatccaacaagtcatgaaccgtttcttttatacaggggcgaagtgattccgccgtctttgcggtaaattctttacctataagcatccgcatccgcttatggtctgattgatttttaaataacagcatatcgtgctggatatgcgatagattttgatatttcgttgaagcttccggaaaagggacgcggtttttaaaccgggtgtctttcaaaatcgctgccgcttctttatacccggtgacataccagcccggatgttttaatacggttcctttataaacaggatcaatggcacgcagtttttcataaaacgggtaagggtcattccaaaaatccgaatccgcatggagggacggatgtgcagtcgataggcccgccgtcatcttatacctccgtattgcaggcggattgcaggccggctttcatttcttcaacggattcgacttcaaaccctaaatcatggagcatttgatgatcctctgtttcatgctgccctgctgtcgttaagtaatctccgacgaaaatcgaatttgcggcgtaaagtcccagcggctgcagcgaacgaaggttgacttcccggcctcctgagatacggatttcttttgacggattgataaaacggaacaaggcgagcactttcaggcaatacaccggatgtaattcgcttaccccttctaacggagttccgtcaatcgcatgcagaaaattaaccgggatgctgtcggcatcaagcgcttttaagctgttcgccatatcaatgacgtcctgtttcgtttctttcatgccgacgatgacacccgaacaaggcgacatccccgattgtttcgccgtttccactgtattgaccctgtcgtcatacgtgtgggaagtcgtaatgtttgagtgattcctttgtgatgtattgatgttatgattgtaccggtctactcctgcctgtttcaggcgctctgcctgttccggcttcagcagaccgaggcatgcgcagatttttaaaccgtacgtttctttaatttctttgacagcatcaacaacttgatctacttctctgtttaacggtccccgcccgctggcgacgatgcagtatgtccctatattcaagtcatgggcgcgttttgcccccttaagcaatatatgcttatccaccatccgataagactcgatcggcgcttttgatattgaagattgtgaacagtacccgcaattttccggacacaggcctgattttgcattcataatcatattcagctttactttttttccgtaaaatcgttttctgatatgaaaagcggcatgcatcagcaataaaagatcctcatcaggacaatttaaaatggccagcgcttcttgattcgttacttccgccccgtccagaactctctctgcaagatccatccattgattcatgtttatctccccatttgtgtcagattcatgaaagaggaaacatctatatgtttctcaatcatgtgttgaatgttttccggtgaaacgtgatccagcttcggtgtgattcccaaaatcggaactttgcataatgtttcaatcatgctcgggtttgtcttctcgtccagccccggccggctctttacgccgttgataataataccgagaacctctattcccatgtttttcgcatattcaacggttaaatatgtgtggttgatggttccgagatcaggcctggcgacaatcactgccggtaattccaaggcttttatcaaatcactgactaagtaattttcaccaagcggaacggaaatgccgcctgccccctcgacgatgaaacactcatgacgatttttgatcttactccagtgggccatgacttcatccatgctcacggatttcccctcaagcatggcggccgtgtacggcgcaagcggctctttccattcaaatggcgtgatttcttcatgagacagtgcggtttgtgacatgtttttcaacagcgaggtgtcactttccggatgagtccgcggcacgccgcttaaaaacggtttaaacactccgatatccgcctgtttctgcctgaatgccgcggcaagtccgcaagaaacgatggtttttccgacgccggtatctgttcctgtgacaaaaaaacttctcatttgtttatattcagctcttttctaatggaatcaaatgcttctgtcagctcgtctatgtcctgtaagctgcgatccgccgtaacggtcagcctgattctgctttcgccttccggaacggcgggcgggcggatggccggggcgcagattccctttttctcaagcagcgcagcggctgaaaccgctgtttttgcatcaccgatgataacggggataatcggtgtatctccgcctcttacagtaaagcccatatcggccagacgcgtttttatctttttgacagacgactgcagctcacggcgcgtatcgtgcatatctgatatgaggtcaaatgccgtatgcgaagccgcacaaattgacggcgggagggccgtctgaaaaataaacgtccgcgcctgattcagcaaaaaatcaataaaaatgttggatcccgcggcaaaaccgccttccgttcctacagctttgcttaatgtgccgatgacaacatcaggacaaacaccgaaatagtcactggttcctccgccgttttccccgagtacaccggttgcatgcgcgtcatctgctatcacaaatgcctggtactgctttgcaagcggcattattcggtcaagaggcgcgatggtgccgtccatgctgaaaacgccgtctgtgacgataaagcggcggttccgagtctggacggaggcaagttttttttcaagatcagccatatcaatatggcggtacacgatggtttccgcttttgataaacggcagccgtcaacaatgctcgcatggttcagttgatcgcttaaaatgacatcgcctttttgaggcagtgaggcaagcacgccgatatttgccaagtaaccgcttgaaaataataaagccgcttccgtctgtttaaagtccgcgattttttgctcaagtttttcgtgccacacagtatttcctgtcgttaaccgtgagccgccgcttcccgctccgaaccggctcagcgctgtttgcgcggctgtgatcagccgttcatcttttgacagacctaaatagtcattggacgcccaggtctgccgcttttgccccttggttttaagagcggtttcctgtgttcgcagcgtccgatacagcccgtctcttttcaccgcatcgagccttccgaggagccatccgtcaaaatccacggccggtcacctcggctatcgcttctttcataatggaaatcatggcttgtaactggtcggttgtgctggcgagcggcggaagaaaggcgatgacgtcaccgagcggccgtgtcagcatacccagctctctcattttcaaggacaccttgtatcccatccgcttttcaggcggataaggctgttttgtccccttatcctgcacaagctctatgccgcacatcaaaccgagctggcggacatcgccgacatgaggaagcagcttcagatcatgaagaaatttcgcagccgtttttgatttttcggcgactcgttcaacgatgcgctctgattcgaataaacgcagattttcaattgccgcggcacagccaagctgatttcctgtataggaatggccgtggaaaaatgttttcattttgtcgtagtcatcgtagaaggcttcataaatggcttctgtggcaaacgtcacagcgatcggcaaatagcctcccgtaatgcctttccctgccgccatcaagtccggctggacgttttcatgctcacaggcaaacatttttccggtgcggccgaaccccgtagccacttcgtcaacgatcattaacacatcatatgccgtacacagctttcgtacgcctgccagaaagccttcaggcatgacgatcatcccggatgcgccttgcaccatcgattcaatcgtaagtgcggcaatctcttcgtggtgctttgcaagcagctgttcgagcgcgtgaaggcattcatcccggcactgtacggggtcaccgctttcagatctgtatacataaggaatcggggctttgtagctttcaaacatcagcgggccgtacacatggtggaagagttcaatggagccgacgctgacggctccgattgtatcgccgtgatagccgttctgcatcgaaataaacgtctgcttcttaggtctccctacgtttttccagtattgaaaggccattttcagagcgatttccattgcttccgctccgctgtcggagtaaaaaacgcgcgtcagcttttccggtgtgatgcccgtcagcatctcggcaagttctgttgcgggaacgttcgtcatacccagcaaagtcgaatgagcgattttttcaagctgtttttgaatcgcttcatccatttcttttttgcggtggccgtgtacattgagccatactgaagaaaagccgtcataatattctttgccgctgatgtctttcagcatgatcccgtttccgctttcaatgatgaacggatcttcatcgtaatctttcatttgtgtgaaaggcagccaaagatgctgtttgcttttttcaatcattgattgtttcatatgttctcctcccgctgtatgaatacaggctgcttctctaaaaaatggatacagctctccgcatctatggagccatcagtaaagaaaacccggcatccgctttcatctccggcattcttcatcttggcaatccgctgatatcccagcttctttgcggcaacgtagcctgttatgtaatcagggtcatctgaccagcacaattcggcaataattcccggatgtgcgcaaacttttgccgcgatggcatgtgcttcctttattcgtgaattttccggcatgttgtgagtaaaagcccatttttgaaaatcatgtgacggccaatccactcgggatacccgcacacctctattccctctgcagtcaatgcgttttcctgcccggatatcaaacaggaccgctcctcttgcttctgcatattccgcaatgttttcgtacgctttctcgatcatgtgcggaggaatccccgccttttgcagaagcttgcgggcgattgcttgtcctttttccggggtgtctgtttgatggagggcaaccggcaaagggcggatcgtttcgatcggttcatgaacgctttcaagctgaatctgcataaaatcaggtatccctcttgagtgtgagaagcctttatgtaataagccatctaccgcttcctgtaaaccgctgtaagtgatgagccgttctccgccggaaatgtgttttccgccctgctcatggggggcgtttcgggaagctctcattctgacgctgtaataggtctcttcccgcatgaaatttccctcctttcttttatttcgaaatttaatgttaaccaaaataataaaaggttaacactaatacagaatattagtgtcttgcacgtaatatgtcaacctaaactataaaactgttaacttaatgggttttacaaagcctcattacgttttcatgttttgttcatattttagtaattgtttattcaacactgtccgctaaagtaatccatatcaacaaataggacagcgatccgcatcttacttatgaagggaggtcaaaaccggatgccgttatgctgaaagaaaaagtaaagacagcaggccgtttttgcaccgtgggcgccggcaatacgctgatcgattttggtgtcttctttcttctcaccgcttgccttgtcccctatctgccggcgcagatctgctcctattcggcagggatcatcaacagctatgtgtggaaccggaagtggacgtttcgtgtaaaacacaaggctgacgggaaagagatcgtgcgctttctcatcattaatcttgcagcgtcgggaatcacctttttgctgctgtacgcgtttcaaaaaggcggctgttcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggtcatccccgcagcgggtttaggaacgagatttctgccggcgacaaaggcgcagccgaaagaaatgctgccgatcgtcgacaaaccggccatccagtacattgtcgaagaagcaagagagtcaggaattgaagatatactgattattacagggagaaacaaacgctcgattgaagatcattttgaccggtcggcggagttggaaatcaatcttgaggaaaaaggcaagtcagagacgctgaaggaaatgcagcggattgccgatttggccaatattcattacatccgtcagaaagaaccgctcggactaggccatgcggtgctgtgtgcggagcattttatcggagatgagccttttgccgttctattaggtgatgatattatggtatctgacactcccgctctttcacagctcatagacgtctataaccaacacggcacagaaacgatcggcgtacagcccgtcgatcctgctgatgtcagcaaatatggtattatacagacggggcggcagagcggtcatgtgtaccgggttgaggatctgattgagaaaccggccgttgaaaaggcgccctctcatattgccgtgttgggccgttacatattaacccctgccatttttaaagcgctgaagacgatcggaagaggcgcgggcagcgaaatccaattgacagacgcgctgcgcgaagtatgccgcacccgaagcatttacgcgcgggagcttgaaggaagccggtttgatataggagataagttcggctgttttaaggccggcacggagatcgggcttctgcgggaagaaatgagaccgaaacttttagcttatttagaagaggtgttaaaaagagaatctgaagaaatcgtgcgttaaaaaataatttgtaaccattttgcttgtcaatcagtcatataattgggtaaaaagataaagaggttgtgaacagtgtgggcaattttattagtgaaatattatcctggctgacaagtatgggctatttagggattgcgctcggattaatgatcgaaatcattccgagtgaaatcgttctggcttacggaggctatatggtgtcagaaggcacgatcagctttatcggcgccattgtcgccggtgtgatcgggggaacgatcgcgcagtgctttatatactggatcgcccgttatgggggacggccgtttttggacaagtacggcaagtacttacttctgaaaaagcatcatgttgatgttgcggaaaactggtttcgccgttacggcgccggcgttgtgttctcggcgcggtttatcccggtcgtcagacatgcgatttccatcccggccggccttgcgaaaatgcctctttccaagtttgtcatattgacgacgcttgccattattccgtggtctgtcattttcgtttatctcgggtatcagctcgggggacagtggaaagacgtagacagctatgccggaatgtatacaactccgatcattatattggctctcgtatttattgttgtttattttgttgtgaagaaaatgagatcaagactgtgaaaaaagactgcataagaacggctgcgagccggatctatgcagtctttttttatttataccgggtatacggggtgtttccggtgtgtgaatgtcagttgtttggacatgtaagcagtgaggcgtttattgagttcttcccgcaaggaatcagcaggaacaatgccgtcaatcaccatttcagaggcaagccggtaaaggttaatgtcttccttatattcatcacgcttttcttgaataaaagcaggcctttcttcaggggccagctcgctgattttgtttgcgtagaccgcattcaccgctgcttcaggacccattacggcaatttgcgcagtcggaagcgctaaacagcagtccggttcaaaagcaggccccgccatcgcgtataatccggcaccgtaggcttttctgacgataacggaaagcttcggaacagtcgcttccgccattgcggagatcatttttgcgccatgcctgatgatgcccgcctgctcaaccttcgttccgatcatgaatccgggaatgtctgctaaaaacagaagcggaatatggaatgcgtcgcacaaagcgataaattttgcggctttatccgccgaatcgagaaataaaactccgcctttgacacgcggctgattggcgataatgccgaccggctgtccgtgaattctcgcaagccccgttattaattcctgcgcaaataacggtttaatctcaaaaaatgagtcttcatcaatgacacgttcaattaaatccatcatgttgaacggtgcgttttgatgtgccgggatgacatctgagagcggtttttcaaaagctttcgggttcttagatttgttgacgggcgctttttcagtataatttgccggaaagtagctgagatatgtctgcgccatcatgattgcttcctgttccgtcggggcgaggagatcaccgcagcctgatacagaacaatgcatacgggcgccgcccatttcttcaagcgatactttctcgccgattaccatttctgccatgcgcggggaacctaagtacatggatgcattgccttcgaccataatgacaatgtcgcaaaaggccggaatgtaagcgccgcccgcagcggaaggaccgaacaataaacagatttgcggaatgcggcccgacagctttacttgattataaaagatgcggccggctccccttctgcccgggaacatgtcgacctgatccgtaattctcgcacctgcggaatcgactaagtacaagagcggacactgaagcttctccgccgtctcctgaatgcggatgattttttccaccgttttcgcgccccacgagcccgcctttacggttgagtcgtttgccatcacacaaacggttctgccgccgatggttccgatcccggtaacgaccccgtcagccggcagtccgtctgacatgcactcggcgaaaaaagcgtcttcaaccgatatgccgtcatcgaataaaagcttcagcctgtctcttacaaaaagttttcccttcttttcgttgcttgcatgatatttcgcggctcctcccttttcaatcgttttgctgcgtgtctgccgttctttttcgtaatccatccgagtccctccatgttttattttcctttgtattcagggggtcttttttctttaaaagcgcgcaggccctcttctctgtcaagtgtagggatgacttgttcatatgcttttcgttcgatttcgagccctgtattgagatctgtctccagacccttgtttatcgcggattttgcttgtctgacggcgatcggcccattagcggcgatgcggccggccagtgcttttgctttttccataagttcatcggcttcacaaacatgctcgatcagcttcatgtcttttccctcttcggcagaaagccttcggccggtatagatcaattcttttgccgcgccggggccgataagccggggcagtctctgcgttccgcccgccccgggaatgattgcaagccctgtttcaggaaggccgaggcccgcccggctgacggctgttctgatatcgcaggcgagagcgagttcaaggcctcctccgacagcggttccgttcagcgctgcaatgaccggctgcgggagagcttcaatggatgcagccgtttcaccgatacgcctgacgctttgcttaacttgttcatgattcatcccagctctttcttttaaatcagcgccggcgcaaaatgtgcttccggagccggtgagaatgacacagcgaatggatggcgagtttttgatgtcttcaatcacacgctgtaaatgatcaatcatttctgatgacagtgagttggccgcatgcgggcggttcagcgtgaccagaccgatcgtttcttgacagacggaatacaagacgcaatctcccatggcttctcctttctcatttcgttctgaatgcctgcagatttctgcttggcagatctttgcctattttatccgcgatccagccggcggcataaagaagtttattcatgtccgtcccggtatcaatccccatttgttcgagcatataaatgacgtcttctgtggcagcgttgcctgctgatccaggggcgtacgggcagccgccaagcccgcctgaggaagtatcgaaggatgtaatccccatatcaagagcgggaatgatattcgctagagccgttcctcttgtatcatggaaatggagtgcgatttttgaggcgggaattctcggcaaaagggcttcaagcacggctatgacctgcaaggggtttgccgcgccgatcgtgtcgccgagcgatatttcatcaacacccatttcgagcagtgtgtctgacaggcggatgacttgttcgaccggcacgttctgttcgtacggacagccgaacacagtggacagataagctctcgtcgccattttttcagcttttgcttcagtaataacccgcctgagctcttgaacggtccggtcaatcggtttgtttacgtttttttggttatgggtttcgcttgcagataaaaatacacaggcctgatcgattccgccttctgccgcatgctccagtccgatgaggttcggaacgagcgccgcgtagaccgtatgttcagacctggcaatgccttttgcgacgtccaggctgtcacgaagagccggaatccatctcggatgcacgaatgatgtcacttcgatatagggaaggcctgtttttgacagcatattgatccactcaatcttatcttctgtatccacccacgccgattcattctgcaagccgtcacgcggtcctacttcattgatgcggacatattccggacagttcatgctgcacctcccgttttattgaagttcaatcaggacctctccttcatcagtgaaatcaccttctgattttttcacttctttcaccgtacccgctgcatcagcgataatcggaatttccattttcatagattccaagatggccacttcctgtccttcttcaatgacatcaccgggcttcacatgaattttccacaggtttcccgccatctgaatttttatgacgctcattttgacgccccctcgttcattgtttgtaaaaaaccggttgttgcctcacccttttcaaacacttctgaatgtgcaatttttgtaagcagcggaatgttggttttaatcccttctacatgatattcgccaagggcggttttcagttgttcaatggcttgttttctcgtattcgccgtgacgatcattttggcaatcatcggatcgtaaaacggagaaatgacgcttcccttttcgacggcgcattcgtgtcgcactgacgggtgtcttaaaacggaaaaagacgagatggtaccgggtgacgggtaaaaggtgaccggatcttccgcatagatccgcacttctatcgcatgaccgcggtggttgatatctttctgcgagaaagtcagcgcctgcccggcggcaattttcagctgttcttccacaagatccagtccggtaatttcttctgtcaccggatgctccacttgcagtcttgtgttcatctctaaaaaatagatttgtttcttttggtcgacgagaaattctattgtgcctgcattttggtagccgatcgattcagcggctttaacggcggtttcaccgagtctttgtcttaattcatcgtcaacaaacggcgacggcgcttcttctatcactttttggtggcgcctttgtactgaacagtcacgctcaaacagatgaacggtgttgccgaaagaatctgcgagaatctgaatttcaatatgacgggcattttcaatgactttttccatatacattgcgccgtctccaaaaaaggacgcggcccgcttttgattgccttcgaacgctttggccagctcttcttctgaatgtacgatctgcatgccgattccgcctccccctgcagacgctttcagcatgaccggaaagccgagggcacgggcttcggctaaggcggagtggacatcgggcaatggctctgaaacaccgggaacgatcgggacctttgctttttgcatcgtttttcgggcttctatcttgctgcccatcttggcgatgatatcaccgggcgggccgataaatgtgatttgttccttccggcagcgttcggcgaacaggctgttttctgacagcagcccgtagcccggatgaatggcgtccgctccggcggatttggcggcttctatgattctgtcgatatgtaaatagctttcatttactctcgatttaccgatcggataggcctcatcagccgcttttacatgcagcgcgtcactgtcggcttctgaatacacagctgccgaggggatgccgagacgtttgcaggtgcggataattcttaaggcgatttctcctctgttggcaatcaggacttttttaaacaaatgtgaagcactcctttttcattaagttaacttgagctcttcaatcgttttttcccgcagcttgaatttctgaattttccctgaggctgtcattggatattcatctgtaaacaaaacatacctggggactttatagcgggcgatatgttctttgcaaaaggttctgatgtcttctgcggaagcggtttgtccttctttgagcctgacccacgccgcggcctcttctccgtatttcggatcaggcacgccgacgacctgaacgtctgccactgcgggatgccgatataacatttcctcaatctcgcgcggatagatattttcgccgcccctgatcagcatgtctttcagacggcccgtgattttgcagtacccgtcctcgtccatgacagccaaatcaccggtatgcagccagccgtccttgtctatcgcttcttcggtcgcttcttgatttttatagtaacctttcatgacatgatatccgcgggtgcagagctctccttgttcgccccggtcggcttcttgggatgttccgggccgaacgattctgacttcgatatggggaagcgcgcgccccgctgtttccactcttctttcaaatgaatcatccgttcttgtctgcgtaatgacaggtgatgcttcggtctgtccgtaggcaatggtaatgccggtcacccccattttgccgatcacttctctcatgacttccgccgggcatggcgagcctgccataatcccggttcggacgtgggaaagatcatattcagaaaagcggctgtcatttaggagggcgataaacatcgtcggtacaccgtgcagagccgtgcaggcttcttgctccaccgttttcagaacggccggcggagaaaactgttcgatcggaatcatcgccgcacccgcggaaacacatgccagcacgccaagcacacacccgaagcagtggaaaaacggcacgggaatacataaacggtcacttgaagtaagcttcatgcattctgcgatattggccgcgttatttacgatattaaaatgtgagagcatgacgcctttcggaaatccggtcgtacctgatgtatattgcatatgaatgcaatcatcctttttcaggctgtccatccttccgtcaagcgctgcatccgttacagcttcgccttccttcagcaaagaatcccagcggtgcatcccgggcgggcttttatcaccgatatataacaccgtccgtaaaaaggggtaacgtttcgaacgcagcctgccgtactcacaagttttcagctccggaatcagcttattcaccatctcaacataagatgtctgccggtaggaatccatgattatcagggccgagacgtctgaatgcgccagcaggtaatcgagttctgcgatttgaaaatttgtattaatggtgaccagaacagcgccgattttcgccgttgcaaattgcgccgcgagccattccggtatgttggatgcccatatggccacatgatctcctttttcaattcccagtttcatcagcccttttgcggtttgccggcataaccggtcaaactcggcatacgtataacgaaggccgcgctcagggtaaacaaccgcttcatgatccggaaaaagctccgcggtccgctcaagcagctttccggctgttaaatggataagttcagccatatgacctgcccccttccatccctgtcttagtaaacgttttcatttcacttcaaaagctgtcttgcgatgaccattctttgaatttctgacgttccttcgccaatctccatcagctttgcgtcacgaagcatacgttcgacaccgcattccttcatataaccggaaccgccatgaatttggatggcctgaaggcaggttctgacggccatttctgaagcataaagcttggcgaatgccgcttctttcgtaaatggcaggttttgatccttcagccatgccgctttaagcaccatttgtctggcaaggtcaatttccatcgccatatcggccagcttaaattgaatggcttgaaatgacgatatcggactgccgaactgcttgcgttccttcgcatatgacagcgacgcctccagtgcgccttgagcgataccgacagccagtgccgcaatcgagatccgcccgccgtctaatgtatataaaaattgtttaaaacctttttcaggatcaccgagcaggttatcggcaggcaccctgacatcctccagcacaagctcggccgtatccgatcctctcacacccatcttgtcgtacggatttgtgatcgtaaatcccggtgtgtctgtcgggacgatgagagctgaaatgatcggttttccggcggagttctttcccgtaacggcggtgacaatgaccgtgcgggcgtaatttgcgtttgtgatccagcatttttctccgtttatcacatagtcatcgtcctttttctcggcttttgtctgggtgccgccggcatctgaaccggcattcggctctgtcagcccgaatgatccgagcgcttttcccgaagcaagcggaataagatgttcttgcttttgctgttcagtaccgaaatagtataatgggcttgcgccgagtgacacggctgccgcgtagctcagccccgtgctgccgcaggcttttccgatttcttcgaccgctgctgcatatgaaatggtgtcaccgcccgccccgccgtattcttccggaaacggaattccgagcagcccgagttcgcctatttttttaaatgtgtctatcgggaagacggctgattgatcaacctcatgggctttcggggcaatttcatttttggcgaaatctctgaccatttcgcgcaccatctgctgttcttttgtcagttgaaaattcattaaccttcctccttctgctgctttctacattttattaatgggggtctttattcattccatccaaataaagtctgaacattcggactcatccgccgcaaaaaaaaactgacagtgccgcaactgtcagttttattaataatggctatttaatcgtccgttttgcggagggacggctctcatggtgaagcctgtcaacggaagtaacgatataggtgcatgcttcttccgcccgaatatcagtatctgaaaatgtctgcgtccgtgacgatgtttttctgactgtatccactaaataaggctgctttcccttttctgcgcggtaaatggcgtaataagccgtttttttaccgttggatttcgcatcttcgatatagagtgtattgcctgaagcattcttctccgcccgtttgacagccggtttttttaaagcggaatgtccgagccaaggcatctcgggaattaatgcgggccggctgtacatgtcattgatcaaacggtttttcacatcgagcggattacggtttaaatcctttaaactgaaatgcatgctgccttttatccatgctgatcctctgtttagagtaatctgtcttccgtattcccccgggtcggcccaggccggatcagtattgttgttgattttataagcagcctgcccgatatataaatgcaccggccgattgttcacttcttttccccaccaatccgctaagacgtcatatgccgccgctttaaatccgatactccagtaaatttgcggtgcgatgtaatcaatgtatcctttttggatccattctcttgtatcagcatataagtcatcgtagttccgcaccccggcggccgtttcggagcctgtcggatcatctgcggcatttctccatacgccgaacgggctgattccgaatttgacataaggtttttctcgtttgatggtttcgttgatttcttttacaagccggttgacgttatccctgcgccagtcatcaattgatgcaaagtgagcttttccgtaccgttcgtattccgcctgatcggggaattcctgtccggcaattttataaggataaaaataatcatccatatgaaccgcatcaatgtcataacggctgaccacttctttgattccatccgttataaattgtcttacttccggaatgcccggattatagtacagctgttttccgtatgcagcgacccagtccggatgggaacgcgcgggatgatcatctgaaagcgcattcaaatttgtgtgattcatcgtgatccggtaaggattgaaccaagcgtgaaattcaagattccgtttatgtgtctcttcaactaaaaaagcaagcggatcgtagccgggatttttgccttgggttcctgtcagatactctgaccaaggcccgtaatctgatggataaaaagcatcagccgcaggcttaatttggacgataacggcgttcattcccatcttctgaacgtcatccagcagcttgctgtattctcttttttgctcttccggtgacagcccttttttagagggccagtcgatattggtgacagacgcgatccatacggctcgcatttctctctccggctgagtgccgcttgcttgtgcggatgctgagaacgtaaagatgccggctgtcagtacaacggccaaaaaccatatcatgctaaaacggcagcttttcatgtttttccccctctctgctttacggtattccgaagcattccgggcggtgaatcagaaagcctgctttgctcctctcagcctaaaagggaaagaaaaaagtcctaaagcgaatcaaaacgcttcaggactttttatgttttatggcggcgagcacgtcaatgaccttcgttccgacgccgacgcatgtttcaagaatggcctgcgctccggcaatggacaaaatgaaaataaccggatgtgcatagcggggccagaccaaatagcagatgccgatcaatatggcgcaccagacgcccgcacaccaataacattgcagcatataaccgaatgcggaggaagggacttttttttggacggcgcgcccgttttgatcgacggttttttcttgctttataaagggttttcttatgaattccgtaatcttatcaaatacgatcaaatgggtcagccggtagctggcaagaataatcattacatacgtaagccaagataggttcgtcatctcaaagcctccaaaaaaaactgagtttgattcccctatcttgccctttgtcttcttcagtcattctgccggatgttacagattccgcgccaagcgtcttccgctgtttgcgatgatgtccagtatgacctcagcattttgctgtgcaaaggcgggttcaaacatatctttatgggcgccgccgccttgatattcctgatagactcccgttgtggcgccttcccatttcaccggctcggtcttatcactgtgctcttcctttatgccggcctcaataaaatggagatttgccgcaatttggccgtcatttatcagttccgcccagtacgtttgatagcgctctgtttttctgatgaccgcttccctgacggcttccgggacattttcggctgttgcgtttgttggctgcggcggcagtgcgtcaagctttctgtacgcgtctgcgataatgacgtcgctgatttctaagccgcgcttttccatcgcttttgcagcctcgaatgccgtattgccgcccgctgaatatccgaagaggatataagggccttccggctggatttccagcattttatcaatgtattgttccattctgctgtcttcttcaataaagttaaaaccgtacacagcagcccgtccatttaatgccgccgccagatctttaaagaaaatgccgaaacctgagataggcggaaaacagaaaagattgcggcctttcggctgattcagtctgctgatatgctgttcggcagcttctgacagtgtgtttgaatacagcttttcagccaattgttcaattgtcggatattcaaatatcatttcaatcggcacatccatctgctgcctggtcttcagctgatgaatcacttgcaatgctttcaaagaatggccgcccagctcaaagaagtcatcctgtatgcccagctccccgcagccgaggatcggcgtccaaatgtcgatcagctcacgctctacccagtttcgtggcggaacggcttttgatgaagcttttttccgttccggcgcaggcagcctgcggcggtccactttgccgtttacggtaagcggcatacggtcaagcttcatcacatactgcggaatcatatagtcgggaagcgacctggccaatagggatcgaatggctctttcttcagcatgtgcgcctgtataatacgcacaaagggttgcttcttgtccttcgtctgacacgatgactgccgcttccctgattccatcaatttcagtcagccgcgcttcgatttcggccggctcgatacgcttcccgcgaatcttgaattgacggtcgatacggctgatgtatccgatgcttccatcaggcagccagtgtgccaaatcccctgttctgtagatcttttcttcaggatgaaccgggtggctgacaaatgcttcacttgttaagtcaggcctgtttaaatagcctttggcaaccccgtccccgccgacacaaagctcaccgggcacgccgatcggtgcaagtccgccatttttatcaatgatatacgcggttgaattgctgatcggttttccgattgggatcggctgagaaaaatcgtgcctgatttcgtaaaaggtggaaaatgtcgtattttccgtcggtccgtatatgttataaaggctgagattcggacagcggtgtctgaccttattgatgagcgccggggacaatgcttctccgccgacatataaggtgtgcaatccgcaaaacatctccggatccgcctgggcaaactggttaaaaagcgccgtcgtcaaaaacagaatcgtaatacggtttgaagaaagataattgccgaacctctcaggggcaagcattgtcgtgcggtcaaccacatggaggcacgctccgttcaatagcgctccgaagatttcaaacgtcactgcgtcaaaaccgatggatcctgtcagaatgagacggtccgtcgtgccggctgacgtgtaattactgtttgacacgagcgatacgacgttgcggttggaaatcatcacgcccttcggttttcctgttgaaccggaagtatacataatataggaaaggtcaccaggtgacgtaacggtattcagtttacccgcctcagctgtttgtttttcagctgcagccgggatagagatgatgtgagaaaagtcaatgtcagtctcaatccctttttgtaccgttaacagctgtgctccgctctcagtgagcatatcggcgatcctgtcggatggcagttctgcatcgagcggaaggtacgtccctcccgctttcaatacagcgagaacagcgatgataaattccggtgagcgttcggcaagaatcccggcaattccttttggcgccaaaccgttttccagcaggatgcgggcgaacgcagttgaccgttcatcgagctcccggtacgtcatcgtcagcccgccggcgtgaagcgcctgatggtccggggttttcttcacctgtcggctgaacaggctgatgatgctttcgtctctttcatacgttgttttcgtgtcattaaattcgccgattattcttgatttttccttttgtccgagcatcggaagccgatcagcggaaacatcgggattgaaggcggcgccgcgcagcgcctcttccaagtgtccttttacgctctctatccatacttcgtcataaacgttcgcattgtagctgaatttgatgatcagctcatcgccgggcgctatgatgaggttaaaatcgtagcccgattgttccgaaacattgacattcccgatccggaacggtgcatccgattccttttccgcgtctctcatctgctgctgaatcggataattttcaaacacgatgatatggtcgattaaatcctgtttcagctcagtctgagattggatgtcagcaagcggatgataactgaacgcctctgaatcaagcatttctttctggcagcgtcccagcagttctctaaagctttcgtcacccgttttaatgcgtaccggcacagtattgataaacagcccgatcatgctttccacgccgtcaatgacggaaggccgccctgatacgacggcgccgaatacggcatcgtccgtccggttgtatcgctgcagcatcaggccccatacagtctgcataagaaccgcgagcgtagcgccctcttctttggcgatggttttcagcctgtctgtcagattttgatctaaagaaaacaggagctctttcttacggtagcctttttcctggggacgggccgatattttcgggagtcctgagggtgtctcgcagcctgctaaatatcctttccaatactcagaagccgcgtctttgtcctgatcagtcagccatgtaatatacgtgctgtaaggctttgcgggcgccagtgtgacgggtgagcctgattcaatcgcccggtacatatgcatgaattcctgaaggacgatgccgaggcaccagccgtccataaggatgtgatggtggctccagacgcatacatatttttcctcagccgttttaaacaaagacacacgcatcagcatatccttttgcaagtcaaagccttttaagcggtcacgttccttaaatcgctgtaagtaggcgctctgttccgcttcatccaaatgtgtaagatcttcgcggtgcagccggaattcccgctcacgcagcacgacttggcgggggccgttcagctgagcgacatgaggtaaaaaaaccgttctgaaaatatcgtgacggctgatgacagactgtacgctttgctcaaacaattccggacgaagccggccttttatggtgaagacggattgctcgatatatgcagccccctccttttgcagaaaggaatgaaaaagcattccttcctgcattcggctgaggggataaatattttggatattttttgttttgtccatgtgttcctcccgctcggtttagtggaagctgagtaagtcggcaatatcctgcaaggcttcctcagtcagctcccgatcatcaaagtcactgacggtcttctccgtatcggttttgctgaggcagtgttccgacagtttcaggagataataccggcagctttcggacagccgttcgatcgtagcttgccggaagcgttccgtttcataggaaatgctgacggtcatccggccttttgccgcaatcgcgctgatttcaagtgactgctcccgtttccatgtatctgtcacatcatctccgcctcccaaaggagaaaactgaaacgcgtcaggctgttccgtttctgccggactcccgccgggcgcatcgaattgtccgagataattaaagctgatctccggtgttttcccgaaagtcatcccggcaagcttcggcggtgttaaatatttgaggacgccgtatccgttccctttatccggaatgcgccgcaatgtgtctttgacggttttcaatgtgcgaatttcatattcttcaagaggttcataaactccgctccggacaagcaccgggtaaatggaagtgaaccaccccactgtcctgctgatgtccgcacctgcctgctccgattggcgtccgtgtccttcaagggcgattttcaaagcgtgccgcggcgaccacttttgaagggcaagcacggcggaagtcaacagcacatcttgcgtatccgtattgtaggcgctgtgtacatctttcaacagggcgtccgtttcactttctgtcagagtgaaggataccgtgttccgtttttttgcaggagtttgagatagatctgcctgctcgtaaggaagactttctgtttcatagtgttcaatctcccgccaatactccgcctgctgaagaagctgtttgctttcggcataatcggccagctgctccgtatatgttttgaatgacatggttttcggagggagtttgatttcctgtccagaggcggcctgctcataagcagaagccaagtcctccaataaaatccgccatgatatcccgtcgacagcgagatgatggaccgtcagaaacaagtaatcttctgcttcagagcggaacagccccgcctgtaccagcggcccgttctccaaatccatgtttctctgaagctctgcgacgcggcgttttataaaacgttccttctcatgctcatcgccttccgtttctaatatggtcaggttgtaaagctgctcatctgcgaggtcagccggtctgttgaagaggagaagacctttctcttcgtcttttttgcagacaaggcgcaaggcatcatgatgaacggtaatggcttttaacgttttcctgagagcctcttcatctattgaatttgttcttgtcagcatgacggactggttaaaatgatttgcttccttcatgtcttgtgtgaagaaccatttgtgaaccggcgaccacttcacttctccttctgcaggagcttggctgaccggctgccgctctgtacggacataaggagccagctctctaattgtcggccggctgaaaatatcttttacggcgatctgttttcctgcctgatgtaatcgggctgatacttgcagggctttgatggaatcgccgcccagttcaaaaaatgattgatccgcggcaatgttttcagttccgagcacttcgctccaaatcgcggaaagctctttttccatgtcgttttcaggctccgtaaatgcccgtccggtgtgcgcttttttccgcggctcaggaagcgcgcggcggtcaagcttcccgttcggtgtgacaggcagggcttcaagtgtttcaaagaacgccggcaccatataagcgggcatttcatttctgagcgcctgctgcacggtttcactttctgttccttcttctgtcacgatataagcgcatagttccgtttggcctgctgatgcggtatgagcggtgacggctgcttctttgacaccttttatgcctgttaaggccgattcaatttctttcagttccacccggtagcctctgattttgacttgctcgtccattcggccgatatattgcagcgtgccgtccggcagccattttgcaagatcgcccgtgcggtacatgcgccggttcttctggaacgggtcttggacaaaggcttgggccgtttgcttaggaagattgcggtaccctcttgcaaggccggaacccgaaatgcaaagttctcccgttacaccgatcggctgcgggtgatccccgtttaaaatataaacgtgtgaatgctcaatcggccggccgatcgtaatgttctcactttgttctatatgtcttgccgctgtagtggcgacgctgttttccgtcgggccgtactcattggcaagctccgtgtgaggacaaaccgataaactgcggctgataatgttttggtcgacagcttctccagctaatgtgacaattctgagagactctgcatcccccggctccagtacgtcaagcagtgtacggtacagtacgggaacaatgatcatatgagtgatgcggtaagatgcaagatagtgtttaatggcaagaatatctcttgcttcatcttcggctaaaacggctgctttcgcaccggaaatcagcggtgtgaacatacttgttacaaaaccgtcaaatgaaaatgaaaagagctgaagaaccgtatctttctcattcagatcataaaatccgcttcgccattgaagggtttggctgacggaacgatgttcgaccataacccctttcggcctgcctgtcgtcccggacgtgtaaatgatgtaagccaaatcttccggtgctgataatggctgaaccggtgatgcgtcttgttcttggatatcctccagtgcgagcacttcacctttaaaatgatcaggcacttgatctattgcgccgtgtgcggtaaggagaagcgctgtgccgctgtctgaaatgatatattgcttgcgttcctccggatattcaggatctatcgggacgtaggcgcccccggctttccaaaccccgaagactgccgcgacttgttccggcgatcttggtatcacaatgccgacggcggcattcggtccgatctgccgtttttgcagagctctggcgattttattcgaccagtcatctaattctttatatgtgaccaacgtttccccgctgataagggctgccgcatccggtgtttttcgcgcctgggtgatgaacagtccatgaactgttttttcaggcagctgtttatccgtcatgccgttaaagtccgaaagaattcggtcccgttccggagcagtcagcatgctgatcgcttgtatagaagtttccggttcacggacaatgtgttcaagcatcgtcataaagtgggaagcccagcgctgcatcgtttctttccggaataaagacgccgcatattcaaacagaaaatgaatctgtcccccgccttcagaagcctgcaaagtgacatcaaatttggaaaccggacgggacacgtccgcaggctgaatatgcaaaccgtccaacagcaattcctcatgttccatattctgaacgacaagcatggcatcaaatagcggattacggcttgtgtcccgctgcacgccgagcc

SEQ ID NO: 109 - DNA, 171421 bp, Bacillus velezensis FL50S
ttaaagaggcttgtttttttatttctcacatgcgatatagtctttatcccggtcaagtcttttatttgcattataaagcgcttttgatacatacggcttgtactttgttctgccgcccttgtttttcactttcgacgatttggccacgccgcccttatacaccttattcagcgccttacagttttgatacgtttttacctttgttttcgcttctgccgtctgccccgctccgtatgaacaaccgaataccaggccgaaagacaaaagcacagctgccgtctttttcatttctatcctatcccctttcctgaatcatgttgtgtgactgaacatatcatagttcaaataatctccatttacaagataaataggaaaatagtttcaatttacgtccgcccgtatatcttttatggaatttttcccaaaaccttttataatatgaattgatagcgctatctgactatgatgataggaggagaaatgatgatgaaaaaagggcttgttgcgggtgttctcactacagccgttctattcggcgcatgtacggcggatattccgggggtgatcagtcccaatacggctgaagcggcttcccagctcagtaaaggaatcggcggaagggcctatctgaacagcacgggctcagttctcgtcacgaaaattcagcttccaagctcgattcaggtgtcaaatgggacagcctatatttactcaggatttaccggaggcacagaggctgatatcgggcttcagtacagtgacacctatcatgtatggaaaccgatcatgaaagtcggttcaaagggacaaggccaggtccggtatctggaaggagaaagccaattcacttatacgaaaggcttccggcccggcagcaccgtacagctgaccatttacaaaaatctgaacggcaatacccgcgccacatattggggcacgaataatgacggatacaccggccgcatcatctcagaactcgcccaaaccaatgtaggctctgtctcaaaatggaaagcgctcgccaccgtcgcggtcacatcagaggatcagcgcccttacatcaaatcaaacttctcgacagcctttacgaacatcacgatcgacaataaagcagtcacacctgtgattgatacacaggattttgccaaattgacagtgtcaggcagcagcgtcagcatgtctgtcgtcaaataaagaattttgaacgcacgatttctgtcatcgtgcgtttcgtaagggtctgccggatacgcaaatcccttatttttcggattacgtttaataaaaaaacagccctcctcagggttgtttttttaacatttctttcattatttccgccaaaacgctgagcagtccgccttatcctgaatattgaattgaatcatgctttcaagcagctcataatgcaccggttcagtccattgaattctgaacaaacgggaagtagcgctgtagccggcacgggcaatgccgtcggcaaaatgcgcaattccagcttcttcgggagaaacacttacatgatgctttgctgccgcaaagccgataataaaggtgccgtgatcggtaaacatcggcgtgttccacttgatctgcggtgttaaacccgggaattgctcagacgtccacgacaggatttcctccattcgcagacgatggtcagggctgtcgatacttgataaatagtctttgaaaacgtccatgtcttcctccttcaacatcacgtccgctaacgccaaaaccccggattttcagctttttccttgatgttaaattcgatgatcttcttaagcagatcatagtgcaccggatcagtccaccgaattctgaacaggcgtgaagaagcgctgtacccggcttgggcgatgtcatcggcaaaatgctccatcgtctctttttcaggtaaaatgctcaaatgattttttgccgcggcaaacataatgatataggtgccgtgatcggtaaatgtcggtttgttccacttgatctgcgcttctaagttcggaaattggtcagccgtccacgacaaaatttcctctgctttgagacggtgatccggattatcgatttctgatacatattttgcaaacacatccatgcccatctctcctaaaatgaattatcattactctttacatcatcatagccaacagacggacacgatacaactctatccgggcatgtaaatcgaagcccttcccaaaaggaaagggcccgtcccttcacatcacagctttctctaatatctctcccccagctcccgcaaaataaagtcgtagatcattcttgtccgctcttctttcggatacagcatgaattcctgccgcttcgggatatgactgcccatcctgtcctgaaaagtggttctgagataggcggttctgtaaacctgattttcaaaagaatgataggatacttccagttccatcgttttgccgtttgagaacgtgaccgctgtgtcatcaaatgccgtcggttgaaaatctttaacgtgcacatgagatatccagccgcattgaggccttgcagaagaaagtgtagggaataaaaagatgtgatttgaagggtccaccataatcggcggcttgtgagaaattttaatcgcttcatatgttcccgcttttctcccggcatagctggagccaaagtagcggcagcttctgtcgatgatgtgaatcggcttcatgctgacatacagaatgcagtctttttcaatgaccttcgaccccattttaccgtctatttcctcaggcaaaacagcgatggttgaacgatttacttcgtagctttctaagggtgcgtgtgttttctggcacatgatgtgcagcctccaatccttttcttgaaaatttatactaataatctatcatctgtcattggaaaacgacaggttttttttgaatatagctaaaaatcaccttttaaagctgtaatttagtcttaaattactatttaaatattatttttcttttttatttcacctcatttatacaatgatcattttcgttttttcgtcaatttgcaggatatgtcgatatatttccaagtattagttgtctaaagattataaaaattaattgatttttccggccgttatccatatactataaaaaaggcattggggggattctttatgaaagagaaaaagtcgtacactgagctcatgaagtcccgcaacacggaaaaagcaaacgaattcgatgtgacaatggccgatatttacattcaaatggtgcttgatgaatccttgtataaacgccggatcgccatgctgacaatgcagattaataaggcgcttgatgataaaaataaagaagcgttcctcacgctttcaaaagaatatgccgctctcaaacagagtgaataagccaatccatatggattggctttttttacattatccgtttacgatggtgccgccgttcacatgaatcgtctgtcccgtgacataggaagaatcatcgcttgctaagtacaaatagctcggcgccacttcaacaggctctcccgggcgctgcatcggcacgtctgagccgaagacttccacttccttcgccgagaagctcgccgggatcagcggcgtccagatcggccccggcgccactgcgtttaccctgatgccctgagtgacaagagattgggaaagagatcttgtaaacgtgacgatcgccccttttgtcgctgaatagtcaatcaatgttttgtggcctttataggcggtaatggaggccgtattaatgattgaacttcctcttttcaggtgagggagcgcggctttcgtcaagtaaaacattgaaaaaatattcgtctgaaacgttctgatgagctggtggctcgtgattttctcaatccccggctgcacgtgctgctcacccgcgttgttgaccaggatgtcaatggaaggaaaggcttggcccgcctggcggatgacatcgttgcaaaaggcttcgtcgccgacatcccctgcgatcagcagacacttcgccccttctttttctacatattgcttcgtctcttcggcatcctgatgctcatcaaagtaaacgatgaccacattagcgccttcctttgcgaataaaacggatacggcgcggccgatcccgctgtctccgcccgtgatgatcgccgttttcccttcaagttttttcgccgctttcggtttgtcaaaaacggggcgcgggtccattacatattcaaagcccggctgccggttttgatgctgcggcggcaaggttttcttcttctgattcgccattttgatcactcctttacattaattactatattatgagtaatttgagcatcttatacgaatttcatgtatgaacagagtcttattggaaaaattaagaatatacaacagaggaggtaaatctgaattgactactttttcaaacgaggaaccggcttcctattggaaagcaacagctgacattccttcctttcccgccctcactgaagatacggaatgtgacgttgcggtgatcggcggaggaattacgggcctgacaacggcatacgaactgacaaaaagaggtttccgtgtcgctgtcattgaagcagaccggattttaaacgggacgaccgcgggcacgaccgcaaaaatcaccgcccagcatgatttcatctatgccgatcttattcagcagatcggcctgaccagcgcaaggctgtatttcgaagcccatctccgcgccatggaagacatgaagcagatcatcaaggacctttcgattgactgcagactgattgaacaagacgcatatctttacaccaatacagaatcaggcgtcaaaaaaatgcgcagtgagcaggaagcttataccaagctcggtattgaacacgagcttgtgaaagatcttcccgtccccgttgattgcaggctcggcctcgccatgaagaatcaggcgcaattccatccgcttttatatggtgcggcgctcgtcaaagagatcgttaaaaacggggcgcggatttttgaacagacggctgcgatcgacataaaaaaagaaccgcagccggaagtggtcacgaaaaacagacacggcatcaagtgcagctacattgtctgcgcttcccactttcctttttatgacggaggcgggctttatgccgccagaatgtatgccagcagatcctacgtactcgcggtaaaaccgaaacaagcgtatccggacgggatgtatctcagcatagacaagccgtccagatcactgcgatacaccgatttaaacggtgaaaaactggtgcttgtcggcggtgaaagccacaaaacaggccaaggaaaagaaatgtccgggcattacgaagcgctgaaacaatttgcggaagacacaatcggagttgaaagcatcccatatcattggtctgcacaagaccttgtcaccattgacaaaattccgttcatcggtccgatctcaggcgatgaagaacatattttggcggcgaccggttttaaaaaatggggcatgacaagctcagcgctcgccgcgaagcttttggctgatcatattcaaaacaaaaagaacccgttttccggcctgtttattccgtcacgcttccacgcagatcccggactgaaaaaactgatttcctataatgccgacgtggccaaacaccttatctcgggcaaacttgagaggccggacgcttcgcctgagagtcttgggcccggggagggaaaaatcgtaacggtaaacggcaaacgggccggcgcctataaagatgaaaaaggctgtctgcatcttgtcgatacgacatgcacccatttaggctgtgaggttgaatggaatgacggcgaacggacgtgggactgtccatgtcacgggtcccggttcacacccgacggcggggttgccgaaggtcccgccatcaagccgctgaaacgtctcacccaagattgactaaaccattctgtacgaatggttttattttttccgcattaaaatatttttatcagattccttcattcaagttccttccaaaccgataaaaagaaaaagagaatatctgggggaacttatattgttatttaaaaaagaccgcaaaaaagaaacagcatatttttcagaagccgatggaaaaaaacgcatcgcgctttcaaatcaatatgcagatgtccaaaaacagctgaaaatggtcaggctcggaaacgaagaacttcatgtgcttgaagagctgcagccgttaattaaagaacatatctcaacaatcgtcgattccttttaccgaaacctggatcacgaaaaatcattaatgacgatcattaacgaccacagcacggtcgagcgcctgaaaaaaacattacggcgtcatatccatgagatgttcgccggcacaattgatgatgaattcattgaaaaaagacagcgcatcgcttccatccacttgcggatcggccttgaaccgaaatggtatatgggagcgtttcaggatctgcttctgtcgatgatgaacatatatgaagcaaccattccggatttgcatgagcttttaaaagcgatcaaagcgacgacgaaaatattgaatcttgaacagcagctcgtccttgaagcattccagactgaatataactgccagcgtgacgaacaagaggaaaagaaagcccgccttcatcagaaaatccaggaaacttccggatcactcgctgatttgttttcagaaacgagcagagccgtgcaggagctggtcgataaatccgagggcatttccgaggcgtcaaaagccggcaccgtcacttccgtacatgtcgaagaaaaatcaatcggcgggaaaaaagagcttgaaagccagcagcagcagatgaataaaatcgacgccagccttctgcagattgaagaagaaatggacaagctgaatgacatcgcccagcagatcgaaaaaatcttcggcatcgtgacggggatcgccgagcaaacgaatctcctgtcactcaacgcttcaatagaatccgccagagccggagagcacggcaaagggttcgccgttgtcgcgacggaggtaaggaagctttcagaggatacgaaaaaaaccgtttccaccgtatcagagctcgtgaacaataccaatacacaaatcaacattgtgtccaaacatattaaagatgtaaacggacttgtaagcgaaacgaaagaaaaaatgacgcagatcaaccgtctgtttgatgacatcgtccaaagcatgaaaacgagcaaagaccagacaggcaaaatcgacgttgatttgcaggcctttctcggcggccttcaagaagtcagccgcgccgtttcccacgttgcatcatccgttgattcacttgttatccttacagaagaataaagataaaccgaccggcctttttcataaagggccggtctttttaatgttaacttaaaatataatagagttgacatatataaagactcgctttattgtataaacatattttgataagctggaggaatacataatgaaattgacagaaatgatgcatattgccgtgtttaccgccattatgggacttttggggctgcttccgccgcttttcttatcctttacgccggtgccgattacgctccagacgatcggtgtgctcttatcgggaagcatcctgaaaccgaaagcggcgtttttaagccaattgctttttttgctgattgtggcatgcggagcgcctctcctttcaggcggaagaggcgggttcggggtttttttcgggccgagcgccggatatctcatcgcatatccgctggcggcattactgctgagcctcagcatccaaggccttcgctcagccgctgtcccccatttgtttatcagacagttcttgttcggcgtgctgtttttgtatgtcatcggcattcccgttcaggcttttatgatgcacattgatatcttgactgccgtaaagctcagcctcatctatgtgcccggagatctgcttaaagcggccgcagcctcattcgcagccgtaagaatcagaaaaactcttcaagctagccggcttttgccgacgaaaggaagctgattttagtcatcatgattacatcatcatattcagatacagccggacaagcgccggaacggatcgcaattcagacagacacagaacagatcacctatcaaacttggaacaggctagtaaaccaaaccgcaaactggcttggcagcctttcagataaaccgaaaaacattgcaatattactgccgaacggcatcccatttttacaacttttcgcaggagcggcgcatgccggctgcacggcggttccgttagatccccgctcggctgcggcggaactcgcggaccagctgcacatcagcaaaaccgacctcgtcatctgtgaccgccggctgagcggcagactggacggcatcaaaacgcctgtcatcctgtgggatgaatgcgggcctttgatcgaggcggaaaaaacggaaggcgcttttatcaaaaacaccggcctgcccttttataccggattcacctcgggatcgaccggtaagccgaaagccttcacccgctctcaccgttcgtggctggagagcttttcttgtacgaaacgtgaattcggcatttcccctgatgacaaagtgctggtaccgggcacgcttcgctcgtcacactttttatacggcgccgtcagcactttgtttatcggcggaaccgtcctccttcaaagaaaattcaatccggccggaatgaaagaccggctcagacaagctgacgttctatataccgttccgacaatgacggacgccctgctctcactagaggcgtttccggatacaccgctcaaggtgatttcttccggtgcagactggcccgcttcgtctaaacaagcgctgtcagagcgctatccccatttacggttgtacgatttttacggaacgtctgagctgagtttcgtggcgttcttatcgcctgaagacagcgcccggaagcctgacgcggcgggccgtccgtttgaaaatgttacaatcgaaatccgccggcccggcggggaacgctgcatgccgggcgaaacggggaagatttttgtgaacagcccgatgaaattttccggatacatcaacggcgcaaaacctgatgattccggctggatgacggttgatgacatgggatatatcgatcgtgaaggctatctttatatcgaaggacgtgaaaacgggatgatcgtatcaggcggcctgaatgtattcccggaagagatagaacgtgtgctcaaccgctgtccgggcgtcagaaaagcggccgtcatcggcattcctgatgattattggggcagcatcgccgttgcggtgatcgacggacatgcaaatgtaaaggaactgaagaaacagtgccgcgagcagctggcggcatataaaatcccgaaaaaatggctgttttcagaaataccggaaacagccggcggaaagatcgcccgtgccgccgtacaaaagctggcaaaggacatgatggaatggaagctgtaattacggatgcgaagcggacgattttcgcccgggaaaacggcctgttaaaagactgtctccccgaagatttggcagctccgctgatccgacatttgagccggaacatgcccgaagacattgatgaagtcctgatcggaaacgcgacaggccgcggcgggaacctcgcccggctgtcagccttggccgccgggcttcctttgagcgtgtccggtacgaccatcgacaggcagtgcggttccggattggacgccgtgagggtcgcgtgccactttgttaaagccggcgcggggagcacatacatcgcgggaggagcggagagcagcagccgttcccctttctcatcccgggcgcgcttttctcctgaacacatcggcgatcctgatatgggcatagcggccgagtatacggcacaggcttacggcgtaacgagaaagatgcaggacgaatatgcccttctcagctatgaacggagcgtcaaagcgcacgaagacggcttgtaccgccgggaaattctcccctgtcacggattcgccgctgacgaaaacatgctgaaaaagcggaacatggagcctctcatcgcccgcgccaaacccgtctttcagtccggaggctctgtcaccgcggccaacagctgcggaatttctgacggggcggcggcagtttgtgtgatggaagaacaaaaagcgcggtctctcggtttaaagccgggattgcgttttatcggaagcgcggtaagcggcgtccatccgcattatccgtcagcagctccggtttatgccgtcaaaaagcttttgaaggaacgggacctgtcaccggatgatattgatatatacgaaatcaacgaggcgtttgccgtcaaaatatgcgttttttcacagcagcttcaagtacagtattctaaaataaatgtccggggcggtgctctggccgtcgggcatccgtacggggcttccggggcggcgcttatcacccggcttttttatgaagcaaaaagacgcccggatgcccgctacgcagcagcagcgatcggcagcggaggcggagtcggactggcgcttctctttgaagtgttaacgtaacggcagtataatagatgatatcgataaaaaatgatcggagtggagactttatgactgccgtttgtttagtaagacatggagagactgattggaatgcccaaaagaagcttcaaggcaaatcggatattccgttaaatgcgacgggagagcgtcaggcgaaagaaacaggagagtacttaaaggggtccgaatgggatgtcatcgtctcgagcccgatgaaacgggccagaaaaacagctgacattattaacgggtttttgaatcttcccattgtcgtcatggaagatttcagagaacggagctacggtgatgcggaaggaatgtctttgccggaacggtcgaagcgctacccggataaaaactacccgaacatggagaccgcagaagagctgacagacagaatgcttgccggtttagtgaaagttcaggagcggtttcctgatcaaaaagtactgatcgtcgctcacggcgcagccattcacgccctcttgtccgctatttctgacggtgataccggcatacaaaacgcaaagcttgtcaatgcgtgcctgagcaatatcgaacgaattgaaaataagtggcgcgtcaaagattacaatgtaagcagccacctatcagaatcataacaaaaaggcccgaattagttttgggcctttttggcgagcatttttttctgaagatcatgtaatacggcgtccgcaccgtcaatgctccggcgctccgtccataccgccctgtccgcgcggtaaacgtgtccgttttttacggcagtcagctgtttccagaggtgatttttttcgagttcttcctcaccgtccaatagtacgatgtaatcaggatcgatatgcaaaagctgcccgggcctcattttgatagcgtctgatttcccgccggaatccgtctggaccgcatatgtaaaccctgcgagcgtcaaaagccgggatgtgaaaagccggtcatcctttacggaaatgctgccatttgcagcgtcaattaataaaatcgtgccgccttctgcatccagctttcttttgatgtcattcagcttttcttcctgagccgacaattgtttctctatgatgccctctttaccgaccgccttttcaatggtaagggcagcatcaaccgcatcctgataatccgcagcttcatttttcaaagcgattgtcggagcgatctttgtcagctcatggtatatccccctgtgcaggcttgagtctgcaatgatgagatcgggttttaacgaagtgatttttttcaaatcgggatgtgacgggggcccgacggacggactgccgtcgtttcgctctttccggttatccgccgcggccgccggctttataccgagatcatggagggtgtcaataaagccctcattcaatacggcgatgcgctgcgggtgcgcagccacatgcgccgtccccagatcgtgcctgacggcggtttcatgttcctgttctgagcatgccgttatgaagagaacggataagatcatcagcatactgaaaattggtttcatctgttccccctctttcgtttttccgcaattatatcattgacaatataagtatcaatgatattcattatcattatttttataaaatggtttcacagcttttctccctcaagaaagccaaagactgattcatgccggccgctttatttcattccgctttcgtttccatcagacttctgcattcaacaaaaggtgacatttatcctgtttttgcctcagcttccaaaaatggaatcaaaccgttcgacccagtaaacaagagagcgattgcggctgtgtacaaatactcatgtccttccatcggttttttccattaaaatttaaatatttcgggttcctattaaacgaaagagagatgatatacctaaatagaaataaaacaaactgaaaaaaattgggtctactaaaatattattccatactatacaattaatccacagaataatctgtctattggttattctgcaaatgaaaaaaggagtggataaagagtgagaggcaaaaaggtatggatcagtttgctgtttgctttagcgttaatctttacgatggcgttcggcagcacgacttctgcccaggctgcagggaaatcaaacggggaaaagaaatatattgtcggatttaagcagacaatgagcacgatgagcgccgccaagaaaaaagatgtcatttctgaaaaaggcgggaaagtggaaaagcaattcaaatatgtagacgcagcttcagctacattaaatgaaaaagctgtaaaagagctgaaaaaagaccctagcgtcgcttacgttgaagaagatcatgttgcacaggcgtacgcgcagtccgtgccttacggcgtatcacagattaaagcccctgctctgcactctcaaggcttcaccggatcaaatgttaaagtagcggttatcgacagcggtatcgattcttctcatcctgatttaaaggtagcaggcggagccagcatggttccttctgaaacaaatcctttccaagataacaactctcacggaactcacgttgccggtacagttgcggctcttaataactcagtcggtgtattaggcgttgcgccaagcgcatctctttacgctgtaaaagttctcggcgctgacggttccggccagtacagctggatcattaacggaattgagtgggcgatcgcaaacaatatggacgttattaacatgagcctcggcggaccttctggttctgcagcgttaaaagcggcagttgacaaagccgttgcttccggcgtcgtagtggttgcggcagccggtaacgaaggcacttccggcggctcaagcacagtgggctaccctggtaaatacccttctgtcattgcggtaggcgctgttaacagcagcaaccaaagagcatctttctcaagcgtaggttctgagcttgatgtcatggcaccaggcgtctctatccaaagtacgcttcctggaaacaaatacggcgcgtacaatggtacgtcaatggcatctccgcacgttgccggagcggctgctttgattctttctaagcacccgaactggacaaacactcaagtccgcagcagtttagaaaacaccactacaaaacttggtgatgctttctactacggaaaagggctgatcaacgtacaggcggcagctcagtaaaacataaaaaaccggcgtcggccatggccccgccggtttttttattatttttcttcctccgcatgttcaatccgctccatgatcgacgggtggctccctctgaaaattttgacgagaaacggcgggttgacccggctcagtcccgtatcggccaagtcctgaaacgtctcaatcgccgcttcccggtttccggtcagctcgatgccgtaacggtcggcggcgttttcctgataccgggagacggcgttcgtaatcggatcagaagcaaaactgagaacggatatgagcagcaataacagcgggagggcggccagatcttcaggcccctttatatgaagcattcggccgaagaatttggacagccgcttataaagcttgtcaatgatataaaacccggctaatgacagcagcagatacccggccagtccgatgtacacgtgcttcatcacatagtgccccatctcatgccccataatgaacaaaatttcccgatccttcagtttgttaagcgtcgtatcccacaaaacgatccgcttattcgaaccgatgcccgtcacatacgcattcagcgcattcgttttctccgacatatttacttcatacacatggctggccggaatgtcggccttgtcggcaagcgacaaaattttgctttccagctccttgtctttcagcggatagaaatcattgtataaaggatcaatcacgaccggctgcaggaaaaacaaaaacagggtaaacggcacagtaagacaccaagcgtaaaaccaccatttttttgtatgctttgtgatcagccagtaaaacacaagcacacacacggcaaacagcggaaaactgatccagaaatcaatgacatggtctcttatccagcttgctgctgtctgcgtcgaaatatgatacgcaagcgaaacccgatatccgatccactcaagcggaagcgaagccgccgtaacgatgagtgaaatcacaaatacgaagcttacgatttgcagcacccgaaagcgcaccgctgcttccagccaatgctttattttttttgcaagccccgtaatgagcagcagaaaaaataaaaaccaatctaacggcgctccgatgaaaaataaaaaatcctttacatttgaaaagttttcagcggctgccaggcggcccgggtccataaacgaggacggatcggctttcgttccctttacagcctccgggacggcggagtctcctgtcataaagaaataccaatagaaaaaaaggccgtacagcacataggcaagtcccgctgccgctatccatttgcgcatggaagtctccctccttagccttatgacttactcctattgtaagcataaatgcaaataaatagaaccaagcctccgaaacggatgttaatcttttcacaacagaaaagaatggaacaacaggaagcgggaaagactaaaagacggagtgatgaatatgaaaaaaataatcgcgtttattgtagtaatcgcccttttggttattgctttcttctatgtatacagccggaccggcgatgtgtttccatcaagcaacgcagatctgattattctgtcagagcacggaaaaaaagaaatcaaaattaaagacaggcagaatgtaaaagatatgctcgatatcttgaatcaaggaaaacaagtcaaactgaccaaaagcgtgtctcccgattacgacggaacggtcaaataccatgaagaccgttttgattcatttagcatgtggctcgaaagcggcaattatatgatgtacaagtataaaaacacgtattacaaactgacccggcatgatacgaagcttgtgcaaagcatcattaaggaagaatcgcagagctgaccggatcagcatgtaaaagcgaagcccccggcttcgcttttcgtccgtcatttcggaagcatgtcccggaccgcccttctcagcagcttcccggtcgcgttcttcggaatctcatcaagaaaaaccacttccgccggccgcttatattttgccaaatgtgtttcacagtaatcgaaaaccgcctgctctgtcagctcaccgtccgcaggcactatataagcatgcaccgcttcccccgttttggcgtcaggaacgccgatgaccacggcttctttaatgccctcatggctgtagagcacttcttctacttcgcgcggatagacattgtatccgccgacgagaatcatatctttttttctgtcgacgatataaaaataaccgtcttcgtcgcgcttcgccaaatcacccgtgtacagccagccgtctttcagcgcgtgctccgtctcctcgggcatcttgtaatagcctttcatcacattcggccctttcacgatcaattctcccacttgatggtcgggcaattcgcgtccgagcgtatcgacgactttattttcgacatgtaaaatattcgtcccgatcgagccgggctttctcccccggtcaaacggattaaaacaagtaaccggagacgcttcagaaagtccgtatccctccagaatggtgacgtcaaaggtttgttcaaacgtctgcaacagagcgaccggcatggaggccccgcctgaaatgcacagtctgacggacgcaaaatcctccgccttgccgtgctcgtattgatacagatagttatacatcgtcggaacgccggcaaaaatggttgcctgacggcttttaatcagtttaaacacagaagccgggctgaattgcggctcgattaagacacacgctccgctcatcagaggcgcattcatacaaacggttaaacaaaaaacgtgaaacatcggcagtgccgccacaattttgtctttctcattcattcctaagtatccggcgacatcatttgcattggagaaaagattctgatgggtgagcatggcgcctttcggttttccggtcgtccctgaggtgtataaaatgacggcagtatcgtctttggacaatgtcggataagttctgctgcgctccgccgggcggagcatttttgtaaacgttgtcatttttaagcgcaattgagggtcttctgtcgatggagcgttctctgctgtctggctgataatgatatgctccagcagcggcagcgagccgtgcaggctttcaaatacgggaattaataggtcgatgccggcgatcgctttgacatcgccgtttttcagcatgtatgcgatttctgaaggtgtgtatgccggattaacaggtatgacgacaattcccgcttttaacgcgccgaaaaacgcaataacaaagtcaggcgtatttccgagcagcagcgcgagatgatccccttttttcagtcccctgtcctccaagccgtttgcaaatgctttgattttacctgccagctcctcatacgtcatgtactgatcttgaaacagacaagctggtttttccggtttctgcgatgccgtttcttccaatttggaaaccagattcattttcccacccctttaaaaatataatgaatgaatagtcattcatttatccggaataaacgttcacttttattatagaaaaatatagaaaaacactcaagggcaaaaagccccgagtgccgtaaaaccggaaactataattgtttcagcgcttcactgaccggcgtgccgcccgctgtcagatcgaacgctttttcatacgtattcggttcatcaagggatgcgataacggtcttggcgacatcgtctcttgaaatggagcctctttctaaatcggccgcggctttgatatttcccgtgccgggatcatttaataacccgcccggccggataatcgtatacgtcagaccgctcgcttcaagaattttatccgcataatgctttgcggcataatacggcttcagcgcttcattccaattgtcgcggttatgagcctgaagggcgcttaccataatgaaccgcttgatgccggctttctttgccgcttctatcgctttcgccgctccgtcaagatcaatcagaagcgtcttatcgtatccggtgcttcctcctgatccggcggtaaacacaatcgcgtcacagccttcagcggctttcgcgatgtcttccgtgcttccttccaaatctgcaagaacagcttctgttcccgcggtttgaagcgcttctttctgctcttctttccggaccatcgcccgcagcgtatgcgtgccgtctttttgaaacagcccggtcagacgctgtccgatctgcccgtttgctccgatgagaaatactttcatcatgatccctccccattcattatggttctatcatttcacaaaaacgggcgctgattcaagtcatgcgttcggcaaatgttctaataaatcagctcgaggaaatcttccagctctattttgccgaaatactgtttcagatcgattccggccagcgcctccctgatagcggttctgtcatactgttttccggtcagcgcctgttcgacttcactcacatctttcgcaccgaagaaatcaccgaaaattttgcagtcctgaatgattccttttttcacttcaagacgcagatcaatcgatccgaccggataacgtttcgaatgctgaaggttgaatgcgggcgaccttccgaaattccagtcccagttttgatagcgctcttcggaaatcttccggatcgctttccagtcttcatcggtcagtttatattccggcacttcggaaagatcatttgtattaaaaatatggtgaagcagatgctttttgaattcgtccgccgtcattttgtcatcaagaaactcgctgatattggcgacacggcttctgattgacttaatgccttttgattcgattttgtcttttttcactttcaaggctgacacgacatgatcaatggcggaatccagcattaatgttccgtggctgaaaatacgccctttcgtcgaaaattgagcattgccggaaatttttctgccgtccgcgacgatgtcgtttcggccgcttaattcagcttccacaccgagctggcgcagcgcctgaataacgggttcggtgaattttttaaaattgtggaagctgtcgccgtcatccttggtgataaaactgaaattcagattcccgaggtcatggtaaaccgcgccgcctcctgacagcctgcggacgacgatgattccgttatcttctacgtatttcgtattgatttcttctattgtgttttggttcttcccgatgataatcgacggctgattgacataaaacagcaggtatgtctgttcagggtcgagatgcttcacgcaatattcctcgattgcgaggttgatcctcgggtcggttatgttttggttgtcgataaataacatggtgctcctcctttatttctcccacttcaatccggaagcggcgattgtcacttcgcccccgaacacggattccgcttcttctttcagcttccggtgctcgccgaaatgaggcagatgtgtgagaatcagctcccccgctccggcctcctccgcgatacgtccggcttccaaactgttcatatggccggctgacgtgccgtcctggtccgcgtaaaaattgcactcgcagatcagcagatcggcattttccgcaaacgggataaacgcgtcctggtagcttgaatcagccgtatacacaacagaagctgaaccgtcagtaatccgcatcgcataacaagtgaccggatgcaccgttttcaggaaggtaatggtgaacggcccggcagaaagcgggcggtccggctgataggccactcctttcgtatgcgttttatatgtaagacgctcaaactgttctatatcagcatcatgcccgtaaatcggcagtgcatgcgtcccttttccgagaaaggagccgacctgtttggcaaattgaagcggcccgatatcagcgatgtgatcatggtgataatgggacaaaatgacggcatcaagctcttctgccggaacataggcaaacagctttgataatacggcgcttccgcaatcgacgagcagagaatagccgccggactgaaacagatagcctgaagttgcttcgtttgcggccggaaacccgccgcagcatccaatgactgtaattttcatatggtcctccgaatgtttatgataaaaagatcctttcctccaatatacctatttttcgtacaaattgcatgttttaaacattgtgccaaaacagccgttgattttccgaaactgttataatacaatgtagagacaaaacaatgaaagagggatgggtatgttagaaaagatgtcggattttttcagaaatttacccggtaagaaatgcgaagaatgcggaaatgagattgttgagcagtatgagtgtcacattaatttgtgcaatgactgcttgaaaattaaggatatgtgacaatagggcgccgcacaattctaagttgtgcggcgcccgttttttcggccgtcatcatactttctgaatagggcgttattcaccattattagcaattatctgtacgttttaaaagattcagtattttcaatctatatttttctatagacggattgttttcttttctattataatttgttctaatagctatctttttagatacttattgcacttttttcttcgggaggtaatctatgaaaaaattacgatttggactagcgacgcaaattttcgtcggactcatactaggggttgtagtcggtgtcatctggtacggcaatcccgccattccaacatatttacagcctatcggcgatttgtttttacgcttaatcaaaatgatagtgattccaattgtcgtctccagcttaatcatcggcgttgccggcgcgggaagcggaaaacaagtcggaaaattaggcttcaaaacgattttgtattttgagatcattaccacttttgccattattctcgggctggctttggcgaatctgtttcatccgggaacaggcgttaatatacatgaagctcaaaagacagatatcagtcaatatgttgaaacagaaaaagaacaaaataacaaatctatcgcagacacattcctgcatatcgtaccgacaaacttcttccaatcattagccgaaggagatctgcttgccatcatctgctttaccgtgctgtttgcactcggcatctcggcaatcggtgaaaaaggaaagcctgtcttggccttctttgaaggtgtttctcatgcgatgttccatgttgtgaacctcgtcatgaaagttgcgccgtttggtgtttttgcgttgattggtgttaccgtttccaaatttgggctcagttccctgctttcactcggtaaactggtcggtttagtgtatgtagctttggctttctttctcattgttgtattcggaatcgtcggaaagcttgccggagtaaacattttcaaattcctcgcctatatgaaggatgaaattttattagcgttcagtacgtcaagctccgaaaccgtactcccccgcgttatggaaaaaatggagaaaatcggctgtccgaaaggtattgtttcctttgttgtgccgatcggatatacctttaacttagacggatctgtgctgtaccaatctatcgccgctttattcctcgctcaggtataccacattgacttgtccatttggcagcagattacccttgtgcttgtcttgatggtcacttccaaaggaatggctgccgtgcccgggacttctttcgtcgtcctgcttgcgacattaggcgcattcaacattcctgcagaaggccttgcattcatcgccggtgttgaccggattatggacatggcccgcacggtcgtcaatctgaccggaaacgcgctggcatccgttgtgatgtcaaaatgggaaggccagtatgatcccgttaaaggcgcgaaggtcatgagcctcgccaaaacagaacaaaacacaaccatttcaggttaaaatgaaaaccctgcacggaatgatttccgcgcagggttttttatgccatcggcgatagaacgtaccggtgcaaaagcttcgccgtattaagaagcgataattcatgcgtgcgttcaaaagcgtgtgaagcgtcaattcccgggccgatcagcccgtgaacgatgtcatggcccgaacggatggctgctgaggcatcagaaccgtaatacggataaatatcaagctgataatcaatgccatagcgctccgcaagcccggccagatgttttctgagctgataatggtacggtccgctcgcatccttcacgcaaatggagacggtatattcatccgtagactggccgtcgccgatcgctcccatatcaacagccaagtattcgacggtctcaggaggaatgttggaattgccgccgtagccgatttcttcattattagaaatcagaaaatgcgtcgtatacggaagttcgattttctcttccgtgatgcggcggattaaattcaagagcagagccacgctcgctttgtcatcaagatgccgggacttaataaagccgctcggcgtaatctgcacgcgcgggtcaaatgagatgaaatcgccgaccctgatgccgagctcggacgtctcttccttcgtccggacaggctcatcaaggcggacttccatattctcctgattccgctctgccttgccggcgtccttgtagacgtgcactgaagtctgatgcattaagatggtgcctgtataggttttgccggaagaagtttggatctcgcaatattccccttcaatcgagtgatatcggaagccgccgatcaagtcaatcttcagccggccgtccgactttatttcctttaccatcgcgccgagcgtatcgacatgcgccgtcagcaatctgtgtttcttgtcatcacggccgggaattgtgacaaaaagaccgcctttgcggtttctgtaagaggagacgccccattcttttaaaagactttctgtataggcgataacctcgtatgtattgcccgtcggactcggaatcgacaccagttctttaatcagttccatcgtatgtttcatattttccacaggtcattcctcctatcaattttattcttcttaaaatatactcttttgatccataacccgtccaatcttttcctgctcttttttcatagaatgaagggagcatgagcataggagggaaatgtatgatcagccgtaaaccgcacaagcggaaaaggtttcataatgattggtttgaggattggtttgaggatgattggtctggtgcagccttctggtgctgtaaaaaagaaaaagatcactgtaaaaagaaaaaagaagacccttgcaaaaagaagaaagacaaaaagaagcatcatcattcatgccgccgctgctgccgtcattggtaatcgttcacacaagcccgttttacaaataaaattctcatgctccccaaacagcggatgctgcttgggtttttttattaaaattagtaccaagtaataatatcaggtgttataatctgatataaaggagtgattttttcatgtcaaaatctaaaattacagcaatcggtacatatgctccggcacgccgattaacaaacgcggatttggagcgcatcgtcgatacatctgatgaatggatcgtccagcgcaccggtatgaaggaaagacgcattgccggcgaacatgaattcacatcggatttgtgtgtggaagcggtgaaaaaccttgcagaacgatacagcggaactcttgatgatgtcgatatgattcttgtcgccacaacgacggcggactatgcgtttccaagcaccgcggcacgcgtgcaggcttacttcggctggccgcacacgggagcgcttgatattaacgccacatgcgccggactcacttacggccttcagctcgcagacgcattaattaccgccggttcccatcaaaaagtgattgtcattgccggtgaaacattatcaaaggtaacggattatactgaccggacgacctgcgttcttttcggagatgctgcaggcgccctattggtggaacgcgacgaatcagcgccgggctttttggcagccgtgcaaggaacagcgggaggcagcgcggacgtgctgtatcgcacgggactgagcgcagaattaaacggcgagccgcttaaaggcggaggaaatatggtgcaaaacgggcgcgaagtatataaatgggcggccagaaccgtgcctgaggaatgcaatgcccttttagaaaaagccggcttttcaaaagacgatctggattggttcgttcctcacagcgccaacatgcggatgatcgaatccatctgtgaaaaactgcctttcccgattgaacggacattgacaagcgttgaatattacggcaacacttcatcggtttctattattctcgctttggatgaagctgtaaaagcaaaaaaactgtcggaaggccagacgctggtattgttcggattcggcggcggattgacgtataccggactgttggtgagatggggattttaatcgaaatcaaaaaaaagaggccctgagcatctgctcagcgcctctttttcttatgctgttatttcttcttccgttttgtgttcttttttgctttgcaccgtaaaatacacgatggtcagcgcgatcatgacaacggcgatgcccaacagaatggatgcctgctgccacatatagccgtaatcgccatttgaaatgacggcacggaacccgttgatgctgtaagtcatcggcagtgccccgtgaatcacttgatagaatcccggcaggagttcaagcgggaaggttcctccgcttgccccaagctgaagcaccagaatgatgacagcgataaagcgtcccggatttcccatcgttgtcgccaataattgaatcatcgacaggaacgcgatgctggtaatcatcgtaaagagatagaatctccaagtgctttccacatcaagcccgattccttttaacagaaccgtggcgactataacggattgaatcagtccgacgagcagaatgacgctgaatttgctgaggaaccattcaaaaccgtttctcggacgccctgaagcttcactcagagggaatacgaccgtcagcatcaatccgccgacatacaagcccatagagagaatataaggcgtcagtccggtaccgtagttaggcacggaatgaatcgcgttatcgtccgtttttaccggatcggcaaacatgctgtacgttttgtcatctgtcttaatgtccccggtttgatcagccgcatctttcagctggctggacaattgtccggtgccgtctaaaagcttgcttaaaccggtgccgagagacgcttgaccctgctcaattttggacgagccgtcatggattttgttttgcgcgtccagcagtttcgttaagccgccagacacctggccgctccctgacactaacgcttctgatcctgatttgagctgtccgaacttgctgttgtattcgccgataccggccgtcaatttgttttggctttcaaagacggtctgcgctccgctgtacaatttatcagttccagccgtcagctggttaatcgcgtcttgtaccgccgccgcgccgttatacagtttcgatgtggactgaggcagtgctttcagctgatcagccttcgcttttacatctgccagcgcgctttttatgactgacatatccggaagctggatatctccgccggacggaagctggctgacgatattgtctaaatccggaaggtcggccttcggaagcttctcattcagaagctgaacaagtttcgctttttgctcatccgttaagaaatcactgtccttaatcacctttttgaccgcgtcatcccgggcatccaggctgtttttcagatcagaaagctttttcttaaactgctgcaattccttttcagtctgctcaagctcgccaaccgctttttcaatatctgagaggttgactgaattgatcgcatcttcaaatgccgccgctttttgcgacacttcctgcgccttgctgtttaacgcgcttaatccattcgttaaatccggaagcttttgctggagctgcttttgtgcgtcaaggctcgttttcagcccgctggccacttggcctcctcctgaagcaatctgtcctgatttatcttgaatttcggcgcttgcgctctgaagttttgcgatagagctgtcaagcgtttgaattccgcttgtcactttcgccgctccgtctgcaagctgctgcgttttatcgccgatggtggcggtgctttcagtaagcttcgctaaattttccttcagcttggcgctgccgtctttcgcgtttttcgtgccgtcgtctattttcttggcgccgctgctggctttgccgagtcctttggcaatatctttaaaattgtcaaaaatgacttttgcgtattgctccgtcacttctttcgacacggaggctttcagcttgtcgatcgccttttctccgattgtcgcgccgacatagtttgatccggcattcgtatgatatttcagatccagcttcttcggatttttatccattaccgtgctggcgtttttagaaaaatcttcaggaatctcgaccaataaataatatttagcatttaataagtcctttaacgattgatcaagatcgtttgaaaaatgccaatcaaaattatcatttttctttaactctttcacaagatcgtcaccgatctgaagatgtttcccttcgtagtccgcccctttatcctggttgacaacgacaaccggcagctgatccaccgtgccgtacgggtcccagtacgccttcaaaaacactccgctgtagatcagcggaacgaataatatggcaatgatggggattaacagtttcttgttcgttacaatgtctttccactggctttttattgtattcaaccctgttgcctccttccgcaaactgactcatttgacaaaacggtcacggcacctaaaaagtgaaggatcatctattatttagataatccttgaccaacatacatttccagcaattcggcgatcgtctctttttcaagaggcggatggtttttttcccagtcaaatatcagcgcgatgtagagcttgagcatcacaaaagcggtcagttccggatcacacggtttaatgcttccgttttcaatggctgtttctatcttttctttaatgtatgacagaatggcccgctccattttcgcaatgacatcctgaacggctattgtaccaatctcggcgttctcctgaaaaattttaatagtcagctggtgtgtttttctgaattccaaaatcgcgacaagcgcccggtgaacattttcgtgaaatgaaagctccggtttcatcgcttcgtctgcgtgttccttcatttctcttaaaatagtggtgaaaatatcatcaaacagttcttctttgtttttgaaaaacgtgtagatggttcccttccccacatttgcaagctttgccaccagatccattgtcgttgctttgtagccgaattgtgtaaaagacttcgttgccgcttccagaatgagctttttccgatcgacggacatgtttcccacctcgttaaattgaccgtttgaacgttttagtcattttgtacataagataacttatcacagtcgcaaagaagattcaaatgttttttctctttattggtgttccctttacagaacgggaacatgcaaaaaacctccgttttacgataacggaggctggtacgtttcaaataaataagcgagtgaatcatatacggcggcttttccctggtcgatacagtcggggatgcccaccccttcgaaagacgcgcccgtcgcgtatacgcccggataggaagctttcagcgcatctctgaactctttgatgcgctccttatggccgacatggtattgcggcatgctttcgttccagcgggtcacacaggtcatttccggttcgccatttattttcattacttttttcaaatcttccattacgattttaatgatctcgttatctgaaagatctacgatggattcatctccggcctttccgacgtacgccctgagaagtgttttgccctccggcgccgcgtgcggccattttttattcgtccatgtgcaggccgtgatggagaaatcgctgtttcttgagataacgaatcccgtaccttcatgctccattttgacagctccctcaggaaaacctaaggcgacgttggcaacggacgtagaatgcatgtctttgagacatgaaaccgccggcagatcagaaagcattttcgccgcggctttatgcggggctgtcactatgcatccttccgcatagagcactttgccgttatcaagcgtcacggaatatcctttctcctcgcggccgatatgggtgactttcgttcctttcatcacctttgtcagcgtaagctgcttttccagctcctccaccaacgtttgaagccctgtcgtcagcgttaaaaactggccctgctttttggccgtcagctgctgtcccgaaggctgcggacgtgattttttcataccgagaatcaggcttctgtgcttttgctcagtctgatagaattgcggaaacgtggacatgaggctcagcttatcaatatctccggcataaatccctgataatagcggttctattaaattctcaacgacttcgtcaccgacgcgtctgcggaaaaattcacccagagactgatcttccttcggtttgctcgcaggcaggacaaagtcaagcgccgcccgagcttttccgggtacagaaaataaaccggtggagatgaacggagcgattttggtcggaatgcccatcaccgcgcccttcggcatcggatgaagcgtctcattgacgagcacgtaagactggccggtcgcattgttgacgagcagatgctcaagccccaaatccttaacgagctgcggcgcgctttttttcctttctaaaaaagaatccggcccccgctcaatgatgtagccgtctttatgcgccgtctgaattttaccgcccgctctcgggcccgcttcgatcagggtgacctcaagcggcagctgtttttccttgatttctttttccatgtagaaggcggcggctaatcccgttatgccgccgccgatgatgaccagatgttttttatcgccactcatttttatcgccttctttaccgtttaattctacttgtccagctctttcagcacgaccgctgcaagcgcgtcgataaattcaggctgtgcgttcggcatggccggacgatagtagcttgcgccgacttcttcggtcacagctttgcattcataatcattatcgtaaagcacctctaaatgatcggcaacgaagcctgcgggcacgtatacaaatgctttataaggatgcttttgatacagctcgcgcgtgagatcctgcacatccggcccgagccacggatcaggggtgttcccttcgctttgccagccgactgcgtaatcggtaattccggcgccttcggcaatcagttttgcggattcctccagctggtcaggatacggatcgccgtattctttaattttttcaggaaggctgtgcgctgagacgatcagcatcgcgtcatcccgttcttctttcggcattgattcatacgttttcttcacctggccgacccaataatcaacgaatttcggttcatcataccagctttcaacagacttgatggtcaaaccgccgagcttctccgcttcttctttcgcgcgtttgttgtatgactggacgctgaatgttgaaaaatgaggggcgagcacaaggctgacagcttctgtaatgccgtctttatgcatgtccgccaccgcgtcttcaataaacggttcaatatgttttaatccgatgtacactttgaatgttacgtcgtcctggatttcatttaaacgctgtgcgagcttctccgcctgctcctgcgtgatttttgccagcggagaaatgcctccgatcgcttcatatctgtcttttaagtcttgaagcatgtgcggctccggctttcttccgcgtctgatatgtgtataataacgttctatgtcctcttctttgtaaggcgttccgtaagccatgacgagaagtcccattttctttttgctgctcattttgttaaacacctcttttgatggtctgtctaccttgattttgacaggaaaatcttcttataaccaacgatctgctcaggaagattgttccgtttttttggccgcggaatattcatgtacaaacgccgtcagctttttcagcgttgccggattgacatcagggaatacgccgtgacctaaattgaaaataaacccgtccgttttcatgccttgatcaagtatcgctttcgcttttttctcgatgacttcccaaggcgcaagaagaagcgacggatcaagattgccctgaaccgtttttgtaatgccttgttttctggcgtcatctatgccgagtctccaatcaagaccgacgacatcaagaggaaggtcatgccaatccccggccaggtggcttgcgcctacgccgaacatgatcagcggaacttgctctgctgaaagctcccggaatattctgtccatcaccggttttataaactgccggtaatcttcgcggttcagcgcgccgacccatgaatcaaaaatctgaatggcttttgcgccggcattaatctgcgcttttacataaacgataatcatgtccgcgagcttgtccatcagcatttgccacgcttgcggcatactgtgcataaacgcttttgttttgttgtaatttttagaaggcccgccttcaatcatataactggccagcgtaaaaggcgctcccgaaaaaccgatgagcggaacattcagctgttcgtttacgagtaatcggatcgtttccagcacgtaaggaacatcctgttcgggattcagttcgccgagcttttcaatatccgcagcagagcgcaccggctgatcgatcaccgggccgattccgttttttatttcaacatccactccgatataaggaagaggcgtcataatatctttatataaaatggcagcgtccactccgtactgctcgaccgggagcctcgtcacatacgcgcacagctcgggctgatgcgtaatttcgactaagccgtacttttctttcagcttgcggtattccggctgagacctccccgcctgtctcatgtaccagacagggacgtgatttgttttttctccccgtgccgcttttaaaaacgtatcattaaacgcttctcgtttactcatctgaatttccacctttcctcctgcaaccatacgttcgtgttcttcgcccattacactataccttgttttttctgaatggtatagaattgaggcttaatgttcaaaaaatcgccgaattcatgattaagaagaaaaaagcttcggctgaacgtattccgttccctctccttcttgattcgtctgcgaattaaatggaacgactttgtatgaagcccctgaaaacagattggcgtacggtatgtcaaagctgccttttcctttcaccgaatccagaagcttgtcttttccgtctttcttctcatatattcggtaaacaacccgatcatccttttgaatatcccattttaattgaaccgtaatcagtcccatcgccttaaatgtataacgggccgacagggattttaccgcttccagctcaatcgggctgcccagttccttcacattttcaggctttttgaatgtccggccgttttcccccgcttttgtgacgatatctttaaagagtctgaccgggtactggcttccgcctttcaggtaatgggttttatccgttttgtcatagcccatccagacggctcccgtcagtccgggagtgtatcccgcaaaccaggcgtcctttgtcgcgccggggatgccggtaaatgtggtcgtgccggttttccccgccaggtcaccttgatagctgccttgtgaagcagttccttcttttacgacctgctgaagcattctcgtcatattccatgccgtctgtccgctgaagacgcgcgttttgccgtttttaggcccggatagcgtttctccgtcttcgtccgtgatgttctctataaaaaatggcttcgtatacattccgtttgccgcaaaggtatgataagctccggcaagctgaagcggagtgacgccttcagacagaccgcccagcgcaatcgcgagtccgttgtcagaaatgttcatgccgtttttctcaagatacgattttcccgtatccacgccgatctgcttcaatgtccagacagcgggcgcatttatgctgtaagtgatcgcatcctgcatcgtcacttcccccttgtactgtccgtcataatttttcggttcatacccgtcgtaggacgtcagtttgtcttggagaagcgaatacggtttgaacttgtcttcctgcatggcgggcccgtatacggcaatcggcttaaacgttgagcccggctgccgcttcgccgtaaccctgttgtatccttttgtcacgtagtcgcgcccgccgaccgccgcgcgcacgcctccggttttattatcaataaagacggcgcttccctctgccgcctgatccgtccccggaaaatagccgctttccttcatgagggtatatgccgttttctgcagcttggaatcaagtgacgtccggatcgtatagccgccttgaagcagctgttctcctgacatcgaataacggtcttccgcctccttgatgacaagatcgatataactgtcaaaccaaggcgtttctgatgttttcttgacattaagccccaatgtccggccctgggctctgacggcttccttggcgctgatatagccttgatcgttcatcattgcaagaatcgtatcgcgccgttctttatttttatccggatgctgaatcggcgaataaagagatggcgccttcggaatcgctgccagaacggctccttctgcaacggttaaatcttttacttctttattaaagtagtagtgggacgcggcttgaatgccgtaaacgccatggccgaaataaagctggttcaggtacatttcaagcagcttgtccttgctgtaatcacgctcaagattgatggcgataatgacttccttcgtcttgcgcaaaaatgttttatcatgagtcagaaaaatgtttttcgccagctgctgggtgatcgtgcttccgccctccaccttgccgcctgctaaaacatcccggaacaccgcccggccgacagacttcacatcaatgccgtgatgttcgtaaaaccgtttatcttcaacggcgataaaggcatctctcacatcttccggaacctgctgaatggataccggctcacgattttccgtatagaggctcgcgatttcatcaccgtcttgatcgacgatttttgaagatgcgtgcagtattaatttcttttcatcgatgacataatggccgagaaatataatgataatgtatccgattaacgcgagaaaagcggttgccgccgcaattacagccggaataaagaatctttttttctttttcagcataagtcacctcgcctttcttaacttgtagtatgggaaatattgtttcgaattatgtcagaatgagtcgccaatagaaacttataccactcttttgatatactagcaagcaggaggtggctgatatgaaggtttatattacatacgggacagccgattttttaaagacgattgccaagaaacacccgagtgagaatatggtgctgatgcaaggggaggataatgcggttttaattcatgaaacaaatggagaaaccgtttttcaggcgccccattcctatgaaagcatcgacagcgtcggggaaatcaaaaatccgggctacgccgtcctcaacaacatcgccgttacccaggaaggccgtccgctgtttgaaaaccggtttaaaaaccgcgccggcaaagtggaaaatgaacccggttttaaagccatccgtgtattaagaccgctcgaaggcgatacgtatgtcattttgaccctgtgggaagaggaaaaagcctttcaggattggcagcagtcaaactcttatcaggaagctcataaaaaacgcggaacatctgccggtatcgacacgacgtctattttttcccgtccgtcttatgtaaccgcttattacgcaatagactgaaaaccgccggagattctccggcttttttgatgtcctgattttacgcatccttctttgcaccttccgcccgcctatgaataccctgtagcaatcctatttataaacggagtggttcaattggggatcggcgtctactcggtacatctgctttatgttgcttttatcgcggccattatcgtttttatgcttctcagaaaagatacaacctttatttcactcgccggcatttttgtgattgcgctatggacgacgcattcattctccgcttcggtcagcagcctgtttcacagctttacgtatgccgccggagaattgctgccgacgatttttatcatttgttttatcgtggcgatgagcggccttttgaccaaaaccggtattaatgaagcgatgatttctccgtttgcaaagctgatgaaagggccggctgtcgcgtattgggttatcggctgtctgatgtttgccatctctctttttttctggccgtcacccggggtggcgctgatcggcgctgtgctgcttcccgcagcgatccgggcgggcctttctccgatcgctgcggctatggcgatgaacctgttcggccacggattcgctttatcgggcgattacgtcattcaggcggccccgaaattaacggccgatgccgcgggcatcccagtgagcgatgtcatgcaggcaagtattccgctcgttttgatcatggggttaacgacgacaatcaccgctttcttcctcatcatgcgggatcgaaaaaaaacgaaggcccccctctccttggacagctccggttctttggacacaagtatgtatctgccgaaaaaactcagggtgatcctggcggttttcattccgcttgtttttctcgccgatattatctgcatgatcgtataccgcctccaaggaaacgatgcgacggcactcgtcggaggaaccgcgatcggcattctcctgatcattcatttcattgtatataaagagcggcatttagaaaagatcaccgagtattttatcggcggttttcaattcggctttaaagtattcggccccgtcattccgatcgcggccttcttttatctcggtgacgcggggtttaaaagtattttgaacaccccgctgccgaaagggtctgcgggaatcgtcaatgacctcggactggccctgtcccattcttttccgatgtccggagaattcgccggcatcgccctggccgcagtcggtgcgattaccgggctcgacgggtcagggttttccggtatatctcttgcaggctcgatggcaaagctgttttctgccgcgcttcatacggacccggccgttttaacggcgctgggccagatttcagcgatctgggtcgggggcggaacattggtcccttgggcactgattcccgctgcggctatttgtaaagttgacccgtttgagcttgccaggaaaaactttatccctgttgcggccggacttatcatcacgaccatcgccgccatcatcattctcccgtagcaaaaagattgaaatcttctgacattttctatacaatcatgggaaaagcagacgagggggcatcgcttttgacgttaacgacacttcaaaaaagcttaaacgctcagcttgacgggctgtatgaggaaatggttgaaatcaggcgtcaccttcacatgaatcccgagccatcctttaaggagaaaaaaacaccggcgttcatcgcctcattttatgaaaagctcggcgtccccatccggacgaatgtcgggggcaacggtgtcacagcctgtattgaaggcggtgaaccgggaccggtcgtggcactcagagctgattttgacgctttgccgatacaggatgaaaaagatgtgccctatgcttcacaaattcccggcgtcatgcacgcctgcgggcatgacggccatacggcggctctgctcgcggccggaaaagtgctgtaccgcaaccgggaaaaactgaaagggtcatttgtgatgatccaccagcacgctgaggaattatctcccggcggagcaaaagcaatgattgaggacggctgcctcgaacatgtcgatgccattttcggcacacacctatgggcgactgaacccgtcggaacggtcttatgccgcccgggcccagtaatggccgccgctgacggctttacgattaaagtcatcggcaaaggcggtcacggtgcgatccctcacgatacgaaggacgccgttttaatcggctcacaaatcgtcacggctcttcagcatatcgtcagccggcgggtaaatccggtgcagccggccgtcatctcagccggctcgttcaccgctgaaaatccgtttaatgcgattgccgatcaggcagtcatttcaggcaccgtccgctcgtttgacgaaagtgtgcgcggcctgctcgaagcagaaatagaagccgtcgtaaaaggaatctgttccatgcactccgcttcctatgaatatcgtttcaaacgcggctatcccgccgtcgtcaatcatcctgaggaagcggcgcacgcggcggcagccgcagcggaaacagacggcgttacgaaagtcgttgaaggagagccgcagatggcgggagaggatttttcctattatctgcagcatacaaaaggcgcttttttctttacgggcgccgctttagaaaacgcggaaaccgtttatcctcatcaccacccgaaatttgattttaatgaaaaagcgatgctgacagccgccaaggtgcttatcggcgccgcggtaagctacccccgctgacataaaaaaaacagccggtacattacgtaccggctgttgtaattcttaaatgaaaaacgtgccttgccgtctcaccgagctgtgacagcagtttataattggccgctccgcccacggcggctccgacgaccggcaaaagctgaaacaatttcaccacgtccagataatcgcggtattcctgctgaaaaactctccaatcgacatcatgctttttcgaatcccactgttcaatcattgagtatatgcgtttccgctgctcaccgcttgagaaagccagctgaaaaataaacagcaaaaacaatcgctcatccctgtctttcacatcatagccgtaaatggaggcaagatcgaacagacatttcattttaatggatagcagcaaaggaaaatcagccattcctaaaaaaattccgccggcccccgtaccgataccttcagctgccgcgaccttttggtacgatgcgatggtttgtctggcgagagcatctttttcagcaagcgtcataccgtttgtatcccgcttgcttttcaccagatttgaacccgccattgttgcttcggtcatttttttaatgctttctgtgatgacggcatgaattttttcgggaatccgctcatttattttcgcctgcattcctttagaaaagcgttcaagcatggaatctttgcgcaaaaaacgcgctttccattgcagtgcttcctgtaccagctgctgatcgtcggtcatctgtgtctccttctttcattgaggtttcaaaaacccgattgattacagcttgccgtactttttcaatcttccgcccatatacgatggcatgatcacaaaaatcagaacggctgaagcaacggccgcatacagcgccccgctgactcccgcggcataggctgacgctgcgcagaacagcagcgcctgcacggttaatgccgatttcatcagcgaaaagaaactttgcagcttcgctttctgattgaccgggtaaagctcctgcagagaaagatgatgaaaatgcccgaacagaggaagaagctgtattcccgtaataaagacggtaaatacggttaacgccgccgtgatccacggattggcggaaacgagcataataatcaggataaaaataatcgtgagcctgacctgaatgccgagataatcatttgaacgcagaaaggcccgcgcatacatatagaagaacgttttccgctgctcaaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggccgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacagaggcatgcatacaagcgacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacatcggcgccgcggtaagctacccccgctgacataaaaaaaacagccggtacattacgtaccggctgttgtaattcttaaatgaaaaacgtgccttgccgtctcaccgagctgtgacagcagtttataattggccgctccgcccacggcggctccgacgaccggcaaaagctgaaacaatttcaccacgtccagataatcgcggtattcctgctgaaaaactctccaatcgacatcatgctttttcgaatcccactgttcaatcattgagtatatgcgtttccgctgctcaccgcttgagaaagccagctgaaaaataaacagcaaaaacaatcgctcatccctgtctttcacatcatagccgtaaatggaggcaagatcgaacagacatttcattttaatggatagcagcaaaggaaaatcagccattcctaaaaaaattccgccggcccccgtaccgataccttcagctgccgcgaccttttggtacgatgcgatggtttgtctggcgagagcatctttttcagcaagcgtcataccgtttgtatcccgcttgcttttcaccagatttgaacccgccattgttgcttcggtcatttttttaatgctttctgtgatgacggcatgaattttttcgggaatccgctcatttattttcgcctgcattcctttagaaaagcgttcaagcatggaatctttgcgcaaaaaacgcgctttccattgcagtgcttcctgtaccagctgctgatcgtcggtcatctgtgtctccttctttcattgaggtttcaaaaacccgattgattacagcttgccgtactttttcaatcttccgcccatatacgatggcatgatcacaaaaatcagaacggctgaagcaacggccgcatacagcgccccgctgactcccgcggcataggctgacgctgcgcagaacagcagcgcctgcacggttaatgccgatttcatcagcgaaaagaaactttgcagcttcgctttctgattgaccgggtaaagctcctgcagagaaagatgatgaaaatgcccgaacagaggaagaagctgtattcccgtaataaagacggtaaatacggttaacgccgccgtgatccacggattggcggaaacgagcataataatcaggataaaaataatcgtgagcctgacctgaatgccgagataatcatttgaacgcagaaaggcccgcgcatacatatagaagaacgttttccgctgctcaaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggccgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacagaggcatgcatacaagcgacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacaaatgaaaagagcaccgccatcacccaaaaagagggaaaatgaacggggatgtctttgacccacttgctgtaccagctcgccgcgccggcaataaaaaagatcagcacaatgacgagatgatcattgagcatatatttcatatacattctggtttcctttatatgctcttcaagccgggactgccaaatagtagacatattattcatggccggcgtcttccttcgtcagttcaatatacaagtcatcaagagctgcgtctttcatgccgaactgctctctcagttcttccagtgtgccgcttgcccgcacttcgccgttatgtaaaataatgaatgcgtcacagtagcgctctgccgtagccaggatatgcgttgacatcagcacgcttgatccggcttttttcgcggcgtccatccgctccagcaatgcattgatcgcaagcgggtcaaggccgaggaacggctcgtcaatgatataaagcgagggctccgcgagaaacgcgcacatgatcatgaccttctgcttcatccccttggaaaagtgagcgggaaaccatttcagccttttttccattctgaattctttcaaaagcggaggaagccttttttcaagcgtttctttggaaaggccgtacgccatggccgtcagctccagatgctctttgagcgtcagttcttcatacagcaccggcgtttcggggatgtacgtaaattgcgagcggtagctttccttatcctccgaaaacgtcttgccgttcagctcgatcgagcctttatgcgggtccattaatccgataatatgccggatcgtcgtgcttttgcccgcgccgtttaatccgatgagtccgacaatctggttcggctcaagggtgaatgaaacattttttaagaccgggtttctcgtataaccgccggttaagtcttttaccgatagcagagacataatttctccccttctgattcgtttttcttcatagtaccaaaaataaagtctgatttgaaacgattccctttttttctcacgtgaaaagcgtgcatagttatcgttttggcggacatcataatgtatgtagaaggaaacagctttaatcaactgaaaatgaggtgtttataaaagacgtcttagaacagttggatgaaaatcaacatgtcctgtgcttacaatttcttcacacactgctttgatgatgttcttcattcatgatgaaataatcaaatgaggtgtttgtcccaggaatgattaagcagacccataagtcttcattttaaaaacaaatgaggtgcttacaaaaggcatatttaattttctgtgataaagctcgtacttctgcatcagggtgaacgcgcagccgttcatcctgttttttgttttggccgtttttgtggtacgatgagaatatacatatatttcttttcagggaggaaacccatctatgcacaaagcggacgattgtattttctgcaaaatcattgccggtgacattccgtcttcaaaagtatacgaaaatgaacatgttgtggcgtttcttgatatcagccaagtcacaaaaggccatacgcttgtgattccgaaaacacatatcgaaaacgtgtacgagtttacgcctgagctttctaaagaatatttcgaagcggtgccgaaaatcgcacgcgccatccgcgatgaattcgagccgatcgggctgaatattctcaataacaacggtgaaaaagcgggccaatcggtgttccattttcacatgcatatcattccgcgttacggaaaaggcgacggtttcggggctgtctggaagacccacgccgaagactatgcgcctgacgatcttcaggagatcgcttcaaccgtcagaaaacggcttgcctcatcttaaagatgaggtttttttgcgtccggtaacacaaaaaacataaaattatattttttcatatcaaaaaaatcaaaaaattgtgataggataattgtattatttcttacactaaagcggaaaacagggagagatcgtaaacatggaacgtacaacgaatttcaatgcaggacccgcagcccttccactggatgtgctgcaaaaagcacagaaagaatttgtcaacttcaatgacaccggcatgtccgtcatggagctgtcccaccggagcaaagaatatgatgcggtgcatcaaaaagcaaaaagccttctgaaagaactgatggatattcccgacgattatgatattttatttcttcaaggcggcgcaagccttcaattctccatgctgccgatgaactttttaacgccgcagcaaacggcgcacttcatcgtaacgggcgcatggtctgaaaaagcactcgccgaggcgaaactgttcggaaacacatccgtcacggcaacaagcgcagattcaaaccacaaccatataccggaagcggacctcacaggaatcaaagacggcgcctacctgcatcttacgtccaataacacgattttcggaacgcagtggaaagagttcccgaattcaccgatcccgctcgtagccgacatgtcaagcgacatcctgagcagaaaaattgatgtcaaaacgtttgatgtcatctatggcggcgcccagaaaaacctcggtccgtccggcgtcacggtcgtcatcatgaaaaaatcatggcttgaaaacgaaaacgccaacgtccctaaaattttgaaatactccactcatacaaaagccgattcactgtataatacgccgcctacatttgcgatttatatgctgagcctcgtccttgaatggctggctgaaaacggaggtgtcgaagcggctgaacggcgcaatcaggaaaaggccgacgtcctgtacggcacaatcgacgcaagcggcgggttttacgcggggcatgccgcaaaagacagccgttctcacatgaacgtcacattcaccctccgcgacagcagtctcacgaaaaaattcgttgaagaagcgaaagcggctaaaatgaccggactcggaggccaccgctcagtcggaggatgcagggcgtctatctacaacgccgtcagcctggctgattgtgaaaaactggctcagtttatgaaaaagttccagcaggaaaacgaataaatttcttctaacataacggttcctttgatatactgtttgcatatcaatttttccggccatcgcaataaatgacgagcatattattggatggcgaaaaagcttagcagaggagagcttagtatgaaaacaaaagaattagtcattatggccctgtttgcggcaatcggagcggtgcttcattccattatgccgccggtattattcggaatgaaacccgatatgatgcttgtgatgatgtttatgggtattctgttattcccccgtgtgcagaacgtgctgatgatcgggattgtaacgggaattatttccgcactcacgacatcttttccgggcggacagcttccgaatatcattgaaaaaccggtaacggcgtttctgtttctcgcgctggtgcttttagtgaaaaagagcgtgaaaacagcggccgccgccgtcattacaatagccggcaccttcatctccggtttgctctttttggcgctggcccttctgattgtcggcctgccgggcggattcaccgccttggtgctcgcggtcgtccttccggcggctgcgctgaatgcgatcgccattatcattatgcatccgattgtgcagacgatcttaaaacggtccaatatgattgaaacggtgaaataaccgcataccgaaacctcttccggccggaagaggttttttaatgtgtttcagcatgttttatacgagaagttttgtgaaaaagataaggaacaatgcgagggcggttcctgctgagcagacgatggccttttggcggacgacccgcttcggcggataagaagcggcctggccgagcagtttcaggtaataaacggcgcccgccgcaaagacaagagccatacaagataaaacaatcataaagacagacaaccttctccctccttttcccttaaaaaatatgctaaaataaagcaagctatgtatagaagtttattcttctgaacaaaaatgataaaagttatgagaaaaaaaacggggtgatttcaaatggctgacggacgttcccttttaacaggccttttcgtaggcggattgatcggaggcgcagcggtgttactttcggctccttcatccggaaaagagctgcggggcaaaatcaaagcaaattgcaattcaattgaggacacaatcaaacggttaaaaaaagacggaatggcgcttaaagaccagcttgtccaaacggcgaaagaaagcgcagaagtcattaaagacgtaggcggagagcttcagaccagcattaaaaggtggcaggaggaaatcaagccgcaccagcaggatctccaaaaggaaatcgctgatattgaagagaaaatcagacagctggagaaaaccttacaaaactaatatcctatacaaccaaaaaaagtgcggacatattgcgttccgcacttttttttgcggtttaaagcctttcccagcaacggattaagaatttattataaaattcttaaattttcatctttattaatctttattttattggcataatagaggaaaagaaaatgtgaagcaggtgatctgtattgaatcgtgttgaaccgccttacgatctaaaagaagctttaatctatacccaaaaaatggcgcagctgtccaaagcgctctggaaatctatcgagaaagactggcagaattggctgaagccgtacgaccttaatattaatgagcatcatatattatggattgcctatcagcttaaaggagcttctatttcagaaatcgccaaattcggcgttatgcacgtatcaactgcatttaacttttcaaaaaagcttgaagaacggggatatctgaaattttccaagcggctgaatgataaacggaacacgtacattcagttaacagaagaaggggaaaatgtattcgaaagcctgcttgaggagtttgacccgtcgagaaacgcggtgtttaaaggctcacagccgatctaccacttattcgggaagtttccggaagttgaagaattaacctgtgtcatccgccacatttacggcgaagattttatggagatattcgagaaatcattgacaaacataaacaatgattttgatagtgaagacggaaggctgaagaaaaaaacggacgaatcggctgtccatgaaacggctgaagagctggaaccgatcaacagttaatcaaagtgcttcataatctcaataaattcttccatcagcgctgtataaagcccctgctcatacagagcaaaaatcgtttcatgaacatctaatttttcgttcagctgtcccgcaaaaagcgcaaggagcttgtcaaacgtcacaaagccttgcgctttttgcgactccagctcgtcctccaattcgcggcagatccgcccgacctcttctccttcttcttcggtcagccctttttcaatcatcatcgcataaaaagggtacttatccatatccaccgttttcaccagcaattgtatgtaatattctaaacgcccgatacgctgatccattgaatccatccgtttcacttctttctatctttaatcttattttagctgataatgaatggagaagaaaggttaaaccgtacatttccatgtttcaccgagctcttctgttcttccctttccggggttattttttttctttaaaaaaggattgattttttctcctgaagagagtaaattattttgagattgtattccatctttgtacggaaggatgactctgatgaattgctggaaaaccattaatctgatcaaagattatggtgcggttcgtttattattgactgctgtaggttttatgatcctgttttttatatgcaacttcttggcattcgggctgctgcgtccgaatatcagtttaagtgacgggcacgtgtttgctttttgtgttctgctcgttgttactttatttgtacataaagtcatacatgtcctgccgatgatctgtaaaaaaagaaaaaaggaaatgaaaatgtacttcttgcggatgccgacatggaaaggcataccgaaaacgacgatgctgatttctacgatcagcccgtttttattcattacgccgctattgttttatgccggactggcatttccgagacacgctcattacttttatatgatttcgagcattcatgcgggttattgcctgcctgatcttctgtttgcgctgcacctggtcaaagcgcccaaatcatgtctgattgaccaggaatccgacggttttgatattttagtaaaaaaagtgccggagtcttgatatcccgctgatttttcaggttacattctatcttttttaataaatatttggtaatgtaatatgggagcagttcagagagagggggaatctcccatcattttattctattttatcgtggctgccctgtttattctttattttataaacaggctcacaaatacattatgccttgtcagagagattcctgaagaccggcaggataaggtattccgttttattaatgtatctattttaattttactgatctcttcattcgtcgagatctcctttactgtgtaaacaggcaaaaaaatatggctgacggaggtctgacccccgacagccatatttttttcttaataaagccaagaagcgccgatgatgatcaataagatgaacagaacaaccaataatgcaaaaccgcctgcaaatacttcacccatctccaaaagcacctcctacaaaacgttttatttttccaattacatcatatgcaatttacttctgaaacgattaggcgcccgggtaagaaaacggatcgcttttagaaaaagcgatccgtttcgcttaacaaatgtaagctgcacctacgatgataagcaatatgaacagtactacgagcagtgcgaaaccgtttgaatatcctccgcccatggttcattacctccttttcatgatcaatatatttgtatgtatcaggaaaaagtttgactagacgaatgccctttatttaaaatctttttacagaaagccacaatatgttatgatacgcatatgcaatttaatttggatgattaggagtgtttaaaggaatgaagaaaatcgcgatagcagctattacggcaacgagcgtcctggctctcagcgcttgcagcagcggcgacaacgacgtgattgccaagacggatgccggaaatgtaacaaaaggcgaactctacacgaatatgaaaaaaaccgcgggcgcaagtgtgctgacacagctcgtacaagaaaaagtattagcaaaaaaatacaaagtatcggataaagaaatcgataacaagctgaaagagtacaaaacgcagctcggcgatcagtacagcgcccttaaacagcagtacggcgaagattacctgaaagatcaggtgaagtacgaactgcttgcacaaaaagcggcgaaagacaacatcaaagtgactgacgctgatacgaaagaatattacgacggcttaaaaggtaaaatccgcgcgagccacattcttgtcgctgacaaaaagacagctgacgaagtggagaaaaaactgaaaaaaggcgagaagtttgaaacgcttgcgaaagaatattcaactgacaactcaaaagacaacggcggcgaccttggctggttcgataaaaagtcaatggatgaaacattcagcaaagctgcattcggtctgaaagtcggacaagtcagcgatccggtcaaaacaaaattcggttatcatatcatcaaaaagacagaagaacgcggcaaatatgatgacatgaaaaaagaattgaaagaagaagttcttaaacagaaattaaacgacaactcagctgtacaggcggcaattcaaaaagtcatgaaaaaagctgacgtaaaagtggaagacaaagacttaaaagacacgtttaacacttcaacttcttctgaatctaaataaaaaaaactgtgcggactctcggcgagccgcacagtttttttatgcgatggaatgattggagttttcttctgcatccgcgttttcacttgcgggcgccgccatacggcgctcgcgttcctgttccatccgttcaatatacacccttccttctttttcaataaacgactggtcaagcttttcctcttctttagctgttgagaaaagcttataggcgctgaaaataattccgataatgcaaaggtatacccaccaaggaaaaaatagcacgtcggtttcctccctttttcacccagagtctttattctaagctatgcttgataaagacaagttatgagagctgaacgtaaaaaagaccgatcatagagaatcggcctttttatcttattgatggaacgtcggtttgtagaaagaacggttttccagcgcaaatacacgctctgtgtattcgcccggcttcacccgttccagcgctctgtccatcatgatcatttttgcatccagattgtcaatgtagtgcagaatttccgcttctttcaccatcggcggtttcgggcttccccattccgcttttccgtgatggcttaaaatcaaatgcttcagaatcagcacttcttcagcgtcaatctgaagctcttcggctgcttttgaaagctctgtcaccatgatcgaaatgtgcccgagcagattcccttccacggtgtacgtcgtggagacggggcctgaaagctcttttactttgccgagatcatgcagaatgactccggcatacagtaaatcccggtcaagagacggatacagatcggcaatcgcttttgccaggttcagcatggacactacatgatacgcgagcccggagacgaactcatggtggtttttagccgccgccgggtaatccataaactcagccgcatattttttgaccagatgtcttgtgatccgctggatatttggatttttcatttcaaaaatgtattgagtgacggtttccatcatttcatttttcggaatcggcgccgtttccagaaaatcatcaatgctgacattttcgttctcgccggccggccggatgtttctcagcttaagctggtttcgtccgcgatagtgatggacatctccgatcaccttcacgatcgtctgcgccgcgtacgttacttcatcagtcggcttggcatcccacagcttcgcttcgatatctcccgattggtcctgcagcattaacgtcaggaatggttttccgttgcttgcgattcctttagtcgaagatttaatcagaaagtattgatcgacctgctcgccgacctcgtgcagcataataccttttgccattctattaaaagctccctccatatcttacataataccagtatagcacatacctcttttttgaaaataaactcttttatgacaggagccgcatgacttgtccgctgtgaaaagaccggctgacatgctcatggcaggtgaaataaagtatctgccgcccgccttctgaaagctgattcagcacatcaaacagccgctccagccgctgcctgtcaaaatggacaaaactgtcatcaagtaaaaacggaagtgataccgcagattccctctctgacgcaagggcaaaacggatcgccgcataaagctgctcgcatgccgcctgtgacagttcgcctgctgaaaacacagttccgtctttccgcatgaccataatggaatcatccgcctcggagaaatacaatttatggtaacgtccgtccgtaagcggtccgtataatgcaccggcggtttctaacagacggggaagcgtcacttttttatgccgctccattttttccctgatgatgtgtctgaccgtctgtaatgcggcccactctttagcggtttttttcacgcgctccttctgcatttctgtctgctgttttaaatcggatacaagccccgaggactccagctgctcttgtttcaccattaataaagcggttttctcacggagctgcgcgcttttttcctcaagcgtttttttctctgtttccttctgaacgactgtatgttcaagttcggacactgtgcggctcatatacggctcaagctgttttccgcctatgccggacaagtgcgttttgatttcgcgcagctgccgctctgtttcccggcggctttcattcagtctggcgagttcacaaaagtgttcgcgattttttgcgcctgcctccatgaaaagctgtttgacctgctgttcgtagtaatgaacttcttcatttaattcacgcatttgctcttgtgcatgcagcagatccgtttcgagcgcctgctttcgttttgcttcctcacgggcccgttccgcctgcgccagcaaaacgcgcagtctttcttttacggacagctcccttccgtctgaaggactcagctttttgacccggtcctcaaatgctctttgcagcttttgcagccggcccgcttcaatggtcagctcatgcttattaaggatttcttttttgacatctttcatcacatgatatgcgtcaagaagatgggaaggacttcctgaaaaacccagttccttcataaaaagttccgcctgtttttcagacggcgccatttccgcctcccattcttcatattggcggatgactctttcatatgccgcttctttctgttcaagcacggcttgatccgcaatcagctgctgccggtgccggccgtcacgccaaagctcttcctgcagaaggtcagccgcttctttggagatcgtcggcttctttttcttgtgaccggcccctcctctttctgacggcagcggtttttgcatgccggacagcatatacagcagcagagcgccggtaaaaagggcggcgggcagccattcctttaacatagcgaaaatcgcaatgaacagaatgcccgcaccgagaaagagctttttttgtttggcgcgctgtttttccagctgctgtacatgtgcctgccattcgtttccttctgtatcagccgtttgcttatatgattgtaaagcggcttctttttctttcctgacagcggggtccaaaatgttttccgccgtcaaggcatgttttcgttcggcttcttccagctccagccgcgcttgttcgaaaatcgcatcaagctgtgtctttctttctcttgcctgtccggcgctctgcacggcttcctgcagccgccattcatattcataatcggtgttcagtgaaagaatgccgtcttcctcatgtcttccgagctgctgcaatcctgacgaaacgcgggcagatgtctgccggatctgtgattggatggcggcaagctgttcgccgcgcgattcgtacatatgctgctcgccggaaagctcctgcagctgccgctctgtttgcagcaagtcctcatttggagcgagcagctcagcctgccgcctgagttcagccgcttttgcccgaagtccctcaagacgggccgctttcggatggagatgcgattcgtatttttcaagctgatgcatcccgtccttcgggaattgcttcaatgcatccggataagaagaaagttcgctttccaaggctgtttttttgtctgcgagcggctttgcttctatcgccgattttactgttttgatttcttcagttatgtctttcaatcgtgcttcggcatcctgcaaacggccgccggcgctttttttctcttccagaaggctgtgatagcccgcttccgcagcttccgcctgtttcagctgggcgctgagccgctttaatgtatccaactcctgatttaagcgggggttccgcccgttcggcttatacatcctgtcaagttcttttgccagccgcccgtcaagctttgccgccgcttccgacccgaataagctcgaatacaggagaaactcgccgattttgtcccggttaaaagcttgaatctcctgcagtccgaatacatcgaacgaatagatcgcctcgtacagcgcccgatctgtatcgcaaagaagctgtttgagccattctccgtcctttatttcgcctgaagccgtatacactctgactttttcggcagcaccttttgtccgttcgattttgacggcaccgtgatcgccatgcttcaattccacagtgccgccgtaaaccccgccgtttttcggttcgtatttttttgatttcggaaaaccgaacagcacgcttttgatgaaggacatcaatgttgttttgcccgcttcatttaatccgtagatcacttgcacgggagaatctgacagctgaaaacttcggtcggaaaattttccgtattggtaaatatgcattgccgttattttcatcgctgaagctccttcatctggcgtcttaaaacggcttgagcctgccgcttaatatccagtatctcttcatctgtaaatgaagtgatctgacgccgatatacgggatgacgctcaagggcttcaaatacaccgctcatgtccgcgcattgttctatgtcctgaagcagccctttaaaaaacggatcgggcggcacgctgtctgtttcatccgtccgatcctcaagcgcaagcggccagacgaaacattcctcttcggcctcttcctcctgtaaagcggaaagaaactcctctgcgatgcctgcgggcgcctccgtccaaaagcggggcgccgcgccgcgaagcaccagcctgacacatgccgggcggcccgccgcgcgcaagccggagaatgtatccgatgcggcttttagaagtgaagtcatatgttcagctccggagatatcaagatcaatttcctcccataacacatcatgcgcttctttgaattcccaagacatctcaccgtttgccgcccggacgagataatatcccttaggcccggtttcttttaaatgccgggcttgaatattcccggggtaaatagcggcgggatgctgggcggacagaacctgccgtttatgaatgtgtccgagcgcccagtaatccatgccgcttttttcaaggtcttctttcgtaaacgggcagtacgggtcatgcccttccgctcctgataacatgccgtggagcatgccgatatgataaggcgcgccggtcattttccggtaacgggccgcctgattgaccgttacgcttctttcctgatagctgcatccgtatatgcttgccgcaagctctccgtttttaaagaaagacttttcctccggtgtacccgaggtgaatatatgtacattttccggccattcaatcggcgtccacttaccgcccaaatgatcatggttgccgaatatgacgaacacttggatacccgcttcctgtaatctcgtaaactgttttctcaaaaacagctgggcttttaaacttctgttggcttcgtcaaacagatcccccgaaagcagcacgaaatctgcctgctcccggagtgccccgtccgtcagacggcggacgctgtgaaatgtgctttctttaatacgcgcatataccggttcaggcagattcgaaatgccgtaaaacgggctgtccagatgcaggtcagcggcatgaataaatgtcagatcagccatctcgccctcccctttctgcagattgaattacccttattttagcaccgtttttatacgaatgcacgttctgcaaaataaaaaaacagcccggctgttccgggctgtttcatttattttttggagatgcgcagcgcttgtttgatcgctttgaatccgctggcgtttccgtaaatcaatacgccgcctttgtaaattttcgcgccgaccgccgcaaagatcacaatagtgaccagtgtcagggtgattccggccgcagcctgccaaaacgggatatcgagcatcccgacgcgtaaaaacataatcatcggcgtgaaaaacggaatgtaagatgtaacggtaataaaaccggcgtcaggattgccgatgccgaacatggcgatcataaaacctgccacgaccaaaaaaaccatcggctgaatcgtctgctgtacgtcctctatccggctgacaacgctgccgagaaacgcggcaagcgtcgcgtaaagaaaatagccgagcaaatagaaaatgacggcatagactatcgtcgagacgggaacatccgtaaaattgaggaatgcactgatcggcgacgacgcatcattttgagggttcagcttcagtgagagataacccgatgcaatcagcaccgcaaactgtgtgatccccacgagcgcgataccgaacagtttggcaaacatctgctgaatcggcggcatgcttgaaattaaaatttccatgacgcgggacgatttttccgtcgccacttccatcgcaatcatgcttgcgtacatgataactgagaagtagatgacaaacagcatgatgtatacaagccccattacctgaccgagctcttcctcagatttcgcccctttttccagcgcgtctttgctgacttccggcggagtgtagaggctgctgactttttctgccgaaatgccgagcttggcggtttcgacagcggttttcgtctgggttaaagcctgcttgagcagtttatacgctgattcatcagaaatggtcagcgccttgtatgctcccgttatcgttcctttttgatcctgtctgatgataaacagtccgtcccattcaccgtctttgacacgctttacggcatctttttcggactccttcgtctccattgcctgcagatcattgtctgtatccgccgctttaagctgttttgcaaacgccgggtacagcccgcccgtttcatcaatcaccgcgatttgctgcttgccgtcatccgattgaaacacggaaataatcgattgcaggttggtcaccgctaatactaataaaacggtaatggcggtcgaaataatgaatgactttgttgcgattttgtttttatatgtatgaaacagcataatccaaaatttattcatatacggcccccaccttttctataaaaatatcatgcagtgacggctcttccaattcgaacttccgtataaaacctttcccttgcagcgcccggaaaatatcctgcgaaaccggttcattcgcgacctgcagtctgattccgtcatttgtttccttccatttcacgacaccttcatgcgtttttaaaaagctgaggtcatcatctgaatgaacggtgacattttttttgccgaaagaccgcttaatgtctttcagattgccttgaacgacgggttttcccttctggagaatgcacaaattctcgcaaagttcttccacatgctccattcggtggcttgaaaaaacgatggaaacgccgctgtttttcaaagaaataaccgcttctttcagcagctcgacattcaccggatcaagaccgctgaaaggttcatcgagaatcagcagttcaggcttatgcaggacggccgaaatgaactggattttctgctggtttccttttgacagctcttcgactttcttattcttgtaatctgtaatgccgaagcgttcgagccatgtcatgagctctttttccgcctcttttttgctcattccttttaatctcgccagatagacaagctggtcactcaccttcactttcggatacagcccccgttcttccgggagatagccgattttttcactgatggaataattgaccggcttccctttccaggtgatatgcccgtcagtcaggcttaaaagacctaaaatcatccgaaaggtcgtcgtttttcccgcgccgtttgcgccgagcagcccgaacatttccctttcaggtatttgcaggttcaaattgtcaacagcggtaaagctgccgaatgttttcgttacattttcaattgtaagcacgaatccaactccttccttgacccattatatactaataatgggtaaaaattaatggaggattttaaattctttatcagaatatcattctataaagggggtgacatgatgggacaatatgtattgaccgcattccatgcgtcgggagaaacgctgctggatgaacggatcgaagcagataatgaggcggaggcgaaggccgccggagaggctttgttaaaggaaaaaaagcttgagaacagtactcaccgcttggtaaatgaagccggaaagctgattttattccacagataacagaagctttccggcttctgtattttaccggttaaattgcggcgtccgtttttctaaaaaggcgcggatgccctctttatgatcatccgtttttctcatattttcctgggcctttcgttcaagagataaaacgtcttttaaccggctgatatggaggctctgataaatagccttcgtttcaatcatcgctgacagcggcgcatgcagcaatcggtcgatatacggttgtgccccctctgcagggccgccgctgaacagcccgtcggcaagcttgagccgcaccgctttttcagccggcaatttttcaccgctccaaatcagttttttcgcttcgatctcaccgacgcgtctcattaataaataatggcctcctccgtcgggaaccaatccgatgccgatgaaattcatcgcgagtcgggcgttttcttcggcgagcaccacatcggcgcacagcgcgaaactcagcccgagccccgccgcggctccgtggatggcggctatcacaatttttttcatatcatagagcgtcagcgtaatggattcaatcattttcatgagccgttcatattctcccgaatcatgatccgacgtcatcatctggatatcaccgcccgcggaaaacccccggccttccccccgcaagaggacgataagcgcttcgctgtcggctgccataacgcatgcattttccaattcccggagcatttgttcattcagcgcgttgtaactgtcaggccggttcagcacaatctctgcgatctttcccttttcttcataacgaatatactgcatgtttactccctccttgaatccgcttacatattttgttcaaatgatatattccttcccccgaagcgaaactcctttatttttcaaggtcaacagataccgaaaaatgcatatcatttgaaactgaacatacatttttatatagtgaaattgatatacaaaacaaaaaggggggaaaaacaccgataatgaaatatgtgatactcagcttgttactgagcttttttatggtgctgttccccccttcggatgtcgctcttccttcccaattggtgacagaaacagacagccatgtacaaatttcggtctacccgcaggaaacggaatcggcaaagacgccggttcaaaccaaaaccgctccgcaaggcctgtcaaaaggatacggtgcgttatcccggatgatctccctgttatctgtcaaacctcttgatcaattcattgattccacactggaaaggacatgcgccattccgatacaataccagtcaaattacctccggcagcagaccatttctcattaccaatctgtacttacggtgtaaaaacagtatattccggagggattttttatgaatattaaagaaaacgatctgcccggcatcgggaaaaaattcgaaatcgaaacgagaaatcatgaaaaaatgacgatcatcattcatgatgacggcaggcgggaaatttacagatttgatgaccgcgaccctgatgagcttctggcaagcatttcacttgatgatgcggaagcaagacagattgccgcgattatcggcgggatggtgtacaaaccgcaggcgcttgaatcgattgaaatggcgttcagcgatctgattatcgaatggtttaaagttgaaaaaggggcaaaagcggcagggcggacgctcggcgaactggatgtgcgccaaaactatgacgtgacggttatcgccatcataaagcatgaccagaaaaagtttttaaacccgggggctgattcgctccttgaagcaaacgatacactcgtcctctcaggtgaaagaaagcatctgaaaaaactgatccaagacttcctctccagagacggagtgtgatctgtttatggaccatctcgtatttgaagtcggtacggcgttagttcttgtggccattgcgagtgtcatcgccaataaaattaaattctcgatcatccccttcctgatcattttaggaatgcttgtcgggccgcacgcgccccaggcgggcatcattgatctgacgtttatcgaaagccgggaagtgattgaatttttcggacggatgggcgtcctgttcctcctcttttacctcgggcttgaattctcggtcggaaaattagtcaaatccggacgttcaatcgccgccggcggaacgatttatattctgattaatttcagtttagggctgatctacggatttatcacgggcttttcctttttggaagtgcttgtattggcgggcgtcatcacgatatcatccagcgccattgtcgcaaaggtgcttgtcgacttaaagcgcacggccaatccggaaacggagctgattctcggcatcattatgtttgaggatatctttctggcggtttacttatccgtcgtttccgggcttgttctgggagacgcgacgtctgtcgggggcgcgctgatgtcaatcgtgatcgctttcggatatatgctgctgtttttcattgccgcccggaaattgccgcctctgctgaacaagctgcttgatatccgttcaaacgaggtatttgtcatcgtcattttcgccgcgctctttttcattgccggcttttccgaaacgattcatgtcgctgaagcgatcggcgcgctcttgctcgggctcgtgttttcggagacggcccattctgacaggattgagcatcttgtcgtgccgttccgtgactttttcggggccatgtttttcttcagtttcggcctcagcattgatccgttttcactcggagatgcggtatggctcgccctcggcgccgttctgctgacgattgccggaaactttgtcgccggcatgatcgccgggcgccgggcggggctttctcataaagcatcgtccaatatcgggctgaccattgtgtcccgcggcgaattctccattatcgtcgcaaatctcggcatcgccggcggcctgtccgcttcacttaaacctttcgccgccttatatgttttgatactggccatcttcggccctttgctcacgaaagaatcgaagcggatatatctcctgctgaacagcgtattcaaatggaagacgcctgaaaagaagccgcagaaatcataaaaaaaaaactgacctcttcataagaggtcagtttttttgagcgggaagaaattgctgaaaagccgtttttttattaatggagaaatgctcttttcccagaatggtattgatgattttttggtttctgtaaacagacagcttcaaattcgtagcgcccgttccgtgagcatgatcaagattcgttaatgtgaaaaaatgatgccgtctgtcgtccttaaagacaagacgggaatcggccgtcactttaaaccgtttctcatcctcccattcgatatcgggggcgattgccgtaaaccattccggaatatgaggtttaaagccggtcgccaatatcactttttctgaatcggccgtaaaagtttcatccatctgccattgatgaaagctcagtacacagcgcccgttttgcttttcaattttttcaagctccgccatcggctgaatatacacgtcaggcgaacctccgctgatcgatctgtgatacagggcgtcgtaaatggcggcaagtgtgtcagaatcaatgccgtggcgcagtccgtccagctcagggagtgtgttcagccgttctttaaaaggcaggcggttaaaatattccacataatcaggtgtaaacatttcctgcccgagcttggcggtttccaattctcgaaatccggcggagcgtgtcacccattgcagccggctgcgccggtattgttcatcatgcaataagtcagaaaagatctccgcggcgctctgtccggagccgaccactgtaattgattcggcgccggcgagctcgtctttccggaacaaatattccgtgctgaccatcgtgtcctgacgcgctccgtcatcaatctctgcgggaataagcggttcagaccccgtccccatgacgaaatgcttcgtctgatagacactgatgcttccgtcctcaatgtttttgacgctgacttcataatgtccgccggcatttttcacgccgattacctctgagccgaaacggcatgatttgatttctgaagccgcccagcttaaatagtcgttaaattcccgtctcggaatatcaaattcattaaacgtataaaaccggtacagccggtcatgttcatggagaaagtttaaaaacgtgtagcggcttttcggatcggcgagcgtgaccaggtccgccagaaacgccacctgtaaatccgttcctttaattaatagaccgggatgccacgcaaattctttctttttatcgaaaaaaagagcgtctgttccgggtatatcctctaacaatgcggcaagccctaaattaaacggcccgattcccgctcctatgacatcatacatattatgcacctcttgcgaataacagtctgatgatcttttcccgtttttacagacggttaaacataaaaaaacggcacgctgattccgtgccgtttttgatattataatgcagatttgacgaacatctcatctaagtatttgattttctcttctgtataatgctcgaatcggtcattatatgatttcgggtctttcggattggcgaagtgcgtgatttttccggtttccggatcaatgaatttgcttgccgccccgcagccgataccgataatcgtctgcacttcttccataatcataatgttgtagatgctttcctgacccgggaaggagtagccgacattttcaaggtttccgagaatgtttttctgccggtacaagtagtacggcgtatagccgtgctcttttgtccagcggacggcgtcatccatcatgcgggacacttcctgtctgtcggcaactttatacttatgcttgtttctcgtcatttctgacgcccgtttaaaagaaagcgtatgaacggtcaaagattcaggcatgagcttttccgtttcttcaagactgtgcctgaactcagccgtcccttctcccggcaggccgatgatcaggtccatgttgatattattcatgccgtgtttgcgggaaagatggtatttttcgatggtttcttcaacggtatggtgtctgccgatggccttaagcgtttcgttttcataagattgcgggttgatgctgattctgtcaatcttatacttatttaaaacggcaagcttttcctccgtaatcgtgtcgggacggcccgcttcaacggtaatctccctgatattcgcgacatccgggaaagagcggaccatttcttcatataaaagatccatttcttcagcggtaatgcttgtcggcgtgccgccgccgaaataaatggtcgtcactttgatatcatgccgcttcagccattctccgattttctgcatttcatagtgaagcccccataaaaaggagccgactcttcccgcctgtccttgaatggcataagccggaaacgtgcagtaggcgcattttgtcgggcagaacgggatgccgatatatatgctgacttcatctttgacccggtacagatcgggaaccgcagcgagctgacggtcgacaatctcctgcatcagattaattttttcatcatggatcagataatcttttttcagatcggcatgcgcctcttcttttgtcaggccgctctgcagctttttatgaagaagtttagtaggcctgatgccggttaagattccccatttttgtgtcatgcccgtatgcgattgaagaagatttaagtagacatatgacagcgtgtttttcacctgtttaaatacttctttttcgctccatccggcaagaagcggtttcctgtgatgttccttttcgccggttcctttgatttctccggataccgacacgctgtctgcatcttgagaaatggcaagtgagatgacgagatcagagggttcctccgtttcgccgtacgcaagaacacactcttcaaaaaataaattcgcgatgttttgcagcggacgatgcagcctgtcatccgatatgccgtctatttttatttgcaatgtgatcaccttatttttcagattcaaaactttctttagtgtacagaaagaacaggctaaaatcaatccgcgaaaaagccgcagaccggcgtttcgcgtctgcggctcttgattacggccgtttcatatggaacttatcgagaaagcctttacggtgctgcatgcggaaatattccttaatcatataagcgactccctgttcatcatttgaccttgtcacccagtccgcttttctttttaattcatttgaggcattccccatcgcgacgccgagaccggccagctcgatcatcgggagatcatcttcctgatggccgatagccacaacctcttccattgaaagcccgagttcagcggcgaccatcgaaagtccactttcttttgaaacccctttaggcacgatgttcagtttttctccgttgacgcggatcacatcgacggccgggaatgctttcattatcgtatccgttatatcagcctgcaggccatcttcagcatgcacttcaatgacgggcgctgaaaccggctcatcaaggagcaggtcacttaatgattcgacaaactgcaccggataaaagatcgggtcagacggatgaatcatcgttttcccgaccagattggagttcactttcttcttgttaccgatcgaatatttttcgtgaagaagccggatattgcattgatagctttcgagcacctgaacgatattaaacgtgtgatcttctgatattttcttttcaaaaaacggctcatctattttttcagaaatgtatgcgccgctgtgggtaatcaattttgcattcagctttaatattttcgccactttttgagcggagcgaaaatggcggtttgtgaccagtgtgacgtaaatcccttttttcttgacgtattcgatggcatcctttgtcgtctgatgaagtttgccgttggagcgaagaagcgctccgtctatatttaacgccagcatttgttttgacacagagaagtccccctccttgatgactgtacttgtcattaggatatgaccctgtctctttgtttagaacaaccttttctccgcagcaaaaaagcctgcctcaagcagactttgaactgtcgttttgttgggatacgatcgatttgctgccttctccccaatgtgcatttctattaacgaaatatatcaggaaccccttatttgaccgttgatgcgctcgtttcacttactctctgttgctaccccttaacataccaggcagtataggcgaccgtatccttagatcatctgtaagtgtaggcgctttcagagttattatctcaataatattgttaaaaaacaagggtttttttaactaaaaaaatcaggggaaatatctgtgctgaatgtatgataaagttgaaagggaacgtatattcgcatataataaaagaaaaaaagcagtgactgtcatgtctctattaaaagatatttataacgaagaatttgcagaagcacttctgcacagagtcaaatcggcgtatccggcttttgagcgggacaagtgccgggcgctgatatttcaggaagattggcccggactgacgttaaaacagcggatgcgccggatcacagactctttatatgaaacactgccgaaggattacatacgggcgcttgacgtcttatatgagacatctccccatttcacagggctcgccgggattatttttcccgattatgtccaacagtacggaacggatcactgggaagaatcaatgaaggcgcttcagtttttcactcgtttttccacttccgaatttgcggtccgcccgtatatcaggcttgaccgggagcggatgttcaaagagttcctttcctggacggagcatccggacgaacatgtcagaaggcttgccagcgagggctcaagaccgcgcctgccgtggggaatctccattccggctcttcttgaagatccttctccgattctccctgttctggaccgcttgatgcaggatgactcgttatatgtcagaaaaagcgtggcgaataacctgaatgacatctccaaaacccatccggatcttctggcacagaccgcagccgagcggttcggaagctgtccgcacacggattggattttgaagcacgcctgcaggacactgttaaaaagaggagacaaacaggcgcttgcgattttcgggtttgaagacgcctcccggatttcattggaacgttttacactgaattcggaaacggccgccatcggaacaagcatacatttttcttttcagatccgctcagccgcccggcaaaaagtcagggttgaatacgcgattgattttgtaaagaaaagggggcaccgcagccgcaaggtgtttaagatgtcggagtccgccatggataacggagacgtaaaagccttcagcaaacatcattcccttaaagatttaaccacccgcaagcattatcggggaattcacactctttctgtcatcattaacggaacggtaaaaggttcgcttgatttttctgttgaataaaaaaacccctccatttcatagatggaggggtgtggagcttattgcgggctgccgtaaagctcttcaagaggtttcataatgattttgtttaactcgccgatcagcatgctcatgcgctgttccgcttccatcagctgagaaatcaattcatgctgctgtacgagagcaaccgttttttgtgcctgctctacctcttcctgagtgatttcttcacctgacatctgtttctgctgcagctgcatctgtacattgcggaagttatcaaacatgcgttttgcggattcatctgcgtttacttgatcataaagccctctcagacggctgtattcatcactgtttcgcaaagctttttcaagatcatatgctgcatcataaaaatgaactgccatagtaaccgctcctttcttcctttcggacataccactccactataacagactgcggagcgactttcatcatcggcgtatgttttccttagaaaagaatgacaaacaaagcctgaattgctccgattatcccgccgagcagaccgcctaaatacgttatcatcttaaattctctcttggaaatcgacagcaccatttcttccagccgttcaacgggaaactgatcaacctgctctttgaccacttcctcaagacgcagccgtttcagcacatcctccaaatgagcggcaatactgccgagtgccgcatcaagcagctttggcgcgtacgtccccgtaatctccccttcataacgggagatgatgtcaccgagccggcattcgaaaaagggcgcggtttgaagtgcggccaaagcccgctttttcatgctgaacagcagatctttcgcattccacttttcatcggcctcataaagtgtataagatttgagcttgccccattcttgagaaagcagatcagccagaagctttttcgtttcctcattgcgcaaaaactttaacagctcaggcagcacacggtctgccaagcttgaattgccgaggaacatctgcaccatgccgccgagcatcccccgggaattcaaaaagtcgtcaatcatatttccgagtctgtctttcccttcttcgctctcaaaataatcaatgctacgcttcaggatataatctgcggccagcgggattttttcatccagcttttcctgcagctcatcaggaagccagtctttgatggcgcggtgctcatatttccggtacaggtccgaaagcttttcatcggtaaaacggtcaatccaggcatccgtcttttcctgcggattccgaatgcccgcggcggccaaagcttcgtgcaccgtcatttcagaagcggccattttttgcgtgaattgttcggcgaaaagaagcgcctggtttttaacgttatctgataaaagccgcttttttattccttccggggttaaaaggtggttcgtcaccatgagccccatttgttttgccaattcatcccgtcttttcgggatcagccccggcgtaaacggaacccgttttccgaacaggtaatacggccggtacggacgaaataacatctgaatggcaagatgattcgtcaccgcgccgatcgcggctccgatcacgatcataaatagaaacgttcctgctatgcccattccttttcttctgcctccatcttatgttctattttcttgatgatatatctattcgtattatagaggctggcgggcatgcgggcaaatgaagaacctgaattgttgtttgtgaggaataaggcaagatgctgtttcgtactctttacagtagatcatcttttatgatgcgcttagcatatttattggatggaagggccgttccatcagcggctttttgaataaagggggagtagtaatatgacaacactcggttttatgtctgtatcccgccggcacgaagaagattacgccggggaattggctgaaagagcgcctcaatataatgtgcgcttagcccgctttacaccgtttgatatatttccggattctttgcgcgtgaaagcgctcgtctatcacccgcaaagcggaaagtggaacgaaacggaaatcgatattcccgaatatatttacgaccgctgtttttacggaaaatccgctgaagcgcaaaaagccaaaccgatcgtcgaatggctgaaaaaatatccgaaaacggaatttatcgggcgggggcttcctgataaatggacggtcacggatgcgctccaaaagcatcatctgatcagtccctatattcctgaaacggccgaagtcagccgctatgaacaggtgcaattatacttagccaaggaaaaagcatgtatacttaagcccgctttcggcgcgggaggcagaggcatcatcctgcttgaaacaggcaaaaaatcaattaccgccacttactatatcggaaaaaacaaacaaacaaaatcattttccaatcacgtgtcttttaagtcttggtgcaaaaaagtgctgcagcaccgctatttgcttcaatcctacttaaatatccaggataaagaacggcatccgtgcgacatccgcattttcatgcgcaaaacggagtcaggcgtttgggaaacggtcggaaaagcggtcagaaggggttatcagaacggtcttttatctcatttgcccggagtatcagacccgattaagtttgacacatggtttgaggaaattccgagaaagcagcaggccgttttattggatgatgtcttttcgatcacccaatccgttccttatttccttgatgaacggttcggaccgctgtttgagctggggctcgatatttgttatgccaaagacggacgcatctggcttttggatgtcaattcaaagccgggacggaaagctattttaagcgtggctccggaggcgaaagaggatttgtatacgggtccgctgagacgcttccgcgaacttcagtcacaggacagcaggaagggagtattaccgcgtgaatcataaagggatgattgtcggcatcgataaaaaaagcaaaaatacgctgtttctcccctcctccatgaaacgggaagggcttttatccgctgccttcgggaccaaggttgtcaaatgccgtgtagccttttctcaatcacttgaaaaaagcgcgctcctttctgaagatttgtttgaggagctgttgataccgtataaaagccgggctgactttctcatacacggccagacggtgcacatcggaccgctgatcggcgttttcacagccggtttcacatcatcgccgtcccgcccgttaagagaccgtacagccttcttttccaagatgctctcacttcatgaacaggcgaacggatattgtttcgttttcggagctcatcagatcaactgggaagaaggcaccgtccaagcgctgatttataaagaaaacagctggaaacggacgtccgtcccgcttccgaatgtcgtatatgacaggctcccgagccgaaaaacggaaggagttccgcttttacagcagacaaaacagaggctgatgaatgactatcagattccgtggtttaatccgcaattctttaataaatgggacattcataagcttctggaaaaaaacagtctcaccgcttcacttcttccaaaatctgtcctgcacccgaatgcagaagcgttagagacgttatgcaacacatttgacaccgtctatatcaaacctgcagacggcgcactcggaacggggatttacagggtggaaaaaacagatgccggcttatctgtcaaacacacgaatgaggaaaaaacggtggtgacggcagagtattcagatgcggcatccttcatgaaatcatttaaagaaaacaatgacccgtccgcatttttaattcagcaaggcattgacctgatccggctggatggacgccccgtcgatttcagggtgcacacgaataaaaacgccgaggggaaatggacagtgacggccattgcagcaaaaatttccggtgaaaacagcatcacgacgcatctggcaaccggcggagaagtcaggacgttagctgaattatacggcgatccgcgagagagagtcggcatgatgcggaaactttcaaaagccgccttggcggtcagccgcgtgttaaatgagcacattgaaggttttatcggcgaaatcggttttgacctcggcgtcgatcattcagggaaagtttggatgtttgaagccaattcccgccccgggcgcagcattttttcccatccgaagctgagatcggtcgattacctgacaaaacggagaaattttgaatacgcgtcctatttatcagaacggtccatcaccgccccggaaaaactttggcggtgaggctgtctttttttggttttacccgggacaggcacagaatgatgagctacaatgaacaagatcaacatttcctacaaggagcgtgaacgtcatgatttcgcacttcagctggaaaccgttattcaaaaaagagaaactgcccggatggcggatttcattttactggcagggtacgcattacgaaggggtttaccataagtccggtgacattgaatggggacacacacatccgggaaaagaagagccggctctcgtaaaagagctgcacgaattaatgctttatcacatatatgactgaaagctaaaagctcagccgcatcaggctgggcttttctttttccttccgctatttaccacccggttttccgaatgagatgccgtttgattcaccataatacgtagtacaaagcggcaaacagcattgggtgaagccgagctggcaatggttttcattccgaaaatcatcggctggtgcaattccagcaaacccaaccatactacttaataaaggagatcatacaaatggcaaacaacaactcttcaaaccaactattagtacccggcgctgctcaagcaatcgaccaaatgaaatacgaaattgcttctgagttcggcgtaaaccttggcggagaaacaacttctcgtgcaaacggttctgtcggaggagaaatcacgaaacgtttagtatctttcgcacagcagaacatgggcggccaaggcgtacaataactcaataaatggcttacagaaggcgcgggataccgcgtcttcttttatgccgtcacccttttttcctattccacataccctaggaaaaaaggagggaaaacatgtcattcattgcctcagtcaattgggagctgtttcagttcgtaagtgtttctttggtcaatgaatatgttgcccaccatttcccgtttattcacaggcattcttttccccgctgctttgaatgatataatgagcggcgaggaggttttttacatgaacatcgctttactcggagcaacgggaagagtcggacaggcttttataaaagaagcgcagaaacatggacacatggaaatattcgctcttgtcagatcagccggaacagtccttcccattcctgaaaaacagatcataacagggaatgcgaggcggcgggaagatgtcagccgattgatttccaaagcggacacagtcgtgagctgtctcggcacggacggtgacgataccctttcagccgctatgacccatataatagacggcatgaaacggcatcatgttcagcgtctgattacgatcggcaccgcgggtatccttcaatcacggcttatgcctgatcaataccgttttgaatcggcagaatcaaaacgaaaatcaacaagagccgcaaaggaacacgcccgcgtatacgagatgctgctggcagaggatcttgactggacgatcatctgccctacctaccttcctgacggagacgctgccggagtttaccggttcgaacaggatcgccttcctgaagacggcgccgaaatcacagtcggagacacggcgcattttctgtaccgcgagttgatcagcccgcagtttgtcagaaaacgggtgggactggcttactgaatgaaaaaagggcgaatcttttgattcaccctttccgattacaccgcggatttcgccgttcctttctgtaattcatacatttgatggtactgccccttttgcgccattaattcgtcatggcttcccttttcaatgatgcggcccttttccagcacgagaatctggtctgcgtgtctgatcgtggaaagccgatgggcgataataaatgtcgtgcgcccttcttgaaccacttgcagcgctttttgaatgactgcttctgtttcggtatcaatgtgcgccgtcgcctcatccaaaattaaaatggccggatcaaacacaagcgctcttgcaaaagaaatcagctgacgctggcctgaggacagtgtaccgcctttttcggtgacgggctctctgatgcccttcggcaaagattgcagaaggcttgcggcgccgacttggcgaagcgcttcttccgcctgctccagagaaatacgctgatcatcgagtgtcacattggagccgatcgtgcccgagaaaagatacgggtcttgcagcacaatgcccatatgcgacctcagctcctgccttgacatgctgtatatgcttttaccgtccagcaggatatcccctttttgggcatcataaaaacggaacagaagattcaggatggagcttttgccggaccccgtatggccgacgagggcgaccgtctcccctttttcagctgtaaagctgatgtgtttcagcacctcttctccctttcgatatccaaaagaaacatcgcggaattccactgtcccttccgcctttctgtctgcgggagcgccttcttcttccgtttcctcctcctgtaaaagctcgaatactctggcggcagagacacgggccaattcaagcttcgaaaattggttgacaatccccgtaaccggctggaacaaacggtttaaataatcaacaaatgcatataaaacaccgatcgaaacaattccggccgcactcagactcgcgcctccgaaataccagatcagcccgacaaacgccagattgcgcaacacattgacaagactgtgggacatgagggaatttaaggacagcattttgtttttgtagcggaaatgagcttcattcaattcttcaaattccttcatcgtttccttctcgcggcggaacgcctgaataatcggcattccttgaatggactcattcattttcgcattgatgtcactgttaatggaacggattttttgattgaagacggatgcgtatttgcggtacacaaccgaccagatcattaaaatcggaataatcagaaggcaaacggcggccagcctgacgtcaagcataaacagcgccgtaaaaatgccgagcatataaacgccgcttgtgataaatgtcgacagcaccgttacatataaatccctcaccgcttctgtgtcattcgtaatacgggccacgacttttccggcaggcagattatcaaagtagcggatcggcattttctgaatgtgtgaaaatacatcctgcctcatgcgctgtatgatccggttcgctcccatctgcagcagataatgctgaccgtaatgaaaacatacggaaaacatgagcaatcccgcataaatggcggtcaacgtcagcaatcctttaatttccggacggtaaaattcaaaaatctcctgtctcgataacgtaatggcgggatatgacctgctttctttaccgtttgatattgtcagccggccgtcagacaccgaacggtttccgtcaaaactgacgggacggtcaacaaaatagtagcccgcaccgacttgataaatgtgcgcctctccggttttatccgcccccggtttgagccggtcctccctgacataatcatgcccccggaacctgacggcgcccggatcgtccgcagaggctttaacccatgttttttcaatgccgagaatgtggtcatcaatcattttttttccgataaacgggccggtcagctcagtgccgaccgcaataatgagcaggacgaccgcccatatcagcagcttcttatattgaagcgcgtaattccataatcttctcccggtcttcatgcgcccgtccccccttcttcaagagaggacagctgctgcctctcatattgttttcgataccagccgttctgcgccaatagctcccggtgcgtgcctctttcagacacccggccttcgtccatgacgagaatgagatctgcgtgttcaactgccgagagccggtgggtggtgataatcgttgttttatgccgccgttttttacggatgccgtcaatgatggcggcttccgttttcgcgtctacggcagaaagcgaatcatctaatatgagaatatcaggatcggtcaaaagcgctctcgcaattgagatgcgctgcttttgtccgcccgagagcgctacgcccttctcgccgacaagcgtctcaagcccgtcggaaagcatgccgatatcgttttcaaaatgcgcatctttcagcgcgccgccgatttcctcttcgtttgcatcctgccgtccgtaaagcagattctcctttacagtcttagaaaataaaatatgatcctgcggcacatagccgatccacccgcggagctcctcaagcgggatctcctgaatcgggacgcctgtaaacgtgacctctcccgcaccgggcggatattcacgcagcagctgcttaatgatcgtcgtctttccgcttcccgtcttcccgacgatgccgagtgtctgccctttttctacggaaaaagatacatcggaaaccgccggtcccgctccgctcggatacgtgaaagtcacttgttcaaaaacaagacgcccgggctccttgatgccggcggggcgcttgggcccgatcacgtcaggctcataggaaagcgtctcattgacacgatccaaggaggcattgccgcgctgcatgatattgattaattctccgatcgcaaacatcggccagatcatcattccgaggtacacgttaaacgataccagctctcccagcgtcagccggttttgaaaaacgagataagcgccgtagccgagacctatgagatagctgaggccgacgagaagtttcacagtcggttcaaaaagtgaatcgataaacgccaccttcatatttttctcatatacatccgccgtcatatcaccgaacctgctgacatcatttttttcctgcacaaatgcccggatgacccggacgccggataccgactccagcaccttgtcatttaatgatccgaaagcatcctgcgcttccgtaaaccgctcatggatcttttttccgtacaggctgaccgcagccgccattatcggcagcggaataatcgcggcaaatgtcagcttccagctgatgagaagccccattgtcaaaaatatcgtcagcatatacatcgtcgaatcaacgagcgttaagaccccgaagcccgtcgtcatactgacggcctgcaggtcatttgtcccccgcgccattaaatcgcccgttctgtatttctcgtaaaacggcggtgacatttgaagaagccttcccatcagctttgaccggagaattttctccatgacattcgccccgccgaaaagctgatacatccaaaaataagacagtaaatagacggctgccgttaatgcgagaaaaacacatatgtaaaacagcatcccgcttttcgtaaacacgcccgccttcatatcgtctatcgcattaccgagaagtttaggcggaaacatctcaatgacattcacaatcaataacagaacaatcgctgtcgtatagcgcagccaataggctttaaaaaaccacgcgagcttttttaatacagtaaacaaataccgtcatcccctttcatcaatcagccgccctcaagcttttccggattgtttttcattgttttcgctaatgccgccacatgcatcacacctgtctttctttcatttttttgtataaaaaaagacatgaagcctcagctccatgcctcttattattataaataaggtacagacccgccgtttatgcgcgactgccccgtttttaagcaaatgttcagaaaacggaagctgtatggaagtcacgccggtattcagctgaagatgagttgacaagctttagttttgacatgatccatacctcctttttcctatattgttccttcatcatataaataaatcctttttttgtcaatgcgggttttacatttctgccgcacgggtattgtaaaacaaaccttttttactgaaaggatgaggctgatgtttcacgcagaccggttgatagcagcttttgacggaagtgatgatagtaaaaaagcgcttcaaaaagccatagacctttcaaaaacgttccacgcggatttaacggtcgtacattcccacaatgcaaaagatacccagacgattgttgatcccccgaggccgggagccggggcaacgtatatcggcggcgggattgcaagcgttcctgacccgcttcaggcggaaagaatctcccctgatccgatgatttatgaagaccgtacggaagaaatcgttgcggaagcgagaatgctgatgaacgacagccagattgacggggatatcgacattttagaaggtgatcccgctgatgccattatcgagcatgccgaccgtatatcggcggatttgatcgtcatggggagccgggaccagaacaggctgaaaaaacttttattcggaagcgtcagtgaaaaactgtcatcgaaatccgatattcccgtgctgatcgtaaaataattctttctgtaaagcagcttaatcaaaagctgctttttttacagctcccggctgttttttctttttttcggcattacaaaaaaactcgccatgatcaaaaaatcgatgcacaatacgacagaccagccctttaacagtccgctgagcgcttcggtgcgggaagcgtcctgaatgagaaataccgttccggctaaaagaacgccgccgatgacaaatgctaatacatgtcttccccatccttttgcataatgtttggcataatccagtccgtaccgcttgaccggttttgccccttcctttaccacataatagcggaaccgctcatccgcccactgaatcatgctttttccgaaggcgacagacactccgatataaacggccgccactgcatgcgccatagtcgccgccgcccctctgtataaatcagctgcggccgccagaaacagtacggcatccaatataggaatgagagcgaaaaaaaacattccgagcttttgccgcctgaatatatagcgcgccgccaatccgaagatgacagccgcccaaaaagcagcctcacaaatgacaatcaaccaagcaatcgcgttcaatccggttcccccttatcgttttctaaaatgcattgtatcactgctttttatttaatacaactgtattacaaaattgcaagaaaaaatatttcctgttacactggaaccatgcctaaaataatcgatcatgaaaaaagaagaaaacaaatagccgaagccacttggcggacgattttggagcggggaatggaaggagcgacagtgagaaacatcgcccaagaagcgggtctttctttaggcgcgctgaggcactatttcaccacccaggatgagcttttagggtatgcaatgacactcgtaaaagaaaaagcggccgccagaattaacgaagttgccatgaaagatctgccgccgaaagaaaaagcggtgcgtctgatgcttgaaattatcccgacagatgaagaaacgatggctgaaatggaggtgtggttcgctttcacagcttatgccagacataagggagaaaagtttcaaccccagcaggacgggatcttggcatatatccgcggcctgattgactggctggatgaaaataagcttctgaaaccaaatcttgataaagaaaccgaagcggagaaaatgtacgctatcgccgacggattggcgctgcatgccatgcttgaacctgatcgtctttcaaaagagaagatctcccgtgtactcgttcagcatatcgaatctctttttatctgactgaagcaaaaaggccggatgtgttccggcctttttttcagcttatgactgaacgccgagctcctgctgaatgtgcgactgaaaagcctcctgaatcgttttggctacaggtcccggcgatccgcttccgaccggttttccgtcaagggttacgatcgggattaattcagacgtggttgacgagatgaaaatttcatccgcatctctgagttcctcttcggtaagagccttctcccgcacctcaatccctttttctttcatcagctctaacagtttcatccgcgtaatgccgtttaaaatcagctcatttgcaggatgcgtccggacggtgccgtttatgacggcgtatacattggatgaggttccttccgtgaccgccccgtcccttatcagcacggcttcataagcgcctgcttcataggctttttgttttatcatcacattatacagtaaattcagactcttaatgtcacacctcagccagcgtttgtcttccgccgtgatggcctgcgctccggctttttgttcattttccggttttttcactgaaaaggtgtatgccgtcgtctgcggctccagtccttcgtcatactgatgcttccgcggcgccttccctctcgtcgtctgtatatagaccccgccgtcaatgagtttgttttcctgtacgagcttttgcagatcccattctatgtcctctgcggagaacggcagggtgatgccgatttctgcggcgcttctgaaaagacgggcgatatgctcacgcagaccgaataaggcgccgttatacactctgatgacctcatacacaccgtcaccgaattgatatccgcggtcctcaatatcaactgccgcttcttcacgatcaatcaactggccgtttactaatgtcttcatgtaaaccctcctaatcgttatctgccgtgatgtgcattctcagctgttattgtcaactattctatcatactgaacgagccggctgcggagtttatttttttcttaaaatcttattattcgacatcttttctatgtcttttccagttttgttcctgtatacttgattcgacatacatatgctgttaacttatggcacttcgcaagcctccgctgttatcggcattatgcagaaacttatgctactggagagattgttatgcgcaacacaaaagaaggtgcttccccttctctgttttcattggcttttaaacttacgagtttagcagttttgtgcggactgcttctggtaatcgtcataatgggatattccgcttcggccgcaaaaaacaaacaggtcaccgtgaccgcaaacgggcagcttcgggatgaagcagaaagcctgcggctgaaaaatgattctcccgacgtcttaatgaaacatttgcagaaagagcgtgacccagggaaaaaaacggtatatttaaccttcgacgacgggccgtctccatatactgaacagctgttgaatgtattgaaggcaaatggcgcaaaggccactttttttatgcttgaaccgcggatgaaagcctataagcattccgtgcaaagagcgaagcaggaagggatcgcgctgggcctgcacggcgtgacgcacgataatcacctgttttatcaaacaccgacatcaccgctgaacgaaatgcagcagggacgcgatacgctcgagacaatcactggagtaaaaacggatcttgtccgcacgccttacggcagtaaaccgtcattgacggatgcccagattaagaatctcgaaaaagacggattcgtgtactgggactggacgatagacagtgaagactggaagtacaaaaacgcgcggtacgtgccggaagtattgaatcagctcgcatatttggaaagcgttcatacgagcaggccgcatgtcattttaatgcacgatctgcctgcgacggtgcacgctttaccgagcctgatccaaaaactgaaagctcagggctactcctttgatgttctgacggatcaaatgattcccgtccatgaataagaaaagccggatctgtataggatccggctttttttatgtcgcggcgctgatccgttttgcaaattcaccgatcttctcatggatgacaagatcaaataaatggtcgcaatatgtcggctctaggttaatgatcacttgcttcaaaccgggaatccggcccgcatcctcagggacaaaccttgccggcgccacttcaagcgaagtgccgatcacaagaagaagatcagctttatcaagcttttcataaagggtttcaaaatgctgaacgagatcgccgaacagcacgacatccgtctttaatacggtgccgcataccgcatgatcaccgacttcggccgtacattccggcacttcgtccttcagcagatgagaaagcccgtagcgcgctccgcagcgggggcatgcggcggtctgaattgaaccgtgaagctcatagacactgctgcttcccgctttcttatgcagtccgtcaatgttctgcgtgaaaatgtctacctgctttccccgcttttcaagatccgccaaatacgtatggccggcattcggctcatagcttccgctcattttcatctgaaagagctgtttgaatttaggccagaattcacgcggacggcgttcaaagtattccctgctcatcgcttccattctggaggtgtcttcggtccatataccgcccgccgaacgaaaatcgggaatgccggattccgtgctcattcccgctcccgtcagcaccaggatacgttcagcctgattgatcaatgttataaacgcttccactcttccaccgccttttctttttatcatatcatgaaaaaagaacggcgcctgttatgcccgttctttttctccggaatgatccttcacatgaaccggatcatcgtggctcttctgttttacgaatacattctggcccggataggcgaactccacgccttcctcagcaaaaatatcaataatccggcggttgatatcctgccgcacgtccaggctttccgcccagacgatggtctttgtgtaaaagttgaaaaacagattgtaatagctgtccgcaaacacgtcaaagttaaccataatcgtatcatcatgcacgccttcatgttcacgaagcatttccctgagccttgtgatgcaccgctctaaacgatcaatcggcgtcgcataagaaacacgaacggaaaacgtgacctggcgcttcgtcatcctcgtccagtttgtgatggcttccatggacagcgttgaattgggtacggtaacaagcgccccctgcgccgtgcggaaccttgtgcttcggaatgtgatatcttcaacgccccccgtcacagatgacgtctcgacccagtcgccgatcgtaaacggcttttccgtaatgatgataatgccgccgaaaaaattgctgatcgtatctttagccgcaagcgcgaaggccaagccgccaagtccgagtccggccacgaacccgtttacatcataattgaattcctgcgcgatcacactgacgctgagcgcgagaatgacaaagcgcagcaccttggataaaaacggcgccaaaatgtcatccatatcaagctcaaagcgctgattgactttatgaaataaaaacgaagacgccgatgtcagattgcaaagcccccaggcgatcagcgctatgatcaaagagcggtacatttttttgacaatgtccatctgcccgtctaaaaacggcgaatactcaatcgccaaaaacagacccagcgccacgaaaaaccatctggccggcttgtcaaacgctacggcaatctgtttgaatatgtcggttttcggcttgttcgccaatttgtaaatgagctgaaaaaagtatttgacaaacagttttctcaaaacgagaaaagccgctaaaattccgatgctgatactgatctgcaaaatatggtcaagagtaaaaaagctctgaaattgtgtcatcatggcatatgctcctttgtcttgtcgaaaatctattatactaaaacattcggacatcagcttgttttaatgtctttaggcagcctgaaaaaccccggcctcagagcacagccggggtttttcacacattcgttcatctttcagccagatacaacagggtcaggcactatttcttctttgattgtgtctgtttcaggagagtcgctttttggatttcagcatcggtttcggccttaattctttcttccactttcaatctcccttttcccatgatctcgcctcctttttgccattataaatcatcactgcggattgtaaaccgaaaaaagcactatctttattccaaaaaaatactgttttgcacattcaccagtttgaatcgctgtgcatatacgaatctgatataataacagaaatgcccatgaggggagctgacaagcttgtataccatcgctcatcgcggcgcatccggttacgcgcccgaaaatacatttgcggcatttgatatcgctgccgaaatgaacgctgatttcattgagcttgacgtccagctcacaaaagacggccagattgtcgtcatccatgatgacaaagtcgaccggacgacggacggctccggttttgtaaaagattttacgctgaagaagctgcagtctctggacgccggcagctggtatggggctgagtttaaaggggagcggattcccctgctcgaagaggttctgaagcgttatcattctgaaatcggatttttaattgaactgaaagggcacgtttctcaagtcggtcttgaaaaagcagtcggccagctgttaagcaggtttaccttttccattcaccctatcgttcaatcattcagtctcaagtcgattcagacctttcacgacatgtatccgtccgttccgactgcaattatcgcaagacccagcttcgggatgttttccaaaagccagctggccgcttacaaatcagccgcaaattatgtcaatattaaatatacccgcctgaatcggttcttgatttccaccgctcacaaacacggcctgaaagtatttgcctggacggtcagaaatcacaagacggccgaaaagctgcaaatgatggcagttgacggcattgtaactgattttccggatattatttctaaggatggctgatatgaaacaatacatcgcaatttttatcggaggcgcgcttggcgcattgctccgctttgaaatgagcgcgcacattcacagcggaactttcccgggtgccactttcctcgaaaacgcggcgggaagccttttactcggtcttattacgggttatttcatcattcgggctaaacgccctcttttgaccgcctttttaggaaccggtttttgcggaggtttcacgacgatgtcaaccttcgcaaaagaaaccatttttctgctgcaatcgtctcccgcagcggctttttgttatgctgccgcgactttattcgctggtcttgctcttgcatacgccggcatttttttgggacggcggattgcccttcacgcagccggaagggggcatgatacgccatgacgattgtcctgatgcttatcgcggcgggtatcggagcggtattacggtctctgctgggtaagacaatttcagaaagaacaaaaggttttccgattccgcttggaatggctgcggtcaacctgctcggctccttcagcctcggcatattcaccggcttgggtctggataatccttctgccggcgtcatcatcgcgacgggctttttcggtgcgtttacgaccttttccaccttcagtattgaagccgtgcagctgatgatgaacaaccgcataaaggaaagcctgctctacatcgctgtttcagcagccggaagccttttggcgttctggtgcggctttgttatgatatccatttaaaaaaaccttgagcttatttttcgctcaaggttgcgttatgaagcatgaccgtttccggcacgggcagcgggcggtttattgtcccctgaccgcccgggcggccctgttcttctttgagttcaagctgtttaataaaccggccgtccatttctaatatgagggcagtgtatcccccgatttgtatcgactcacccgcacaaatgtcaatattccgtttcagcacaagaccgccgatcgtgtcgacttcctcttcaatctctgcgccgagaagatgattcacctgatcgatccgaacctttccgtccagcacataatggcgttcggacagcttttgaatctgcggctgttcgtcctcatcaaattcgtctctgatatcgccgacgatttcttcaagtatgtcttcggtcgtcacaagaccggacgttccgccgtattcatcagacaatatcgccaaatgaatccgttctctctgcatttttatcagcaggtcgtgtatcgggatcgtctcgatgacttcaatcaccgggcggacgtaagacatgatggatacttccgctttttcatcttctgtcataaacagcagatctgaaaagagatgcttcgtattgatcatgccgatgacactgtctttgtccccgtccgttacgggccagcgcgtatatttgtctttcagcatcatatcaagcatttccggcacgtccatatcagtggaaacagccgcgatttcttttctcgggatcatgatttccttggcgatccgattatcaaaatcaaaaattttattcacaaatgtatattcagacggattgatttctccgttttttaaactttctgacagcaggatccgcagctcttcttcagagtgggagccttcatgctcagatgccggctttaatccggccaaaccggtcagaattctcgcggagccgttcagcacccaaataaacgggaacatgaacacgtaaaataaccgaagcggtccggcaatccataacgtcagcttttccgctttttgaatcgcaaccgttttaggcgcaagctcaccgacgacgacatgtaaaaatgtaatcagcccgtacgccgcagcaaaagcaatcacatgctcggctgaatccggcagccccatgccctgaaacacaggatgaagcatccgctcaaatgcaggctctcccagtacgccgagcccgatggatgtgagtgtaatgccaagctgcgaggcggataaatactcatcaagatccgtaatgatacgctttgcgagcaccgcccgtctgtttccttctgagatgagctgatcgattctggatctcctcactctgacgatcgcaaattcactcgccacgaaaaatgccgttaatgcaatgagcacaccgattaaaatcaaactgtcaatatcgtccatttcaccttatcccgaattgaaggataaggacgtcacctcctgatttcatcgttttttcttaagcgagaggaacgaaatgggtgattgactacacagagggccccatcctgccacctcctaagtcaaagcatgattgtcatttgtatagtttattgtatcacaactccattctttcatcattttcagatttttcatcatataaaaacagccttcaaaaagaaggctgccgttatctgcttcggaaatgattttctaaacaaagcgccgtattaatccccccgaatcccatgcttaagcttaacgcatggtgtacggtatgggcgctcggcccgtcggtcacccactgaaatgaatcatcaatcggctccgttaagtttcggatcggatgaagcttgttttcccgcatttgcaagagaacagcaatgatttccaccgttccggccgcactcagaccgtgtccggtaatcgattttgtcgcattaatccgcgcgtgcgacaggccgctttcagaaagcgcccggcattcagtcttatctccgatcggcgaaccggtgccgtgcgggttgatgtaatcgatctctttcgctgaaagaccggcccgctccagcgcctggcggatcaccgtcatttcgccctctgctgaaggattcgggttgcggttcgcatcggaagccatcccccagccctttaagccggcccacgatcgtgcgcccctctcttcggcagattcagcgcgctccagcacaatcgccccgcacgcctctccgaatataaacccgtccgtatgccggtcaaacgggcggcaggcggcttcaggccgttcagcgtatgtatcagtgcccatcgctcccaaagaacggagagcgtgacactccatgtacgacagatcggccagcgccccgatcacgatgcaccggtcaaacaggcctcctttgattccttgagcagcctggataaccgccgcctggccgcttgccgacgcgccgccgaccgtaaaggccggcccttttatcccgaattgctccgtacaaagccccgacaaatcactatccataaaagaaagcccgtatgtcggatttacaaattgcggtgtttcaccgtttttctcaaaggcctgcagcaattcgcgctgcgtcatattcgacccgccgatgatcagaccggtgcggctgtgatcagcgccgtctaattgagcgtcatgccacgcttcatataaagcgataagcgccgtctttcctgataatgcggcccttcggtacaagcgcttcgacagcgcgtccggcggcgttaattcgctaagctccgcgccgataaacgaactgcctttctgccggccgggacgtttcatcacatcaaaggcgtgccgcccctccatgagcgcattgagaaacgcctccttgccttgtccgaccgcggttaagactccgattcctgtaatgctgatgtctgatgtgccattatttctcctcgacatttgtccgttctcccatctttatgtattggaagctatgaagaaaaatcttgatacagtgctttgaaaatatcgcgcgactgtctgatctgttccgaaggcacgctgaaagataatcggaaatagccgctttttccaaatccgctgccgggtacgatcaatagtctgtatttctgtgcggcatgcatacagaacgccacctcgtcttcaatcggtgatttcggaaagacgaaaaagcctcctttcggcatttcaaattcgaagccggcttctgtgaggatgtccaccataaggtctctccgctttctgtaaggttcagcgtcaatcgaaagatcatccattttcgccacggcgcgctgcatcatgaccggagcgttcacaaagccgagcgtccggttgcagaaaacgaatgcatccgtcacaagatcgccctcaggcatttgggcgtccgccgcgatatacccgagcctttcccccgcaatgccgagatctttactgaacgaactgactaaaatcacgcggtgatacgcctgaaacggattcgcctgctcttctccatagatcagctggctgtacggttcatcaaataaaataaatatgctttggccgttccgctcttcggcttcttttaataaggcacctaattcgttaaggtttttctggctgagcacagtccccgtcggattatgcggcgtattaacgatcagtcctttcgtacggggggtgatcgcacctttaaccgcttcaatatcaatctcaaatgagtcagtcagcgggcagatgacgggtctgccgcggtaattttcaacatacgctttatattccgcaaaataaggcgaaagaaggatgacttcttcctccgggtttaaaatgctcttcagcgcgacattcagcgccccgccggctccgaccgtcataactgtatgcctggcggaaatttctgtctgaaaccgctctgacaaaaagcgggcaaccttttctctcgcctccggaagcccttggttttgtatgtatccgtgccgtcctgtttcagccgcttcgcatagcgcctttttaaatgtttcaggcggctccgcaaccggatttcctatcgaaaagtcaaacaccttatcggcgccgaactcttttttcagccgagcgccttcatcaaatagtttgcgtatccatgaacctttctccagattctgtgtcacttcccgtgataaaccggccactgtcatctgtcccttctgtctttttctgccgtttctatttacaatgattatgaaagatttacatggcgcagtcaacgctttttcagacagcctgccgccccgtttcaggagaaagacggaaaacaataaacttgtgcaaactccccttcatatattaaactattctcataactataacgtgatggttggggagggatttagatggggctgagacttatcgcatcagtgaattagcagagcttgccggtgtaacgaaacgcacggtggattactacacaaacctcgggcttttaaagcctgacaggtcttgttcgaactatcgttactacgatacacttgcacttaatcggttaaagtttatagtcgcttgtaaaaagcagcgattggccctgtctgatataaaagatcgactggagaaccagtttccctcttcagccctgcctgacgatgttggaaatctggcatcggaaattgatcacatgaatcaaaacatctccgggatcttgaatcggtttgaaaagcttgaaccagaggagcgcgcccagctgaaaaaaaggctggctcctgaaaagcttgcagtgcttcaatcatttatgctgctgttaagttaaaccattatcttactaacaggaggtgttaccttcatcttcccaaaaggagtgaaggttctaattggacattgtgaatttgattttagttgcggttttaatcgcgctgacggcatttttcgtagcatctgagtttgcgataatcagaatcagaggctcacgggttgaccagcttatagcagaaggaaataaagccgcaatcggtgtcaaaaaagtgaccacgcatttagatgagtatttatcggcgtgccagctcggcataacattgacttccatcggtcttggtgtcttaggcgaatcaacgattgaacgcttgcttcacccgcttttcacaaagataaacgtaccaagctcattatcgcatattatttcatttattctcgcctacgcgatcattacgttcttacacgtggtcgtgggagaattggcgccgaaaacagtcgccatccagaaagcggaagccgtttcaatgctgttttcgaaaccgctcatttggttttaccgcatcatgttcccgtttatctggcttctgaacaactccgcccgtcttttaacgaagacgttcggtctggagacggtgtctgaaaatgagcttgcccactctgaagaagagctgcgcatcattttatcggaaagctataaaagcggtgaaatcaaccagtctgaatttaaatatgtgaacaaaatctttgaatttgacgacagacttgcaaaagaaatcatgattccgcgtacggaaatcgtcagtctgccgcatgatatcaaaatttctgaaatgatggatatcattcagattgaaaaatatacccggtaccctgtcgaagagggtgacaaagataatattatcggcgttattaacattaaagaagtgctgaccgcctgcatcagcggcgaagtatcagtcgactcgccgattacggattttgtcaatccgatcatccatgtgattgagtcggcaccgattcacgatctgcttgtaaaaatgcagaaggaacgggttcatatggcgattctgtcggatgaatacggcggaaccgcggggcttgtcaccgttgaagacattattgaagaaatcgtcggggaaatccgtgatgaatttgatatcgatgaaatcaatgaaatccgcaaactcggcgacggccattacatgcttgacggcaaggtcctgattgatcaagtgaacgaactactcggcatccatttggaaaatgacgaggtcgacaccatcggcggctggttccttacccagaaatacgacgtcgaacaatacgactcgattatcgaagaaggctgcgaatttatcattaatgaaattgacggccaccacgtcgcgtatatcgaagtgaaaaaactggcgtttgatgaactgctggaaaccgccgaacaaaaagaagcataacaaaaaagcttgcgcgtctgatacagacggcaagctttttttcatttacagttgttcaagttttttctcaagctctttaattctggcattcagctcttctgtcatggccgcaagcctctccttcggcgcaagatcggaaaagtcctccaaaaaaatcggctcgccgatgataagccgcatttttccctttttaaacagcgcttttcccgtagacggccctttatatgcggccggaacgagcggcgctttccccatttgggcgatggtcacggcccctcttttcagcgggacgtcttcagaagttctcgtgccgctcggaaaaatcccgacaatcttcccttccttcagaagcttaatcggcgttttaatgctgctcggacccggattttcacgatcaaccggaaacgcgtgaatcttctttaaaaaacttccgatccactttttctgaaacagctcttttttcgccatataatgaatctgatggggcaatatcccgacaccgagcgtgaggacgtccacccagcccgcatgcgtgcacgcgataacgaatcctttatcagacggaagattctctttattgtatactttgactcctccgcgcagagaaagaatgaatttgatggcatttgcacaaaacttatacataacgcacttcctttgttgtaatgatcaaaagtgttctctctctattataacaatattttttattacctggtactaataaatatatttttcctccgccgatctctatcttttatgacggattttgggtactatagagaaatggtgtttgatgaggtgaaaatgaatttaagccgtttgcatggaacgtgcaactttaaacctttcttatgcgtgtataacatagaggggagaaaaggcagtgacgatcgatgaaatttaccaaatgtatatgaatgatgtttaccggttcctgctctccatgacaaaagacaagcatcttgctgaagatttgctgcaggaaacctttatgagggcatacatacacattcactcctacgaccacagcaaagtaaagccatggctttttcaagtggcgagaaatgcgtttatagattatgtcagaaaacataaaaaggaagtgaccatttccgatgacttaattgggagcctttttcagacggctgttcaaagcccggctcatcagattgaaatcaaggaagtgctgacagggtatatgtccgaacttcccgacaattatcgggaggccttaacactgtattatttaaaagaactgaattacaaagaagcatcccatattatgaatatttcagaggctaattttaaaagtgttttatttcgtgccagacagcggctgaaagcactttataatagaggtgttaatgatgaatgaagaatttaaaaagcgtttttaccaatacaaaaatggagaaatgagcgaccgggaaatggccgcctttgaagaagagctggaaaagcttgaagtctatcaggagttgattgaaagcgaaatgcaggacgaccgggaatgggacgtcggcatcagcccggaaaaacagaaggccattttgtcatacggaaaacgcaaatcgtatttgcggatttcagttctcgccgtcatctccaccttgatgattttgccgctttgcactttgggaagctacctctattacggtttgggaggaaaagaaagcaccggcaatcaattaatggaaaccgcagccgtgacggtggcgaccaccatgccgaacgtactcgtggatacctccggactgaaaagccaggtgaagctgtttgggatgaatacagagtttccgctgcaaaagcagatcggcacaaaaacgaaatccgtcggcggagaacggattgaaatgtttttagatacggtcaaatcgcctgccgttaactactatgatctagacgcggcacaggcaaagcattatttcgcccatccttcgggcttaaaggaacgcacgattgacaaagccggacagacattgaaaaaattgcctgaaggaagcgtggcggaggtctatctttcttatgaccgggcctacccttcttctcaagtatattcaacttttaaaaaatacgatgtgaagtttttatggaacgcggtcgaaacggagaaaaatctgaaagacagtccttatgccgagccgttaggatttcccgggaaagattccaagatggtgtcctctttcgaaacgcaaggacagacagaccgtgaacaatttatcaatgcccttgaatttatgtcccgccataaaaaatgggcgcatgcaatatcgaaacgcaaagacatgaatcttggcagccgaatcgactatgttgaacatcacggaatgaacgtatacggctctgtcgtgacggggccgacaaaagaaatcgaacgtctgctgaaaaacaaaacagtaaaagcagcaaacatcggtgaggtggaattatggaattggtaagaatttttaaagagcataatgttttcggctggatatcagtcggtaccgcgattttgtcgctgctgcttttgaacgtggcaatcatcagcaatgtgactttctattcttatcagatgctgccgtttgcgatggccgccgtgccgttcggcatcattgagctgtttattaaaaaaggacggacgggcccgggactgctcggtgtcatcctcaaccttttcgtcattgtttgtgtatatacgatcgttgccgttgatacgaatctgcaattcggtttttaaacataaaaacaggcccttttacgggggcctgtttttttaaaatgaaagaacgccgattaaatgcagcaatacgacgatgatagccagcggcacgaggtatttcagaaggaaataccacacctgaaagaaacgatagccgatggcggaaccgcttttcatctcggcgaacagctcccgcttcggtattttcagcgggatgaagattgatattaataaagcgccgagcggaatcagcacattgctcactgtgaaatccgctagatcaaaaaacgtttttccgaacaaatgaacatcaccgagcacaccgtatgataaacacgacggaattccgactaagaaaatgagcagaccgcttgtccacgacagcttcttccttttcgtttcatcacctttcccgacagtcgctacgataatttccaccatcgaaaaggccgaagtcagcgcggcaaagaaaaagaccgccagaaagctgataaaaaacagcgagccgaacggcagccggtcaaacacagccggcagtacggtaaacagcagtgtaggcccttcatccggtttaaatccgaacgaaaaaaccgccggaaaaatggccagtcccgcaaacagcgtgacgagcacattcatcacaacaatggaacctgccgatcccggaaggttttgggttttcggcagatacgaactgtatgtcaccatgaccgaaacgccgagcgttaatgtaaagaacgcctgtcctaaagcatataggatggattccggcgtcaaatcttcaaagtgcggaaccaataaaaatctaatcccctcaacggcatgatcgagcgtgactgatcgcagcacaagcaatagaaacagcacgaataaaaccggcatcagcaccgcactgacacgttcaatccctttctgcacgccttttgcgacgaccgctactgtcaagatcataaatacaagctgcgcggcgagagtctggatcggattttcaatgaccgtcccgaacaccgttccgtactgctcctgagtgagcccggataaagaacccgtaacagcttttaacacataaagcaaaatccacccgccgacaacactgtaaaaagacaaaactaaaaaacaggccgccacacccacataacccgtgaggtgccataccgacttcggcgcggcttgtttgtaggcatcaatcgcatttgtctggctccgtcttccgaaaataaattcaccgagcaaaagcggatagcctaaaagcacggtaaagaggacgaatacaagaaaaaaagcgcctcctccgttcgtacccgctacgtaagggaacttccaaatggctcccaggccgatcgccgaaccggcagcggccataataaatcctatttttgaggcccattgaacccttttttggtcagacacgactttccacttcccttccgccctatattatcccttattcactgcgataacttaagcccatttcaatatgtttcattattccgaaaaataaaaaggagcggcgggtgccgctccttacaaatccccgtttaatttcgaatgctttctcgaatataagaaataaatcaccagaccgatgatcagccagataaagaaacggaatatggtggtggcgccaaggttaataattaaaaatacgcagaacagaatggataatatcggaataaagggaacccccggacatttaaaagctctcggcagatcaggctgtttctttctcaatacgataaccgctactgaaatcaggacaaatgcggcaagcgtgccgatgttcaccagcttcgccagctcatcaagcgggacgagcgagccgagtaatgccgacaggatgccgaacacccatgtcaccacgtgcggcgttttatgcttcggatggacttttgaaagcgcccccggcaccaaaccgtcacgggacatggcaaacatcaccctcgtctggccgtacagcatgacgagcatcaccgttgtcattcccaacactgcaccgatatcaataatcccggccacccaattctgtccggccatctgcaggacgagagacacgggatggtcaacgccttcaaagcgggcaaacggaacgacgcccgtcataatcgccgatacggtcacatacagcacggtgcagacgattaatgaaaagataattcctttcggcagatccttcgccggatttttcgtttcttcagcggcggaagagacggcgtcaaaaccgataaaagagaagaaaacgagcgccgcggcactgaaaacaccgccgaaccccatcggtataaacggctgccagttatgaggtttgacatatacggccgcaacggcgataaacaatagaacaaccagaaccttcaaaatgaccataatattattgacccgcttcgattccttaatgcctaagtagaggaggaatgtaatcgcaagcacgataacaaatgcggggagattaaagaatgtgaccgtgcctttaatggatcccggcgcggccgttaatgcggtcggaagatgaatgccgaagcccgccaagaatgattgaaaatagccggaccagccgaccgaaaccgcgctgacggcgagcatatattccaagattaaatcccatccgatgataaatgcgagaagttcacccagtgtcgcataagtaaacgtgtagacggaaccggaaaccgggacgcttgaagcaaattcggcatatgataaagccgcaaataaacacgcaagagcggcgatgacaaatgaaacggtcagccccggccccgccgtgacagcgcctgttccggttaatacaaaaattcccgttccgatgatggcccctatccccagaagggtcaaatcaaaggcccctaactctcttttcagcgacttttccccgcccgttgcggcaagcaggtcctgaatgcttttctttctgaatatgctccccttcatctgcttcactccttgtaaatcaatatatgttagaatattcagataacaatagcaataatgactaaattcttatttttcgcatgaaatgtttcagcacatcattcctttctcctacatcatattatagcgaaaaatataaaaatgaaaataacttttttgaaaattctatatattatttcagttttcataaaacagaactcaacggattctccgctgtgaaatattaacattagtaattcagctggcggcttctattttttaaaaatcgtattcatatgtaatcaaataaaaatcccgccctttttaaaagtgcgggataaaacttgcgtattatgttgaaataaacctgcctccatttacgtgaatggtctgcccagtcatataggaagattcgtctgaagccagaagcacataagctcctgcgtgttccgcaggctgtcccggtcttcccatcggagtgtccagaccgtgcttttccaccttttcttcagtaaacgttgccggaatcagggcggtccagatcggcccgggtgccaccgcatttactctgatcccctgatcggccaatgacatcgccattgaacgcgtaaaggaaacgatgccgcctttcgtgcacgaatagtcgatcaatgatgtgtctccctgataagcggtaatcgacgttgtattaatgatggcgctccctcttttgagatgaggcagcacggcttttgtcatatgaaacatggaaaacatgtttgtccggaatgtcttctccagctgttcagccgtaatatcaagaatcccgttttgcggatgctgctcagccgcattattaacgagaatatctatttttccgtagtgatctaagacttgccggaccgccttctgacaatgcgcctcatcaccgacgtctcccggaattaacaggcaatcggcctggtattctctcgcacgctttttcgttctctcggcatcggcatgttcgtctaggtacaggatggcaagatccgccccttccttcgcgtaagcgatcgcagccgctgcgccgatgccgctgtctccgcccgtaataacggcgacttttccttttaatctgcccgacccttttacatccggatcctccaagagcggttttggctccatgtctgactcaatgccgggctggcggttttgcacctgcggcttttgtccttccgtctgtctgtctatcggattcatattctcacactcctgcaattggtattactgagacgataccacgcagtgcggggagttaaacggacaaatatgccggtaattaaagctgctgagccgtttcgggaaaagcgccggtgtatttcgcagacggtctgtaaatcatgttgtcagcggactgttcaagcacatgtgcgcaccagcctgccattctgcttgctgaaaaggtcggtgtaaataaatcattgtcgacatcaatggcctgcatcacagccgctgcgtaaaactccacattcgtatacagcttccgtccgggcttatattgctctaacaagcggatggcttccttctccacataaagcgccaagtcaagcgacggatcatttcccgccacttcttcagcctttatgcgcagcgcttccgcccgcgggtcttttgttttgtacaccctgtgcccgaagcccatcaggcgttctcccctcataagcttcgctgtcaaatacgcttctgcattttctttttccccgatgtcttcaagcattttcgtgacgcctgaaggcgcgcctccgtgcagcggccctttcatcgtacccagtgcggcagtgacggcacacactaagtccgattcagtcgaaaccgtgactctcgccgaaaaagtcgatgcattcatcccgtgttccatcgccagaatcatatacgtctcaagcgctttcttttgggctgcggacggctgcctgcctgtcagcatatacaaatagttttcgacgtgtccgtatcgcgcctcgggtgacagcgcttcctgcccttgtttacggcggtatctgtacgcaataattgtcggtgtgacggcaatcagtttaatcgcttcttccggcttgggcggatatgtaaatgaatctgtgcccaaacctgaaacagccgttctcagcaccgccatgtcgtccatttcatccggaagcgtttccagtaagccgatcaaatgtttcggaagcccgcgctcggctgcaagttcttcctgaaacgcaagcaattgccgctcatcaggaagcgccccgttcaaaatgagatacgccgcttcttcaaaactgaattgcaatgcgatatccttcgcgtcatagccgcgatatattaaatgccccttttctccgtcaatgtggctgatcgccgtttctgcacaagtaatccctttcaatccacgataaatcaatttcattcccccttatcctctttctgttattatagtaaatataatatttaaaaaataatgaatatttttaagggaattaattaaaacttttaatcagaggagtgcatctatggattttaaatggcttcacaccttcgtcaccgcggcaaaatacgagaatttcagaaaaacggcggaaacgctttttttatctcagccgaccgtcaccgttcatataaaattattagagaaagaaatcagctgcaagctgtttcagcggagcggccggaaaatacaattgacggaagaaggaaaagcatacgtgccgtttgccatgagacttttggaagactatgaaaacagcatggcggagctgcacagggtgcgccagggctactcgcacacgctgacactcgctgtttcgccgcttatcgccgacaccgttctcccgtctgtcatgaagcgttatacagaggacaataaagaaaccgaaatgacggttaccattttcgaatcggaagaaatcgcctctcaaatcagaaacggctcagccgatatcggactgagctgcttaaaggtgcaatcatcttccctcacttgcctccccctgtacaatgaccccgttgtcctcgtcgcgccacccggccgaaaacccgggacagggaaggcggatgaagtgaaagacctgttcggacaatatctgcttttgacccataaccatcctgactattgggatgatttgctccgccaggtcagaatacagttccctttcgtcaggacaatgaaggtgacacagacgcatattacgaaacgatttattaaagaggggctgggcgtctcatttctgccgctgtcagcggtacggtccgaactcgccgcaggcagcatgattgaaattccgtgcgaattcgcccagatgccgagcgcgggcgcgtacgccatcgccctctatgaaaatgaaaaaaagaaaacctttttagattttttatcacattttcatttttaggtgaaacaaatggagctctgccccgtctaaataaaaaacccgttcggatgaacgggtttctctcactgctagaatcttttcgcgcccaggtagcgcggtttccagtagctgttattcagatcacttgttgtgacgccgtcagaaccggcatggatgaacttgttgtttccgatgtatacacccatgtgtgaaggaccggcttgatatgttgtaaagaagacgaagtctcctcttgacgggctggacacgctcttcattgagctccagtatcccgcagtgcttgttctgccgacactcgtctgtttgtttaacaggtaccagataaatccgctgcagtcaaagccggaagtcgtagttccgccccatacatacggcgtgccgattaaagattgcgcatcagaaatcagcttgtttacattcaggctcgtctgtgcaatattatggctggatgaaggcttctttgatgacgaagatcctgaagacgctgaaccggaagttgatccttttactttaagcacttgcccgatgcggatcaggtccgtttttaaaccgtttaaactttttaattggtttaccgtcattttatatttattcgcaattttccaaaggctgtcgccttttacgactttatatgtagacgatgatgacttgctgcccgaatttgaacctgaagatgatttaccgttgatcgaaagcgtctgaccgatgtaaatgatatccgattttaatttgttctcagatttaatggaattaattgacgttccataccgatttgaaagtccccataatgtatcgcctttttttaccttaatcgtttgcgcagatgccgcgcccgcaaacaaagtcgtccccaaaaccactgccgttgttgctgtaacaagttgctttttcatattttcctccctgaatgattctatctattttatgtgtctcttttttaaagtttttatctgtttcctattataaggttcaatttccactagaaatagacttgacttcccgtgacaaatttcttactaattcgtttttgaaaaaagtttttaagggtattaaatatttcaatttgatttcaaacgtgacgaaaaacgagtcaatttgtcatgtttttttcctgtgatcctcgtattttggaaaaacaaagcagtttactttccaaataactccttgttaaaaaaatcctcgtctttttcaaaaaagtgaatggttttcactctttcttgaaaacataagttacaccggaatttacatttctaacaatgtttcacctgaaatttacaggaggaacaggcgctctttacaaacaccccctaccattagacatgcagacacgattaaaggaggacgagtgagaatgagtctatttaaacaggttcgatcaaaacttctgccggcggcagccgtatccgtgctgacagccggtctgattgcgggcgcggggtttcagcactctgaacaggctgcggcaaaaaaacagcctgacaaaaacgagatcagaaacgtcatcttcatggtcggcgacggaatgggcgcaccctatatgaacgcctaccgttcggtcattaacaaaggaaagccttcggatggtatgaaactgacggcattcgaccccaatctcgccggtatgatgatgacttatcctgacgatcctgattccaatattaccgattccgcggcggctggcacggcaatggccacgggcgtgaaaacgtataacgcggcgatcggagtcgataaaaaaggaaagcgggtcaaatccgtcctcgaagaagcgaaacaaagagggaaatccaccggacttgtcgcaacttcggagattgcccacgccacccctgcggcattcggagcccataacaaatcccgaaagaacatggatgagatcgcaagcagctactttgatgaccgcatcaacggaaaacaaaaagtcgatgtgctcctcggaggcggcaaatcaaactttatccgtaaagaccgcaatgtaacaaaggatttcaaaaaagcgggatacagctacgtgacatcaaaacaggagctgaaaaaggaccgtaacaagaaggttctcggcctgtttgccgatggcggactcgacaaagcaatcgaccggtcaaacgctgtcccttcattagaagacatgacaacggcggcgatcgacaggctgaacaaaaataaaaaagggttcttcttaatggtcgaaggaagccaaatagactgggcgggacatgacaatgatatagtcggcgcaatgagtgaaatgaaggattttgaaaaagcgtataaagcagcgatcgcatttgccaaaaaggacaaacatacgcttgtcgttgccacggctgatcataccaccggcggattgacgatcggcgcgaatgacgataaaaactggcatgttgaaccgattcttgccgccaaaaaaaccccggcatttatggctgaccaaatcaaagcgggcaaatccgtatcttccgtgcttgcgcgttatacagacctgaaatggtcaaaagcggaaattaaacagatcgaaacggccgcaaaacaggatgctgacaagagcgtctacaaagcgatcattaagctttttaatgcgaaaacaaacagcggctggacaaccggcgatcatacgggcgaagaagttcccgtttacgcatacggtccgggaagagagtcatttacggggcttttaaacaacacggaccaggccaaaaagatctttcacatcctgaaacacggaaaataaaaaaggatgcggggatttccccgcatcctttcttcttttacagatatctccggtgcactcctttgccgtcatacgaaaacatcacttctctgtcttcaagaacagattcgatgtgcacgctcctgccccacagctggtgcagatacggcagcactttctccaaatatttcagatcaagctcaattccctcataccaatgtttaatataaagctcattattcttcaggtaatccccgtcattgacggtcagataaggaaatcccccgttgacccgcatgttcacgagctggtcgcgcacggccttccattctttgtcgatcactttatagtccctgccctgcttttggaataaatacaaatcctcacgcataacgagatctttcgtcaaataattgcggataaatgatatgtccgattcaatttccctgacctcaaacattttctcgcggccggatccgggctttacccctgtttttttcatttcatctgtcgggttgtcataacgctcttcgatgtcttcaaaaattttcagccctaaataatacgggttgattcccgtttttgacggctgaacgacgcctgcgttcagcttcgcaaattcgatggcttcatctgaagtcaggtcaagctcgcggataatccgctgatgccaataggatgcccagccttcgttcatgattttcgtttccagctgaggccagaaatacagcatttcttctctcatcatggttaaaatgtcacgctgccacggttcaagctcccgcgaatgttcctcgataaacagcagaatatctttttccggacggggcggaaacggttttttccctcttttctttttcacctgtttcggcttatccattccccataaatcatcgtaaggcgatggcgcggtttcttcttcgtcctcctcttcgtcatcgacgctccacagcagcttcggcctgacgagcgacggatcgatatgctcctgaatcgccagaatggcatctaaaaaggactccacctcttttatcccgtgaattctttcataatgcttaatccgctccgccgcagccgccatactctcaaccatgtcccggttcgtattttgaaagcggcagttatttttgaaaaaatcacaatgggcaagaacatgggctacaattaatttattttggatcagcgaattgctgtccagcaaaaaagcgtagcaagggttggaattaatgacaagttcataaattttgctcaaaccgagatcataatggagtttcatcttatgaaattgtttgccgaaactccagtggctgaatctcgtcggcatgccgtacgcgccgaatgtataaataatttcagccgggcaaatttcatatctcatcgggtagaaatcaaggccgaaacccttcgcaatgtcggttatttcctcaattgcccgctgtaaaccttttgtctcctccgcgttcaagcgaatcccccctacttggacttatttataatgtatgacccctcctctcaaaagatgaaataacagaccggtttccgactgaaaactttcggcacatccgccctgtttgctttatatgtaagtgggtaaaacacacaccataccccaaaaagaaaaggagcgattctacttgaatacagcagacatgcttacgacgtatctcagcaaactcccgaatctgatcattgcactgctcgtcctgcttatcggctggggcattgccaaaatcatcgaaaaagccgtatacaaaggcctgcaaaaaacaaaaatcgacgacaggctgttcgccgaaaaaaagccggcgcgctattcctcagaaaaagtcatcagtaaagtcatttattttatcgcattaatcatcgtttttattctattctttaacattctgcatctgacaaccgtggcttcgccttttgtcagcatgctgtcggcgataacggcggctgtgccgagcgttttaaaagccggcttgattctgctcgtgggctgggcggccgcttcgcttttcagctatctcgtcaaaaaagcgggcatgaaactcgctgaaaacggccggctcagaaaatggacaatggtgtctgaagaagcggagatgagcagatccgttacggctgcttcacgaatcgttttttacttcgtcttgctcttgttcctgcccggcgtcttgtccgctctccagatcagcggagtgtcaggtccgtttacaaatatgattcaaagcgttttgtcctttataccgaaattattcgccgcggcgctgattgttttaatcggctggcttgttgcccgtctcgtccgtgatatcgtcacaaactttctggcgagtatcggaacggaaaggctcgccgcacgtatggggctttccatttatctgaaggatacgagcctgtcggcaatcatcggaacgattgtctacgtgctgattttcattccggtgatcatctctgcgcttgaccggcttaatgtggcgggtatttctgaaccggcgtcagccatgctgcacacggtcttcacaatgctccctaatatcatcatcggtattgtgctgatcatcgccggcatctgggtcggaaaatgggtcagcagcattgtatccgggctcctgcaccgggccggttttgactctcttctcggtaaaatgggctttgaacaggcgggcaccccgaagctgacgctttctcagacggtcggcatgattgttcagatcatcatcgtcctgctctttacggcagaggcgctgcagcttgttcatctcgaatttctcgtcgttatcgcaaccggtattatcgcttacctgcctaatgttctggccgctgtatttattctcggaatcggacttttggccggacagcttgtcagcaggctgcttgccggcatgctgagcggaaaggaattcagattcctggcgccgcttgcgaaatataccattatcactctctcaatctttatggcgctggatcagctcggtgtcgccgacacgatcgtaaatgccgcgtttattctgattctgggcggtttcgcgcttgccttcggactttcattcggtcttggcggaaaagaatttgcctcccgttacctcgcaaaattggatcgcaaaattgaaaaacatcaatcggctgacgatcgtaagccgccgatgtcttaacgaaaaaaacgtgtgctcagaaggagcgcacgttttttttgagttaagggggcaaattccttttttttcattttagattcatatatgatagactgtaacagaagcaaaatctcttttttcgaggtcattctatgaaattaacgaactataccgattactctttacgcgttttgatttttttggcttccagacattccgacgaactttccaacataaaagaaatcgcagatacttattccatctctaaaaaccacctcatgaaagtcatttaccgtctcggccagctcgggtatgtcgaaacgatccggggccggggaggcggaattcgattaggaatgacaccggaagacataaacattggagaagtcgttcgacatacagaagacgactttaacatcgtagaatgctttgactccaaaaaaaatctctgtatcatatctcccgcctgcaacttaaagaaccttctgaatgaagccctgcaagcttacctggccgttttagacaaatatacgttaagggatctggtcaaaaacaaagaggagattatgagactgctcagaagctgaaggaatgtccgcattccttctttttttatgccggcataagaaaaaaggactatttctattaatatgataaacgattgcagacaagtgccgatataaagattatcattactgatatcctcaccttgcggctgcaacgaatggggatagaaaaattatcgcaggaaaagggagattcactatgaaaaaaaaggtagcggtcggtttgactgcatctgcgatcgtcgggtctgcgttagctgtaacaccggcagaagcacaaacgattaaggtcaaaagcggagattcattatggaagcttgcccaaaactacaatacaagcgtggatgccattacatcagcgaatcatctaaaatccaccgttctttctatcgggcagacgctcaacattcctaacggcaaatcagattccggcagcaaaaagccatcttcaaagaacagcggcacgactaaaagcgtctatacagtgaaaaccggagactcgctgtggctgatcgcatctgattttaaaatgtccgtacaggaactgaaaaaattgaacggtctgacaagcgacttaatccgcgccggacagaagctgcaagtgacggggaaagtttcctcaagcaccgatcagaaaaaaaccgctcctggcagcagctcaaacagcagcaaaaatcagtcatcatcttccgggacctataaagtaaaactcggcgattcactatggaaaatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaagacaattcaaaccaaaatcaacaccagacgcaaacgtcctcctatacagtaaaaagcggagactcactctggaaaatcgcaaacgcatacaatatgacggttcagcaaatcagaagcatcaacaaactgacgtcagacatgctgcgggtcggacaagtgctgaagctgaccaaaacgtcttcttccggctcttcgtcttcaccgtcagctccgaaccagtccggaaatacagggaaaaccactacatataccgtgaaaagcggggattctttatgggtgatcgcccaaaagttcaatgtgacagcccagcagatccgcgagaaaaacaatctgaaaacagatgttcttcaaatcggacagaaactgacgattaccgggcagcagacaaacacgacaccgaatcagtccggcagcacaggcggcacaggttcaacaagcgcgaagattaatgtaatgatcgatgccgcaaaagctcagctgggcgtaccgtatgtatggggcggaacgacgccgagaggctttgactgcagcggtttcatttattacgttctcaataaggtcacttctgtatccagactttcagccgcaggctactggaatacaatgacatcagtcagccagccggcggtcggtgactttgtctttttctcaacttataaagccggaccttcccacgtcggtatttatctcgggaacggccagtttattaatgccaacgattcgggagtcgttatttccagcatgaacaattcctattggaaacagcgctacctcggcgcaaaacgtttcttctgatacctgataagctgtacggccgcataaggctgtgcagcttttttacagtctgaaaatattgatgctgatcacgtgttttgttacgggatggaaatacacttcagcacgggatgaaaacgtttcttttgcggtttgcaccgttacgcgaaacacgtctttcgtctgttcccggttcacttttgtacggcccatgtacgaataatcggtaagctcggcccccttgtattcacgttcaagctggttccatgcgagctgttcccatttttcaactgacggatcgaggtgttctgtatgccctttttcagcgatagaggcaatgagaatgccgcaaaacaagagggcaagcgcaaatggaagggatttcatctttatgttctcctgagtcgttttttgtcaatcttagcgtgtccaaagaagagacggatatgcggttttattttatgtctccctcatattgctatgccgcagtgataaggacaccaagttttcccccgttgcatccgggcttcggcggcataaactaacggagaacttctcattgaaaggagaagcgtaagatggatcatgccgattatgataaagccttgtattacacacaccggtctcaatgggacaatttattaattttgatggttcgtacaaaagatgatttattatcaaagcgtattgagcactttctgcacgcgtatcatttcgaatatgatcatgccgtgcttgaaaaagagctgtattcccttctcgggtatattgatcatgcgacagagctcgcttatgaagatcaattagccatgctgacataaaacaatcccggcgtcagacgccgggatttcttgtgtttgtgaacatattcagctcttcgatcatgtctttcaggctgaccgccatatcctcagatacggtccggcgctccatgtcgatgtgaatcgggtctaagaccagctgtttcgggatgacatttgcatagacgccccgcatgaccgtccgcatattcgccagcgcattcatgcctccttttcctccgcccgccgcggcaatgacggccaccggtttgtatgcccagtgatcgctgcttaaaaaatcgatggcgttttttaaagcgccgctcatgccgctgtgatactcaggagataataagacgacggccgctgactttttcacctgccgccttaacttttgcactgaaggcagctcgttctgttcttcttcaccgttataaagcggcagttcactttcgctcaaatcaataaaatcggtatgaaaccgaactctgatataagaagcggcaattctcgtccgcccgttttttctcggtgtgccgctgatcactaatatgctcatgattttaccgcctttcccaaaacattatattttaccgcatacaatgccgcctgcgtccgatcggaaagattcagctttgacagcaggttggacacgtgggtcttcactgttttttctgaaataaacagggccgccgcaatttccttattgctttttcctttggctatttcttgaagaacatctttttcacggggggtcagctgataatatttttccttatcctgatcatcctgaaccatatgggtcagcacgtgaggcacaatatccgccgacagccggtaacgtccggaatacacttcccggagcgttttcactaaatcatcgggctgagcgtctttcagctgatacgcttttgcgccggctttaagggcgggaatgacgtgctcctgatcagaatagctcgtcaaaacgacgatactgatgtccggaaatcgttcagccgcaatttttgccgcttctatgccgtccatatcaggcattgataaatccatcagaatgatgtccggctccgtcttttcagcttgctgaagcgcttcagcaccggtggacgcctcaccgacaacttcaatgtcttcctgagtggcgaagaaatagcgcagtcctttgcggacaacatgatgatcatcagcaatcacaattttcatcaatcagacctcccgtcccgaaacggaagccgaacggagacaaccgttccggcgccaagctcggattgcaatgtaaagcggcctccgatcgcttcagcccgcgctttcatgccggccacgccgagcgatgggagcgcagcatgcgtatcagcgctgaagcccgcaccacggtcgctaatgtgaagctcagcgtaacccggctttttaacggcggaaatgataacccggtccgttcccgcatgctttttacagttattcaaggcttcctgggcgatccgccaaagcgcgtgttcctgttcatccgtaagctccagctcatcctccgcttcacaaacggcttccaggccgataagagcggcgtagcttttgatcgacgcatacagccctttcgttaaactttccggcttcagctgccaaatgagcgccctcatttctgttagcgcatcctgagacagctcttgaataaacgtaatcatctgccggagccgatgatcatctgtaaagctctttgcggcttttgccgttaagctgacagaaaacagcatctgattgacggaatcatgcagctcttgcgcaagtctgcttcgttccatcaacagggcgttctgctgctcaaattcggccaatttcatccgctgaatcgccgttccgatttgaaatgcaaccgcttcaagcagatgcagttcttcttcgttgaaaaatgtcttttcgcttgcggcgacgtttaataaaccgaacttccggccgccgtcctcaagcggtacggtcgcatgatgggtaatgccctccgtatcgcggcagttcgtcgtctgttccgcaaattcaatccgtttacaattcattatgtttacggcctttgtcaatccgccattgctgaatttggtcagacaatagcattccccgctgcacatgagtgcattttcccgctgaccgagagcaggcggtaaataagcggatgcggcgagcgtataagacccgtccggctcaatcagaaaaatccaccctgtctgcagtccggtcaggctgagcagttcgcggagcactttatcaagcgcttcctttaaatcgtggttttggtttaaggtttccgcaatcgcttttaacgtttttaacgtttctaccgtcgttttcgtcaatttccctcactccggccaatcagaattatccatattatatcaattcttttctgtatattcctttgttttcagcatgaattttcctcatactttcggatgaggcgtataaaaaaaccgccggatgtcgcttccggcggtttgttgtttatttcgttttttccactatgtcatccaccgttttcatgactgcttcagataatgcggcaagacgctgttcgctgtcttgtaaagaagtccccttcacggcgaaatagaacttcactttcggctccgttcctgatgggcgaaggcagaaccaagagccgtcttcaaggaaatatttcaggacatttgacttcggcagatcaatatcttcttcaagatgatcggcaaatacagtccgttttcccgttgaatagtcttcagcctgcgtgatttgttttccggccatctgcttcggcggatcgtttcggaatgaagtcaggatagcggaaatctgctctgctccctgttttccttttaacgtcaatgacttcaggccttcacggtaatatccgtattctttaaaaatggacagcagcgcgtcataaagcgacatgccctgctttttataaaaggcgcatacctcaacggctaacagcgcagcctggatcgcgtctttgtcacgcgcgaaatcgccgattaagtagccgtagctttcttcatacccgaactggaacgtgtattggcctgatttttcatattctttgatcttttctccgataaatttgaagcctgtcagcgtgtcaaccgtatctaatccgaacgatgaagcgacggcgcggcccaattcgctcgtgacaatcgttttcatgacgacaccgttttcaggaagggtgccctgttttttcttctcggaaagcaggtaatgcaataaaagcgcgcctgtctggtttcccgtcagcactgtgtacttgccttcgctgttttttacggcaatgccgagacggtcggcatccgggtccgtagcgacaagaatatcggcattttgttcttctccgagcttaatggcatattcgaatgccgcgtgctcttccggattcggcgatttgacggttgaaaaatccgggtccggcagctcttgctcctttacgacggtgacgtttttgtaaccgagtgcttcgagaccgcggcgcaccggtttatttgccgtgccgtgaagcggagtgaacacgacgctgacatccacttcatccgaaagctcgggatgtacggagatggaagtcagtttttcagtatacggtttatcaatttcttcaccgattattttaatcaaacctttttctttcagcgactgttcatcttcaacttgaatcgttaattcattttctatggcattcacttccgcaatgacgatgtccgcttctttcggcggcagctgtgcgccgtcatcgccatacactttatatccgttatattcaggcgggttatggctggccgtcacgacgatgccggcataagcgttcagctttctcaccgcaaaagacagctcaggcgtcgggcggagctcatcaaagacgtatgtttgaatgccttgggaagcaagggtttttgcagcttccatcgcaaactcaggagatttatgacgggagtcgtatgcgatcgcaacccctctttttttcgcgtcttccccctgtttcgcgatatacgccgcaagtccggcggatgctttgcggaccgtgtaaatgttcattctgttcgtacccggcccgatttctcctctcatgcctcctgttccgaactcaagatttttgtagaaaaaatcttccagcagcggctcgtttccttctgcgtccgccaataattttttcaattctgaatctaattgttcggcctgattccagcgttcgtaactcttactccaactcatgttcgtcctcctataatttcagcttatgaccatattttaatatgaagcggctgcccgtgtcacttgataacataaccaaatgctttatgtaaaaagataaaagaagggctcatgccttttcggcacagccctccggttattattgttcgagcggaacaaccgcgtcgtgcagcagcgtatttaaccactcagtgtgtttttctttcgtttcgtcattccattggaatcggtcgctcatgtaatcaatcacggccgttttatacgtttgcacccatttgatgtcgaagaacagtcttcccgttctgcggacgaagaaatcggcaggtgtcgcagccatttcttcttcgatgctgtaagctgcttcagccaaaatgtgaaccggaatctggcgtttttccgcttcgtctttcaggccttcaatccggctgaatacattttcaacgttagagccgtatctgatggctaactgcttagcggtttcctgtgataaaccgattttcaagccgtcttttgtctttgcttccacaaatgactcgaagtttttagagccgccgacatgtccgccggaaatcggcatcgtcttcgtcttgcagccgccgaagtcctggccgccctcttctttcaagcggtcgcggacaagatcgacaatgtgctcagccattttacggtagcccgtcagttttcctccggcgatcgtaatcaggcctgattgagatgtccagatttcatctttacgggagatctcagacgggtctttcccttcttcgtgaataagcggtctgaggccggcccagcttgattcaatatcgtccgccgtaatgttcagttccgggaacatataattgatggagctgacgacataatcgcgatcctgcaccgtcatgcgcgggtgctcaagtttttgtttgtaaaccgtatcggtcgtacccacgtatgtttttccttcacgcggaatggcgaacaccatccggccgtccggcgtatcaaagtacaccgcctgtttaagcgggaatacggattggtcgaatacgagatggaccccttttgtgtgctggagatgttttccgcttttgctgtggtctttttctctcagttcgtcgacccacggacctgtcgcattgacgatttttttggcgtacactttgtattccttgcctgacagcagatcttcaattaaaacgccgacaacttttcctttttcataaagcagttctttcactttagaatagttgacaggctcagcaccgaatttaacggcttctttcatgacttcaatcgtcagtctcgcatcgtccgtccggtactctacataatagcctccgccttttaagccgtcttttttgacgagcggctctttttgcagcgtttctttagcagacagcatgcttctgcgctctgatttttttactcccgctaaatagtcatacacacgcaggccgatggaagtagagaatgaaccgaacgtgccgcctttatgaaacggcagcagcatccattccggcgtcgtgacgtgcgggccgttttcgtacacgatggcgcgttccttaccgacttcagccaccattttgacttcaaattgcttcagataacgcaaaccgccgtggacaagctttgtggatcggcttgatgtgccggccgcgaaatcctgcatttcgctcaaagcgactttcattccccttgaagcagcgtcaagcgccgtaccggcacccgtaatacctccgcctataataaacagatcgtatgtttttttagtcatgtcttccagcatatgatcccgttccaaacttgaaaattggtgattcatcattacgcttcctccttgttgtcacggtatagaaaaagagaccacaacagccaaagcgcatgtcatcactttggtgctgtggtctctcctcatctcaggaccgttcctattaacttgttttcagtataccataattttatcttatttaaaagccatagctgcatttactgcttttttccatccgccgtacaattcaacgcgtttttcatcttccatttccggtttgaattgcttatcaaggttccactgatcggcgatttcagtgctgtccttccagtagccgacagcgattccggctaaatacgcggcaccgagcgcagtcgtttcattaatttccggacgttcgaccggcacatcaagcaagtcgctctggaactgcatgaggaagttattttttaccgctccaccgtctacacgcaatgtttttaaagagatgcctgaatcagcctccatggcatcaagcacatctttcgcctgatatgcgagagattcaagcgtggcacggataaaatgctccttcgtcgttccgcgtgtcaggccgaaaactgagccgcgcacgtcactgtcccagtacggtgtgcccaatccgacgaaagcgggcacgacataaacaccgtcagcggaatccacacgctctgcgtatgtctcgctttctttcgaatcctggaacatccgcatgccgtctctcagccattggatggcagaacctgcgacaaagatgcttccttccagcgcatactcgacttttccgtctaatccccaggcgattgtcgtcagaaggccgtgatcagaagtgatggctttttctccggtattcatcagcataaagcagcctgtgccgtatgtgtttttccccatgccttcttcaaagcacgcctgaccgaacagcgcagactgctggtctccggccgctcccgcaatcggaatatttttaccgaagaaatgataatcaaccgttttcgcgtacacatgagaagacggtttcacttccggcagcatggatttcggcacgcctaaaatatcaagcagctcgtcatcccattttaattcatggatattaaacatcagcgttcttgaagcgttggaataatccgttacgtgcgccgcgcctccggacattttccagatgagccatgaatcaatcgttccgaacagaagatttccgttttccgctttttcccgcgcgccttctacattgtcaagaatccatttgactttcgttcctgagaaataagggtcgatcaaaagtcccgttttttctctgaatgtatcattatatcctttttcacgaagctcttcgcaaatgccggatgtttgtctcgattgccacacaatcgcattgtataccggctttccggtatctttatcccatacgaccgtcgtttccctttggttcgtgatgccgatgccggcaatttgatcagcgctgattccggactcggaaatcacagtcgcgataacggcgagcaccgatccccagatttcgttcgcattgtgctccacccagcccggctgagggaaatgctgtgtgaattccttttgagcggaatgcacgatttttccttctttattaaaaagaatcgctcttgaacttgttgtgccttggtcaattgataaaatataggtctccatgatgccgctctcctttttaaatatattcagaatttgataatgttttctgtgattgagatttcttggtataaatatagagtatgaaaagcactacaaccattataacgcttacaaaccaaaagctaggtgtcacatttcctttaaacgcggcattgtaaaatacgccgccgaacgcaccgcccatgatcggaccgattacgggaatccaggcatatttccaatttgacggcccttttttcgggatcggcagaaaggcgtgagcgattctcggccccaaatcccgcgcagggttgatcgcatatccggtcgtccctccaagagaaatcccgatggcaacgatgaggaatccgacaatcagcgggttcagcccttttgtaaattcattcgctccgattgccaaaatgccgagcacaagcacaaacgtaccaatgacttcacttatcatattcccaaatgtatgaggaatactcgggccggtcgagaaaacgcccagtttagcggccggatcatccgtcgccttccaatgcggcagataatgaaggtacacaacaaccgcaccgatcattgctccgatcatctgtcccgcaatataaacagggacgtctttccaaggaaagctgccttcaagcgcaaggcctatcgttaaagccggattcaagtgagcgccgctgatgctgccgacggcatatgccgccatggctactcccaatccccagccgaatacaataacaatccatccggattggtatgaaagcgatttctttaagttgactcccgcacaaacgccgccgccgaaaataacaagcagcattgtaccgattacttctccccaaaatgctgtcatcatcattcctcctaaatgacaaaatagcaggtttgacagagttatagagaataaaaaacccacaacaaaccgctttacgctttattgcttccgtaaagagctgttgtgggtctccgggtctccatcacatagtattaacctaggtctattgtaacaatgggtgtaagcggtgtcaatctttttttgtcatagaatgttcatatttagcccatagttcggtgtctgaagtcgtcacggccgtggctcctgcctgcaaggcgttttcaacgtcctgctccgtgcggataaagccgccggcaaaaatcggaatccccgtcatttctttaatttctctgattaaagtcggaacgatgcccgggagaacctcgataaagtcaggcttatgctttccgacgaattccatgcttttttccatggcgctcgtatccaagagaaacagacgctggatcgcgtatattttcttttgtttcgctttgacgatgacggcggatctcgtcgaaatgatgcccgcgggccggatgtcctgacaaatgaactccgcaccgtattcgtcatgcttaatgccgtgaattaaatcgacgtgaaccatcagaagttttccgtgttttttcgcttcattcacgacaccttttaattgaccgaggtggatatctaaaatgacgccgtataagaacggactctctaaaaatgcatcgaattgcttcatgttccggatagccggtagaatcttctggttgtgaaaactcatgttttactcctttactttaaaaatcaatgctcagcacgctttccttgacggtcgaaatgatgaaagagagctcctcgtcggacaggcaaaaaggcggagacagctgaatgacattattatatcccgctacagtatcaccatttttcccgacaagcaggcctttttctctgcacgcggtgatgacgtgctgcacaagagcggcatcagcgggttccttcgtgattttgtccttgacgaactcaatgccggcaagaaggcctttgccccgtacatcgccgaccgccggatgttctttgagcggctcaagctcacggagcagccgttctccaagctcccgggagcgggcgatcagattttcgtcctccatcaattgcaggtttttcaaagcaagggcgcaggctgccggattgcctccgaatgtattcacgtgccggaagcggccgtacggctcaccgcccgaatacgcctcaaaaatctcccgttttactgccgttgccgacagcggcagataagcgctcgtaatgccttttgccattgtgacgatgtccggtgaaacgccgtaatgctgaaatccgaacggctctcccgtgcggccgaaaccgcaaatgacttcatcactgatcagaagcgcgccgtggcggcggcaaatgtcctctacctttgccatatacccgtccgggggcatcagtatccctccgcctgtaataatcggttccataataacgccggcaatcgtttcgcttaactcccacgtcatgatccggtcgatttcatgcgcgctttccaatgtgacggcatcgccgggattccgataaagatcaggcggcgccgcgtgcaaaaaaccttgtgagagcggctcatatttatattttctctgcgcctggccggtagcggcgagcgcccccatcgtattgccgtgatagcctctgtaccgggagatgaatttgaagcggctgtgatcgccgttttcaatgtggtattggcgggcaattttgaacgcggtttcatttgcttccgatccgctgttggaaaagaagattacataatcgccgccgagccattcattcagtttttccgcaagctcaatcgcgggttgatggctttgggtcagcggataataaggaagctccttcaattggctgtaagccgcatcggcaagctcctttctcccgtatccgatattgacgcaccacaatcctgacatgccgtccaaataccgtctgccgtcaatgtccgtaacccaggcgccttcccctttttggacgattatgctgtcatccggctccgcccctttcatcgcgtgccaaatcagctctttatccttttgtttgagtgactgatttttttgtacatgttccacaccgctcatctccctttcaatatcattgcactgtatcgaaagctgcccggcttctgacgccgattctcatggtgaagttttcctcttaataagaatataaaggcgcggcatgggcgagtcaataaagcggcggcaattaaaaaaacgctttctcccagaaagcgaaagggctacaagagcatatcccgaaaccggggccggtgcaagtgtttttataaaaaaacccgcccttaagcggagcgggcgtttttttatttcagatgcgtaatccggtaaatgtctttgcgccggtctttcagctggcgcacggttccgttttcacgctgccttcttaagatttcaaggtccacgtccccgatcacgaccatttcgatattcggattcgtttcaccgacgattccgtctctggcgaattcaaaatcagacggagcaaaaatggctgactgcgcgtattgaatatccatattttctgtttgcggcaggtttccgaccgtacctgagatgacggtgtaaatttggttttcaaccgctctcgcctgagagcagtaccttacgcgcaaatagccttggcggtcttcagtgcagaacggcgtaaagataattttcgccccttgatccgcggcaattctcgcaagctccggaaattcgatatcgtaacagatctgaatggcgatctttccgcagtccgtatcaaatacgcgcaccctgtctccggcgctgatgccccaccatttccgctcattcggcgtaatgtgaagcttatattgtttttcaatcgtgccgtcacgtctgaataagtaggcgatgttataaattttcccctcttcttcaacgaagtgggagccgccgataatgttcacattatatttcaccgcgagatctgtaaagaggctgatatagtcctcggtatattcggtaatcctctgaatggccagactcggagaacgctcttcgagaaatgacatgagctgcgtcgtgaaaatctccggaaataccgcgaaatcagatctcgcatctgaagccacatcgacataatattcaacctgattggcaaattcctcgaaggagtaaatctttttcatttcatattgaatgacgcagatgcgcaccggaaatgccgatttgtaatagcgctttgactgcggcagataatcgacattgttccattccattaatgtcgcatatttaatggacgcggtgtcatccgggagataattcggattgatccgcatgagcgtaaatccgttcatcagctggaaagaaagcaccgggtcataaatctgatggcgcgtcacctgttcgacataggctctcgccgtcatttcttccgcatacttatgataattcggaatccgcccgccgataatgatgcttttcagattcaatcgtctcgccaagtcttttctcgcctcatacagccggtgtccgattttcatccgcctgtattccgggtgaaccattacctcaatcccgtacagattcaatccgtccgggttgtggttcgtgatataaccgtcgtctgtaatgtcctgccacgtgtggcggtcatcatattcatcgaaattgatgatcaggcttgagcatgaaccgataatttccccttcatactcggcgcaaaactgaccttccggaaagtgcgcgagatggctgattaaatgctcaggctcccacggctccatccccggaaaacaatccttttgcagctcaataattttgttgatatctttctcttccatattccgtatgaccattttcttttcaaaacgggtcagatcaagtttctcagacaatgccgcttccccctgccggttcgttttgatcgttcaatcgctgtaagagtaattcaagttccatttccgccatcgattccagtctgtgatcgtattctttaaataacagggcgctcgttaccttattcggcacgatgacacatttcatgccggcgcgtttggctgcgattgagccgttgaccgaatcctcaaaggcaagacattcagaaggttcaacgcctaaatgttccgcagctttcagatagagctccggattgggcttcacttcttctacgtcgtcagccgtctgaatcacttcaaattcatcaaacaggcctaattccttcagatggcccgacacccatttaaaatctgagctggaagcgagccccaccttcaatcctaattcttttgccgcggctaaataagcctccactccgggacgcgccgtttccgtcttcatccgctgttcgaagcgcccgcgcctgatcgccgtcagttcatcatgatcgagctttcttcccagctgctcctctaaatatgcgaacggcttaaaccccgccgccgttccgatcacctttccccagacggataaaggcaatgttgaaccgtgttcctcaaacatttcctgcagcacttcatattcatgggtttctgtatctaaaattaacccgtcaaaatcaaagattaatgcttttatcaatggttacagctcctttagctaaacgtactgacctatgtatacactataccgtgaatttcttttgcattcaaaatgtaacattctcacggaaagaagagcctgcatgaatgcaagctctcttcatccgttactgtgtgttttgactggaaatattggaaagagccgctcccgcagactcatttgaacgctgatcgaccgctaagtctccaagcgcaacgatcccgaccagatgattttgatcgacaatgggaaggcggcggatttggtgttgggccatcagatgtgacgcctcttcaagactcatttccgggttcccggatacaacttgagaagacatcacgtgtgaaacaggtgtttggccgtcgcggccttgagccgttgttctcaatgcgatatcacggtctgtcagcattccttttaattcccctccgtcaacgacgggaattgctccgacattatgctggtgcatcagcgcagccgcttcctggatcgtttggttgggagaaacggtagccacgtgggtagtcattgattgtttgattgaactcattgtaaagcacccctttcgcattttattatgctcggggatttgactcattataaagggagttagaggaaagaaattgtggtatcatgtcaaggaagcaaaaaagagcctgtcaaaaggctctttatacccgtcagatcagccttctgtgaccgcaggcttctgatccggcccctgtctcgaaatcatcataggtaaagggaaaattcattccgcattcattcagcaaagcgcaatttttatcaaacagcgcccgctctttgacgtcatatacggggtgcggctttgacagcatgatatgtaccgtttgcagacaagccataatttgaaacgcttcttttaaagttccttggtaacgttggttttgtaaagacaatacgcccctttttttaaagcgctgaatttccagttcggagaaataaagaggaaagacattttgaaacaattcagaggaaagctcttgtatcgcgctttcttgtccgtcagtcgctgcgttcacaattctcacatcaatcacctttcttgccatgtgaatatccttaatctttatcaagaatagcatagaaaaaaacgcgaaagctaaggtaagtgtttcctattgaaacagccgctttccgcttgaaaaggagctttatgatatgaaacaaaatgaccgcggtctggaactcctgattacggaaaaacacgccggacaatggctgttttcagtcctgaaatctgaattccaggcgtcaaaacccgtgataacggaatggatgaaccaaaaaagcattcaggtgaatcggacatccccgaaaaacaacatcatactgaaaaccggagaccgcttattcattgatcttcaggaaaaaacgggttcttcggtaattcctgaatacggagagccggacattttatttgaggacagtcatatgctgattgcaaataagccggcgggaatgccgactcatccaaatgaagagggtcagaccggaaccctcagcaacctgatcgcttaccattttcaaatcaacggcgaacaagcgaaagtgcgccacgttcaccgtcttgaccgtgacacgtcaggcgcggtcgttttcgcgaaacaccgcctggcccatgcaatccttgaccgtcagctcgaaaccaaaacattaaaacgcacctatatcgccgcggcggaaggaaaagtcacgccgaaaaaaggcacggttgactcgccgatcggccgcgacaagtcacattccgtcagacggcgcgtctcacccggcggacaagccgccgtcacccattacaaagtgaaaggctatcatcccggtgcgcagcttacattggcagagcttgaactggaaaccgggagaacacatcaaatcagggtgcatatggcaagcatcggccatccgttggcgggcgatgacctgtacggcggaagcagggcgctgtttcacaggcaggcgcttcacgccaaaaaagtcagtgtcgtccatccgatctcaggagaagaaatcgttgccgaggcgccgatgccggctgatctggctcattttaccgaaacgtatttttcttaaaccgggtcggcatatataatatatcgtttcggcgcatttccaatgtaagaaaacggatagcaagtggtcaggatcagttcctcccgcttgtgttgaagggtgatgacagacgtatcatcccggccgacgatttttgtacggctgattttataagaaaacgtgccgtaagacaaaatcacgttcagtctgtctccttttttcagttcgccggtccggcggaacaccgtgtccctgtggccggataacacaatttggccgtgatcgccaggataatagctgtccttataatgtccgacgccttttgctaaatcatctgcgtcagtcccttcgacgatcgggagctcagcgtcaatttcagggatttctaaaatgccgcttgcctcacccgtttcggggtgaaattcttttttgcgctgtgcctgcacagcgctttttgtttcgttcttttccaagacaggttctgttgctttttttgcttcttcaagcgattggttcgttttcatatgtgaatcaatgatcttccagctaccgtaacatgtgatgataacacctgcgatgatgacgagaagcggaatatgtttcagtttgttcatcgtgtgcgggttccccttttctttctgaaaagccaatatacgccggcacccgtgatcaccaggccggccaatgccgtctgatggctgcccgctgaagtatcaggcaatgggcggcctttttgtgtgccgctttcagtctgttctgtgctttgttccgaatctgcggcagacgccgtacgggattcgggaattgactgcactgcatcagatgctgcttcttttacgacaggacgttcaggttttttggtttgatcaggctgttctgctgcatccggttttttagcgggtttttccgtttgaggtttttctcctttatcaggcccggtgctgcccggtgtttccccgcttcccggctgattgccggtgtcatcaggtgtttcggcggctgatgccgtgcggatgcggccgtcggtttgataagaaatcggtgcggaaaagcttttgacatagtctactgtcgcttccaaatcctcaggccccgtcaccggattcttgccgagtttcccgatcggaccgtattttgcccccgatgccgtcgccataaattgattgactgttactgtatatcctttttcgggctgtatgtctgtaccgtccgccattttcatatccaccgcttgtccggtttccgggttccatgtataggaaaatccgctgatgctgtaatccggtccgtacaccggagaaatttgcgcgttgatgatctcccgcaaatcttttcctttgatttcaagcttcgtcagcacattgccgaacggctgtacattataaagatctccccatgtgatcggccctttttttatgccgtcccggatgcctcccccattcataagcgcaaaatcggatttcatcttcgctttcataccgtcggcaatcagatttccgagcgccgtgtcgccgtcatttgaatacccgcccgttatatcatgggccgcttccccgaccgcttcgctgataatcggtttcactttctcttcatatttgcttaatatgcctgccgcatccggatcaggcttgattttactttgatcgatatattggatttccgctgattttttcacgatatccttcgactctttatctagttcgagatcggcgattccgattgcttttccgtattcaaatgcctgcacgatcagcttgccgttgatttctccgtttacgactttatgattgtgcgcggcgaaaatcacgtcaatctctgagtctgttccgcttgcaagctttgcggattctcccgtgatggctgagccattttgttcagcagacatatgggcgagcacggcgattgctttaattccttttttcttcaggtctgcggcggcgtcattgacggcctttacctcatccgtaaacgtaatatttttaattccgtccgggatgaccatgcctgccgccgatctggttacaaccccgataaatgcgaccggaattccggaaacgtatttgatttcatacggcggcagaaagggctcccctgacttcaatttacagttggcgcagacgagcgggaaatcttggccgtcataaccgcttgtccccttaccgtccggatgatctcctccattgatgatccgtttaagctcattcgttccttcatcgaattcgtgattgccgacagttccgacatcaaaaccgatgtcttccatcagttctactgtcggttcatcctgaaaaagggctgacacgggagagctgcccccgatcatatcgcccgtatgcacgacaaaggcgcgttctttctcggctttcgcctttttaatgtacgcggcggcgtagtccatccgtccgaaagtgccatccggtttaccgtctccgttaaggtcaagctcatattgctgatcaatttttccgtgcagatcattcatgctgatgattctgagcgggatacggccggagtcttcagtctgccgttctttatacgctttatccgttccagcttcattcagtgatccggcttgtccgattgcttccgcatctttcacgctgaacatcataaaacaaaccgtcagcaaacagcacgaaagacgcaaacccctttttttcttcattcatttcccccctgtcttctaagaaatacgttagcttattttgttaaaaatcacatcacttttttgtaaagattgtcttcgctggcgcaaaatagtaaataatccccacgtaacgaaataagtcttaatgtataacggatcggcttttttcacatcttaaatgtgatttgacatgaaggaggaaaacaaccagtggaacagcagcagaatcagcagcagccgccagtaaatcaggggattccgggttcaccgcaagtgaatcacggaggacatgagcttttcgatatgcatgaagtgctggccggaacagtcggcgttttggatcaatttatgatgctcagacagtttatacaggatcagcagctggccgacattcttgaccgccagtatcaattcattctcggactctataatctgacggcagaatgctttaagaccggccaaaagccttctcaggaaacgtcgacatatatgatggaggaacagaaccaggccgtctacggtataaaaccgactcagccgaaaaaaccgaatcaatcattaaatgatgtcaaagatctcggaataagcggccatatgctcggcctgattaaagctcaagcttctctcttgacgatgagctcgcttgaaatgaccaatcccgtcacaagaagagtgctctccgcccaaattcagcaatatgtcgaaatggcgtatgaaatcttcttataccaaaacaaacacggttattatcaggttcctcagctcaatgcacaagatatgcagaccatgctgaattcatttgcgccggcgcagggacagccgcaaatgcctcagattaaaggacaaatgggacagcagcagcaaaacctccattaatgaaaaaaacggcgttggaaacctgactctccaatgccgttttctttttttcatatgcttttgtgaaatcatgttcaaattgcttcaggctttctttcgtagctgcttcaaagcctttttcaaaatcctgtgtttcggcggttttattgataatggttaagataatgccttctccgaatgtttcggttaaatcctttatcatatagaaactttgcaaataaacatccgtttcatattccatacgcgatttctgccattttcggtcggtcgttaattgatcaaacggcacgacggaaaatgcaatcggatcaatgaccacatcataatgcgcaacccactcgctcagcccctcatgaaaccaaagcggaaatacagacgtatccgtccccaattgacgcgttttttgatgaaatgcgtagtgtgtatattcatgtataatcaattgcttatacatgaaaacggccagctcatcttttttcaaaagctgttttttctcttcaggcaaaagccccatcatctgctcctgctctgaataaaaaccgactacatttttcaatcctgagtattgctccatttcagcttcatccgaaaagaaaatgagttcaagaggcgccgctcctttatagccgacaatgatttggttgatacgctttgcgtggtccagcgtaagcttggtcagatccaagagcagcttttcatccgccgtatagtaaatcgctgtatgtttgtaaatttctttattcatgtgttcagtcacttgttccttcgtcggaacagagcggctgttttggcctgacaggacgtacatcatacttactgaaacggctgaactgacagccaatatgacaaggactccgcacaggatcagagtgaatgccgcccgtttccccatgccgtcacgcaaacaagctcccctccccgatcctttaattttcatctcattctttactttatgctcagaagcgctgggtcgtgacggcagataaaataaaaaagccgcagcaaatgcggcttttccattcatttatttattggggtttgggaatacacgctgcaccatttggccgaattcatcaaacagtccggataccgggtggccgttttggattcgttttccgtagccttgcatacgttcaacgaagtccgggtttgctgatacatatacagtccggacatgtttatcggctgatttcaccttatcggtaatcttatttttcaaatggttggcgatggcgcctttttgtccgtttgtcagaacaacggctacataagcgctgtttccggcaacgatcacagtcgcatttttaacttcttttaaatcagtcaccttgtcggcggctttatcagccactctcaggttacggttgtcattgtgatcggtgttttggttatgacggttcactgtattcatatttgtcgcaccgtcgttaggtgtgttgcggtaatttacattctgggtgcggttgtcatttcgttttccttctccctggttccccatactgcaccctgcggtaatcagcatcggcagaagaagggcagaaataactgcttgtttttttatcatgtgaattcctcctttctcactttacgtataggtttttctattcggcgggatttatgcacgccgtttgcattctgagcggtttggataaatatcagaaggatagggaaaggtaagcgtaatcaattgaatgaggagggatttaacttgttcagacaaaaaagcggcatcagcccgacagcgctgctgatcggatcatcgattctgattgcagctttatcacccgaaatccgccggaaaatctccggaatggtttcaggccgaatgcagcataaagatggtacacgctccatgcagcctgctgacctgattcaacaggctttcagcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccatgcagcctgccgagctgatcaaacaggctttcggcggggaatccggcggacagcagcatgagcagacttcccgcaatcactccggctcatcccatacggacggacaggcagaccgcagtaaagaaacttcgccgaagcctcactataccgagccgattcacttcgaagaaagcgcggtaaatgttttaaatgacagcaccgtgatgaatatgctggaagaaattgaacccggaaatcattagaaacgaaaaaaatccttcattcgttcaacgatgaaggatttttcgttttagcgctatctgcttttttattaagcttcttcagcttcaatgacgattgaggaatcattgtacaccgcggtatcggtttccttcgtcattttacttgttaacagccctgcggtcatactgccgctgacatttaaggcggtacgccccatgtcaattaacggctcaattgaaatgagcagcccggcaagcgcgacaggcatgttcaaagcggataggacgagcagagccgcaaatgtcgcgccgccccccacgcctgctacaccgaatgaactgattgccacgatggcgatgacggagatgataaatcccggttcaaacgggttttgccctactgtcggcgcaatcatcatcgcgagcatcgccgggtaaatgccggcacagccgttttgaccgatcgataaaccgaatgaaccggcgaagttcgcaattccttcagggacgcccatgcttttttgcgttttaatattaagcggcaaagcccctgcgcttgaacgggacgtaaacgcaaacaccatgacaggaaatgcttttttcacgtatgtgatcggatttaaaccgctgaacgtaatcagcagcaggtgaatgataaacatgacgataagcgcggcgtatgaagcgatcacaaacatccccagtttcgcaatgctgtcgatgtcgcttgtcgcgatcgtctttgtcataatcgccaataccccgtaaggcgtcaatcttaaaattaacgtcacgacgcgcataataatcgcgtataccgcatcgacaattccgctgaacgtcgcagcgtgctccggctgcttccgtttcacgcccagaaaagcgatgccgaggaaagcggcgaaaataacgactccgatggtggaagtcggtctggctcccgtgaaatcaagaaacggatttcccggcagaagctcaacgatttgctgaggcagcgttttggccgtcatatcctcagatttttgctgcagctcctggcctcttgataactcggtgcttccctggtcgatatggacggctttcagatcaaaagaaagcgccgaaacaattccgactgccgcggcaattgctgtcgtggcgatcaaaattccgatgatcagtccgctgattttcccgatgttatgggtcagtttcagcttcgtaaatgcgccgagaatagaaataaagactagcggcatgacgatcatctgaagcaatttgacataaccgccgccggcgatattaaaccaatcggccgtttgtgtcacgatatgtgatgccggcccgtaaatcaattgcagtgcaaaaccgaatacaatgcctagtccgagcgcggtaaagacacgtttagaaaaggaaacgtgttttttttgcatgacaaacagacctgctataagcaaaagcataataaaaacatgtaagactacaaataaattctccaaaacaggtaaacactcccttgctcattatcctttaacactatattatatcaattccgatcggtcaagtaaggattgacaatatatgtatttttattgatttttctcttttctttccaccctttctctagtaacttatataagggtgattgttatgctgaaggaactgtttcttaatttaacgattttaatcacatttaattatctgttcacccttctttttaaagagtcgctttcgtataaagaagaccgtccgatgtttcaattactgaaggggacggtctgcgggcttttaggggtttttctgattgctttcggcttttcttactccgattccatcattgatctcagaaatatccccattatcatcgccgctctttacggaggctgggtgtctacggcagccgcctttgcgattatcgtcgcaggccgtatcctgatcaatttcaatgcaagcgccattttttccatcgccgccgtcggggttattgcgatactttctgcggccgtcctcagaggaaaaaagccggatcataaaatggcgttcgttatgctgcttttttcaaatgttattttcaccttgacgctgctgtttcttatgcctgaacagcctgccggggccctcgtttattattggctcatttccatcttgggcggaatgctgtcactgtatatcatcaaacacgaagccgatgcccgcgttttgttcaagcaatacaagtttcaagcgaattatgattttctgacgggaatttttaataagagaaaattcgaggaagtctcacgcgttctgtacgatcggacgtctcaatccccctcgtctcagctcgcgcttatttatttggatattgatcactttaagcagatcaatgatcaatacggccattatgaaggggaccaagtgctgaaggaactgggggcgcgcctgaggttcttactcagcagttctcatacgtcagcccgcatcggcggggaagaatttgccgtgcttatgcccaattgcacgtatacaaaagggcttcacctcgcagaggaaatcaggcacacgattgacgcgaacccgattctgctgacgagcggagatacaattcccgtgaccgtttccctcggcatcgcgcattatccgacaaatacaccggaccctcagacattgcccctgatcgcggaccggatgctgtacaaagcgaaaacatcagggcgcaatcaagtgtgcagcactgaaaaaaaagaatgatcgcccgaagaggaaatcattctttcttttcagtgagaaagccgcccctcaggaaaacgggaatcaggctgccctcatattctttttcaatcaacgccgcggtatcatctgattgatacaaagacaggagtttttgcatccgttcatcatctttatcctcagctctgacggcgatcagatgaatatacgcttccttcatttgcgccgatcggatcagcgcgtccttctccgcatgaaatcctgcttttttcgcctcgctttgactgagaactgctgcgtcagcatgttccgccgcctgataggcgttcttttttgtttccgtttttaaggtcagatgcttcgggttgtccttgatcatatccgttgaccccgtaccgctgaatccctttttcaatgtaatcagtccggcctcctgcatgagaaaaagcgccctgccgaaggccgccgcttcatcaggcacggcaatgaccgctccgtccggtatatccttcagccgtttatgttgcttggaatacacccccagcgatgccgcatatgtcgttcctaaaggagccagcttctttttcacgtgaggcggcaaagatttaaaattagtaacggattgaaacgcattggcgtcgagatccccgccggcaagtgccaaatcggcctcagcataatccgaaaacgttaccaaagaaagctgcaatccttcctcaccggcttttttcgcgacaaactcccagatcgattgatcagattcattgattccgatagtaatggtccggttcccgtcaggataatcgcatgaagtaagtgacatgatcaaaatgaaaagaaacagactgtttataagccgcagattcaagttgacctactccctatctatttttatgtacagaagctgcaccatggtattcgggctcatgattacatacaataccgattaaaaaaagggttgtcaattgcttccttaagaggctgcaaagcggtttttatcagctgcaaatgggctgttctggtctcaaatcagatttccgtatcagagcgttttcctcttaaaacatgttatttcgaaaaaagttacatttagcagttgttttttcttcggattactggtagagtaaaggtaattatttttgttcgaactatctttaagaagaaagttttgtaagagttttcgtcttggaagtttgttttagagcaagaatagtgaatttaagcgtttgtcgctttaggaggaaatttcatgttagaaggtaaagtaaaatggttcaactctgaaaaaggattcggattcatcgaagtagaaggtcaagacgatgtattcgttcacttctctgctattcaaggcgaaggcttcaaaactttagaagaaggccaatctgtttctttcgaaatcgttgaaggaaaccgcggaccacaagctgctaacgtaacaaaagcataaattgtttaaaaaaacctgccggtgtacgccggcaggtttttttcatctaaaacgaaaagctgttttgcaaaggcaaaacagcttttttatatcaggtggcaatatcccgttttaagaagacgccgaatgcaagcgccagaaaaataacgaagtaaatcacaagcatcacaaccgaaaatgtcatcgtcatcccctctactaaaggagtcccgttcatatattgcgacaaatccgtgttcgcaaataaaatatatttggtccattcaaatttcgcagcaagaaataccgtcgccgtgttccccataaccaatagaaaaatagaaaatccgaccgctaatgagctgttccggaataccgcagacagcataaacgccatcgtcgcaagcataaaagcggagacagattcatagacatatgttttagcgaggaaagcgatgatattttgctcaaaaacatggccgtctttgtatacgagatgaacatcagccgcagtatctccgcctgtaccgaaaaagaccaatcccaacagagcggagccggcaaataaaatcacaagcatcagcagtccgaacagcagcactgtcatatatttagaaagcaaaatctgaaaacggctgagcggacggatggccagcagcttgatcgtcccccagttgaactcattcgccacgatgcctgcggcaatgataatcgtaaacagcccggtcaaaacagtcatcatcgaagaatcagctacgtatgaccacactgtgtaccctgtatcctcggggatgttatgatccatacggtattgatttatcgcgacattctgtttcaggttatcaatgagcgtctgatttccggtttccttcatctgctgtttcatttctttgttttcagcctggagctcctgtttccaattcggattggcttcgctcgaggtgaaatggtttgacagaagcgcaaaaccgatcatcgaaacgcctaaaatcacaatcatagcccacgtgccgacgcggctgaaaattttaatccattcattatagatcagcttaaacatattgaacctcctctttcgtcccgccggtaatttccaagaaacggtcttccaaagattttgtcatgattttcacttcatataagcggatgttttcacggacgagcagtgatatcacatcaggcacttcctgtttggacagctggatctcaatgccgtttgtcttcttcacacagtcaaactgactcaaaacggcaagagcctcttctctttgttcaatatggaagaagtatgtatctttatcctcttttccttcatcccttactttttgaatatcgacaagctctcctttttgcagaatgccgattcgatcgcacattagctccatttctgacagaagatggcttgagacgatgacagccattcctttttcacgtgtcagctttttcagatggtccctgatttctctgatgccggcgggatcgaggccgtttgtcggctcatccagaatcagcaccttaggattatgcagcaggctttgggcgaggccgagacgctgtctcattccgagagagtaggtttttactttgtcatgtattctgtcctgcaacccgacgagctcgatgacctcatctattttttctttcgtaacgccttttaccatccttgcgtactgctgtaaatttttatagccgctcaggaatttgtacagctccgggttttccacgatggctccgacgtgcctgaccgcttttgcatagtttttcgtaatggattccccgcagattacgatgtctccctgagacagtttcattaatccgaccatcattctgatcgtagtggttttccccgctccgttcggccctaaaaatccaaacacttcgcccgcccggacggagaagctcagatcatgaataatcgttcgtccttttatcgttttctttacctgttgcagttctaataccgtttccaattagaatcccccttctatttcgtgcgcctgcatgacgtttctataccattgcagcacggacattccttcctgttcccgaatttcttcgacctcgcgccgttcagcgattttcccttttatgaaaaccatcacttcgtctaacagcgtctcaatctcgccgatctcatgcgtggcgatgacgacgatctggctgtcaaaatcaatataagatacgagactgttgacaatcgactccctgaccgccggatcaagacccgaaaacggctcatccagcagaatgaccgatgcttttctcgacagggccaaaacgattttcagcctgccccggctgcctttggacagctcttttaacttctgcttcgctgaaagattcatttccgctaataggttatgtgctttttccagctgaaaatccgggaattgcgaatgataaaacgtgagcatatcaccgacggtcgtccgggcggaaaacatatcatgttcggttaaataagccgtacgaaacagcatgttcctgcttactttgcactctcccatccggacggcgcccgatgtcggaaaagcaagccctgcaagcattttaagcgttgttgatttaccgcttccgttcggccctaaaattccgtagattttacccggagacaatgaaaatgatacatcgctgaccgcgatcctgcggccgtatttttttgttacgcgttcaaaatcaagattcatcgtttgcttcctccgcatattgtttgatcccctcgagcatttcctcaggagataaccccagctccgccatttcctgaataaagcgtttgaaaacgtcttttgtcagcctgtctttcagctctgctttcagatcggatctttccgctataaaggttccctgtcctcttctcgtctccacgatccccagcctttccatttcactgtacgttctttgtatcgtgttcggattcactttcatctgtacggccatctcccttacggacggcagtttgtcccccggtgaaagctcacttcggatcagccggtaatatatacgatcggcaatctgcagataaatcggcttggatgactgaaattcattctccatcattacacctcaacctttcgattcagcagcatagaggccagcgcgagacagagcgctgcaagcacgatcactgccaggaagctgaaaagcgaaatgtggacggctttcagctccatcgtccatccggtcaattttgtataatgaaaatgaaaattcgcatacacttttaccggccataaatcatgttgagatgaagtgaaaggcgtaatgattttatcgtcaatataggtccagacaaacgcaagcacgatgcagatcacccaacgcaggacgggaaaatgttttaatgagtgaaaaacagtccaaaatacggccacgatcacagataagtacgctgaactgatcagcaggtaaacattcagcccggttaatgtgccggccaggggaatggtgtgttccagcactccttttgcagaaagcatccggtacatccaaatgccgtaaccggtcagcgccagctgcccgatcaactgatacagcagtgaggccgtcagcttggaagccagcagataaaatcccccattcggattgtaaagccacagctggttttttccttctttatgaaggtgataatacataaaaagcggcgctacaagaaattgaaaaaaccccattgccgtaaaaaagccgaaaatgacgagcggttctttctgacgggcagcgatgacgtgggctgcaaacgcccagcaaatcatgccgcaaagccacaccgcgagccaaatccatgaaactttcgcatcttttttcagcaaacctaaaaacgatgtcattctttctctctccattcggatcaagtgtatgagtaacatagtacactagatcatcacgtattacaatatcttcaataaaaaaaagacaaatccgctcttacgcggatttgccttttcaattacttctttttgttttttaaggagagcagcgcatcacgatagctgctatcctgcattttgccgccgctatcaggatcgtttggttcctgatccgtctcagaagtcttaaacttctgaagcgcctgacggtacacatcatcgcccattgtattctttttctcacggggagattcagattttacaacgacgggagcatgctcggctgagcgctcctcggccggatcatgcttttccggctgttcggctgtagtgccgatcgcttctctcttttcttctttgacatcctgtcctgcagaagtgctgcggacattgaatgtgataagaagtgcaatcacaatgacagcagcaataaccgctataataatggccatataaccctctccttactgtcgtccggcagttagattaccagtgacctggctgacacgtctgccaagcgcacggcctaattgaaggccttcttccgtcatcagcacatcgctgtcaaccgggcatgtgacgcccgcgccgtagtaagagccgtacagcgcgttttcaggaacgttgccgggaagaccgacaacaatcatgccttggtgaaacataggagtgatcagattgtgcatggtcatttctaatccgccgtgtgttgtcgccgtcgtacagaatacagcgccgactttatcaatcagctcgccttcagcccacagatagccgagcctgtcgatccacgcttttaagcctgaactgatggtgccaaagtgacccgggcatccccagataatggcatccatgtctttcagcttgcggatgtctgcttgatcgacatggtcgatcaggacttcagcctcagcgttttctcgtgcgccttcggcaatggcttcagcaagatgttttgtgtgttcgccttcactatcgtacactacgtaaattttcattcaggaaacctcccattcagatgattaagattccttcacttctttaggggccggaagcaatgacagctcctcttttttcttcgcccgctgtttgtctttccgcacgtcacgcaagaacaggctcaggactacgccgataaccgcaaagatcgtcgcccacataaacgcgtcattaatccccataacgttggaattgagtgaagctgttttgtagagatatgaataaacggtttgtttcgccgcatcaagcgacatgttcatgttgaccattaaattcgaaaccgcgctttggaacgactgcatgaagcttggatcagccgtgcttgttttatccgcaatctgcgaataatgcattgtcgtacggttcgtataaatcgttgtgatcaaacttgttccgattgatccgctgatctggcggagcgtgttgctcatcgccgtgccgtggctgttcaaccgtgccggaagctggttcattccggctgtcataacaggcatcattaacagtgacataccgaatgcgcggatggcatagacaagcatgatgtgcgtgtaaggtgtgtcaattgtcaattttgtgtactggaatgtcgttgcgaccgtgatgaccagcccgataatcgcaagcggtctcggaccgattttgtcaaacagaataccggaaatcggcgacatgatcagcatgacaatcgcgcccggcaatagcaagagacccgattgcagcgccgtaaagccgactaagttctgcaggtaaatcggaagcaggaacattcctgtgtaaagcgcaacggtaataatgatattaatgacactggaaagtgagaaaatatcatatttaaatacccggaagtcaagcatcggtttttcagagcgcaattgctgaatgacaaacgcggcaatcgcgatgacaccgacaatgacggtagacagcacgatcggatctccccagccgtcgctgcccgcttcactgactccgtaaagcaatgaggcgaatccgacaatagatagaatcgcacccaagctgtcgagtttgattttttgcggttccaccaagttcttaaagaggaaaaacgctatgataataacgattgccccgatcggaacaaggccgtagaacataatgcgccatgtgtaatgctcgatgatccagccggatagagtcggtccgaccgccggagcaaacatcatcgcaagaccgaaaatccccattcctttccccctgctttcaggcgggaaaataagcagaatggttgtcatgaccagcggctgcaggataccgccgccgaccgcctgaattaaccggccgatcagcatggttgagaagttaggcgcgattccgcagactaacgttcccgctgtaaaacagaacatggctacgagaaagaggcttctctgtccgaaccgggtgattaagaacgcagataacggaatcaaaacaccgttgaccagcatgtatccggtcgtaagccactgaatcgtcgtcgcactcacaccgaactcggtcattaagtgcggcatcgccacgttaagaagcgtttggttcaagatcgccaggaataacccggccataagcacaataagcaatgttttaggactttttacttgattatctgatttagccacctaagacaacctcccttcatggtttgatgactgatctgtattattcagagatttttacagatgcgttcataccaggaagcaccttgtcagatgggttgctgagtgaaattttaacaggaactttttgcgttactttagtgtagttgccgcttgagtttgaagaaggcagcatatcaaatgttgaatttgtcgcataaccgatttcttctactgttccgtcaaatgttgtattaggatcgccgtcaacaattacgtctactttgtttcctacttcaatgtctctaatgtctgtttctttaatgtttgcagtgatgtaaaggtgtttcatgtcaatttcttgggcaattgtcgtaccggcttgcaccatttggccgtttttcacttcgtttttcacgattgttccatccatgatggcttttacgtcagcattttgctgtcctttaatttttgcaacaacgtcgtttttgcttacttctttcccctcatcaaggttccagtcagttactttacccgcagcaggagctgtgatagcagccatgtcgccggcaactttcgcttcatcggtttttacatagtgtgtgctttgataatagtagtaagcacctccgcctataattgcaagaacaacaatcaaaccgataatgttggtcagaattaaacgtcctctgttcattttgttttctcctttcgtttcttcctctatcattttgtggaatgatgataaaaatatgtggggatttttttattttccgtttttcactgcacagccgtttgcaagcttcgttaaactttccgcaagcttgcgcaggtactgcagttcagcggtattgagctgccggtataagaccgccgctttttcggcatattgaacagcagctttctttagaagttcttccccctcttcggttaactgaatcataacaacacgccggtcgtcgtgatagtcgctccgaaccattaggcggcgcttatacagaatatccgtcattctcgtgacagacgccggtttcagatcaagcgacaaagccagccttgaaagctgcgtgcttttgctcttatgtattttgaacatcagcagatactgcagcactgtaatatcaaaaggttcaagcactgtctccagaatcattttctgctttttgtaaatcgatctggaagtatcaaacagttgttcaaaactgagcaaagcgagctctgattcaatcaccgtattttcacctcattcccttaataatagttcacaagataaaatattaataaatgaaagaaggtttgtaaagagaaaagtttcattttttaaggattttttttatgccgttttttctctttatttttaatttaaaaaagccgggtgaagaaccgcggccgcacgattcttcactcggctttatatttaatacgatgctttgcttataccggcttcctcatttttaaaaaagcttttcagcgcttgaaatacgtccgatttctgtttcaggatgtagtatttaaatttatcatctttgacatttttataggcggacatgagggtggaatgcctgttatattgattgacctcaccgtaacagaacagattcgattttttcatgatgtcattgacgagctttacgcaccgggcgttatccgaagtcaggttatctccgtctgaaaaatgaaacggatagatgttgtagcgggcggggtcatatttttcatcaattaattcaagagacttccggtaaacggaggaacagatggtgcctccgctctcgcctttcgagaaaaaatcttcttccgacacaaccttcgcttccgtatggtgggcgataaattcgatatcaaccgtttcatactttgtccgtaaaaatcgtgtcatccaaaaaaagaagctcctcgccatatacttttcccatacgcccatcgaaccgcttgtatccatcatggctaaaacgacagctttcgattccggcttcgtcacatcattccatgttttgtatttcagatcttccggataaatagggtaaaacgacggcttgcctgtcatggcgtttcgtttataggccgacagcatcgtccttttcttatcgatattccctgtcagcccggttttccggatatcattgaactcgatatcggtatggacgatattgtccctttccttttgctgcagattcggcagttctaattcctgaaacagcgcttcttccagatccatcaatgaaacttccgcttcataataatcctcgcctgcctgatcgcctgctccctggccttttccggcgccctgctttttatctgcgccgtctcttgcgacgacatcgccgacttcgctgtcgccgtcgccttggccgacatgtttatttttatcatagttataacggattttatattcatcaagcgaacgaatcgggattttcacaacatcttttccgttggacataataatgctttcctcagtgacaaggtccggaaggttgttttttatcgcttcctgcactttcttttggtggcgctgctggtcgtcaaagcctttgcgatggagggaccagtcttcctctgaaatcaaaaaatttccgctgtcattacgggacatgaattcccctccttaaccgttatggtcgttttacatgtgtattccggcttggtcctgtttatgaaacaagtccggcgaaaagatttatttttatcttatgccggccggactctccaattgacaaacaattgcgaaaaacagacaaaagaacccgtccttttacagacgggcctctcaatgaaatcaaatatcagcggtttaacaagcttccgacatacttcagcagttcattagcgctagtcgaattatagccgtgttcatctattaaccttgccactacctcattgacctttttaagctgctgttcatccggcgttttggtggaggtcgtaattttcactacatcttttaagtctgcgaacagctttttctgaatcgcttcgcggagtctttcgtgcgaattatagtcaaagcgttttccttttcttgcataggcggatatgcggattaagatttcttcgcggaacgcttttttggcgttttctgaaatgccgatctgctcttcaatggatctcatcagtttttcgtcaggattcatttcttcacccgtcagcggatcgcgaagcttatttttattgcagtatgcttccacattatctaaataattgtccatgagagttttcgcggattcttcatatgaataaacgaacgccttctgcacttcctttttggcgatgtcatcgtactctttcctggcggcggaaataaaattcatataccgctctttgtcctcggcggagatggacggatgctggtcgagtccttcttttaaggaacgcagcacgtcaagcgaattgatggattccatattttttctgataatcgttgaggaaatgcggttgatgacatagcgcgggtcaattccgctcattccttcatcatggaattccttcttcatatcctccagatcaacggaattgtaaccttcaacgctttctccgtcatagagcctcatttttttgacgagatcaatatcagagcggttcggttccttcagccgggtcaaaatagaaaacatcgcagccacttttaatgtatggggggcgatgtgtacgtcagaaacatcactttcagaaatcattttttcataaatccgttcttcctctgacacctttaaattataaggaacaggcatcacgatgatcctggagtgaagggcttcgtttttcttattggcaataaacgagcggtactccgtttcgttcgtatgcgcaacaaccaattcgtcggctgagatgagcgcaaaccgtccggctttgaaattcccttcctgcgtgagtgacagaaggtgccacagaaatttttcatcgcatttcagcatttcctgaaattccatcattccgcggttcgctttatttaattcaccgtcaaaccgataagcgcgcggatctgattccgaaccgtattcggcaatcgtcgaaaaatcaatgctccccgtcaaatcggcgatatcctgtgatttcgggtcagacgggctgaaggttccgattccggtacgtttatcctccgagaagaatatacgttcaactttaacatcctcaattctgccgccgtattcttcttcaagccgcatgacattaagcggagaaaggctgccctcaattctgatgccgtattctctgtagaagtcgtcgcgcagatgatggggaatgagatggagaggatcttcatgcatcgggcagcctttaatggcgtaaacagcgccgttatctgtcaatgagtaggcttcaagcccttttttcagcatggtgacaagagttgactttccgccgctgacgggtcccatcaatagtaaaatccgttttctcacatcgagccgcttggcagccgggtgaaagtattcctccacgagccgttccagagattcctcaaggccgaacagctcccgcgagaaaaagctgtatgtctttttcccgtcatcctcctcgattccgctgtcttttatcatattaaaaacgcgagaatgagcagactgcgcgaccaatggattttcttttatgatctccaaataatcagcgaacgtcccttcccatttgagacgctgctcttcctctctgtacttttcaattttctttaatatatccataagaacctcctctatcatggttaatgcactagaaataaggtactttgttacaatctatgcggtgacgtgataatacatgcttttcgtttcttaaaaataaagacgttataaggccgtcattgacaagggtccggtgcaccgttcataatgaaagaaatacagtttcatccagactcggacatcaaatggaaaagcaaagaggaggagacatgatgaaaacgatcattttacttggggtcattctcacttttttagtatccatttttactgcgggttacgacagcaaacctgaaaacaaataacggcaaaagggtgctctttatgaagagcaccctttcctgtacaacataacaatgtttcatatttgaatatgttcttggacagttgatttttcatgagacttacagcttgtttgatactcgatttttccgattttgcagcccgggccgatttccacacgcttccctctgacgatgtccgcttccgtgtattcgaggtaaattgcgtctccttcgatcaattcagcagaaagcatgccggctttccgtttaagaaaaccgggtttccgtctgacggtgatcgatgtgccgccgatttctttcacgcggcttcggtcataacgcaaatggatgtttacgtcccctgcgtttaacaatcccgccacattgatacatcctgttacatgaagcagctccgtctcgcaatcgccgccgacggtgagactgccttttatatgacactgttctcccgcggccccgccgccaatttcagcaagtcccttcagcctcattctggcgaaacgcatggagccgccaattttcaatgtgccgatcacatttgctgaatgtgctgataagtctcctgcaacttcatgctctccgaaaattttcagcctgttgatctcggcatctccgagaaaaagtcccgtgccgaatatccggcagcgttcgctttgaagtccttcgccgacagttccttcccctttaatgcttacattttggtaggaaccgccggaagcgtgtccggctccgtacatttttaaatgactcaatttttttgtcgtttccattgcagctcctcctatcgtttcacgactttgttaaccaaagcggtaggatcacatgtaaaatcgccgctgtattccaccgtcccaatggtgcagcccgcgccgatccgcacatgatttccgcggactgtcttcgcgttcgtgtccgccaattcaatgatgtcaccctcaatcagctctgctgtcagcaccggggccggcatcagcttaaaacgcgtaagcacactctttctgctcatcaccttcaaatggcggcagccgatttctttcacatggctttctcccgccgccagcttcatactgacttcatcggcattcagcaggccgccgatcttgcatttgccttccgaacggaatgtctctgtctcgcaatcaccttcaatcccggctttcccggatatgaaaatatcatcagctttcacaccgccgccgaaagacgaaaatcccgcgacgttcagccgctccgttttgacatcacctttaatgacacccgttccgttgatacggatggattcagcttcggcactgccggaaattttccccgaaccgctgatcgtcagcgtttgcgtcttgacatgtccgtctgtttttccgctgccgttaaacaaaagactcgcgcactccacatcacccgacaccgtgccgcttccgttgatctccactgtatgaaaacggcctccttttgaacttcccgaaccgttaatgattaatttatctgttacttccattgatggtcctcctgcatccatttcgtttttaattcttccgatgccgcagcaagcgccacccgttcaaccactttgacagtcggttcaaataaaatatgttccgcgtctgcgatgaagcacgtcgttacgccaagctttcggagcatgacaagctccgtattcgctttcagctcggaagcctcatacgtcttcagcacccccgccgccaattttccttcctcaaggctgatattgcccgattgcaaaagcccttcaagcacatataaagacagcagcgcgcgggacgtgaatgtcatgccgtcttcgccataaacttgcagcgcggcttttgaaatcagtcccttttgaagcagttccgcagacgttatattgacatcagtcatttgcggagacagcatttctctcatttcatccagagacagattttctttcattttctgtatttttgagatgcgttttaatatttccgctctcggaaaaaatgtttcctggcctgtaaacgtcgattttcggataaaccattcttcaggaattaaatttttccgtttccaccggtacagctgcccgtatgaaattgatgtttcttccagcaattcttttttagaaatcagttgttcctccatgaatccagctccttcgatgaacgtattgtaacataacactgttacgttgttaagcccggaaatataaaaatgccgtaaaccgctgctgcccgtcttttttattcaataaaaaaacgcccggatgcgggcgttttttctcacgtcaaatctctgtaattttgctggcgcagcgcttcatatacaagaatcgcggccgtgttggacagatttaatgatctcacatgctcggtcatcggcagacgcaggcagcggtccatattgttttcgatcaattctttcggaagtccgctcgtttctctgccgaatacgaagaaaaagtcttcctccgtatttgagtaatcaaatgatgtgtgcggcttttgaccgaattttgtaatgaagaaaaactttccgttctcatatgcttcaaataactcttccaatgaatcatgatatacgacgttgacgaactcccaataatcgagtccggcgcgcttcagcattttatcatcggttgagaatccgagcgggcggatcaaatgaagcgttgtgtctgttgccgcacaagtacgtgcgatatttcccgtattggccgggatttcgggttgatataaaacgacatgtaatgccacgatgttcacctctgttttttattccgcccaccattatatcattaattactcttttgtcgtatcatccgtaatatgaaaaaacgcatatctgatggaaggagtatacgccgttgaatcctcatatgaccaatatctcatcctgctgtcatacgtttgggcattgacgagcggcatattgcttttatcttttgcgaccacgatcgccgtatgattaaaacggccgtctccttcaaaatcatagcaaatgatatctccgggcatcagttcttcagctcttgatacttgcactgcgcgaagccctgccttggattgggccagatacatcttcatcgaatgcgcgaccgtccagctgtagctccacgagcttgccttcatccaccagcctgagcctctgttcggatgcccccgcatcggtgcttttccggcatgtaaacattgggaaataaaattggtgcaattatcgctgaaatttttataagcggggtttcgtttattccaaaacttctccgcgtactgcacggcagccagacggtcgtattgaaacgcccgcccgaaatcttcccgttcactccgctcatattcaattacgctgtttccgtcagaaaatccagccggttttttctttacttcccggtctttaatcaaaagctcatcatagagaaatgcagtccgttcctcaatctgctcttctaagtaaaggtgtccgtcatgctccttgcacaaatattcgaaatgaatcgtgtacatgacacataacgtgccgtcgtcctcaagactgcttttgacaatgacggcctttgccttcgctttcacgatatcaactttccgtttttcaaacagctctttttttctcgtcaggacctcaagatcgccggcctgcccattctgcctcatctcagttccgttgattaaataatgaagccgggcctccgctaaatcttcaataatatgcttcaagcgctccacccaccatacgattttataaagaaaaaacacttgaactccggccaagtgctttttctctatacatatgtcaggaccggccggttttagtcttctcagaaaccgataacagctccagccccttttcaatttcccgtatggcgtcctcatcctgctccttttgaagcgctttttctaattcctccgcataatcaggatcaccgattttcccgatggcccaggcggccgtacccctgatgacggggcgcggatcttggtgcatcaaggccgttaattccggaagagacgaggcatctttaaaatgagccaaagctaaaatcgcattccgctgtatcggcttcttgccgcgccatgatcccgatacatgtccgaatttttctttgaattcgcggttgcttatggtcaaaagcggctttaacagcggctttgcgatttccggatcaggctccatctgcggatgaagatgaaaatctttccccttattaatcggacagaccgtctggcacgtatcacagccatacagacggtttccgattttcgtgcggaactcatccggcaaaaatccctttgtctgggtcaggaacgaaatacagcgctgggcgttaagctgtccgggattgacgagggcgccggtcggacacgcgtctagacattttgtgcacgtaccgcacatatcttcaatcggcacatccggttcaaagggaagattggtgatcatttcagccagatagacgtaagaaccgtattcaggcgtggtgatcatgcagtttttggcgctgaagccgattcccgcccgttcagccacggccctgtcggacaattctcctgtatccaccattgactttgtgcggatatcctcatgtttgctttggagaaaattctccagcagatcaagcttttcccgcagcacatcatgataatccttcccccaggaagctctgcaaaaaatgccgcgccgcccgtccctcgtgctcctcggcgcatctttcattttggaaggataagcaagggcgatggcgacgattgatttggctttcgggagaagcaaagacggagtaacccgtttttcaatatccggctcttcaaaaccggataaatagccgagtgattcctgaagaatcagccggtcccgcagactgtcgaacgtatcagccgttgtaaacccgattttgtcgactccgatgcttttggcgtattcgattaattcctctttcagtttatgaatattcattttttgcacagcctcctttctttgtgatcaggctcctgcacgggtataatagagttttatcatcccgaaatggagtgaacacacttgaacatcagtttagatccacttattgctgaacgggtgccggggatcaaagcggcagccgtcttatatgaacagatcgaagtcgggcccgctccgcaaatgctgaaaggccgcctccgtttatttcaagaatctctttactttgattatgctgacggcggtatagatgagcagccttttgttaaagagtgggcgcgtataatggaacagctcagtcccgccttttcaggacaagaaacgccgatggagcttatgctcggcgatatttcccgggaacgattcattgaaagtgtgaattcagcccatgataccatactttttttctccttgaaatattcattgcctatcatggcgtatgacgccgcagaaatagatgaaccgatttcgattacaatcggagaaaaagaacacgtacttgctttttccgactttggcggcattttcggcggccttaccggacatatcaatacccgccctgtaacaaccggcacaaagaaaatgctgcagctgatctttttcccgccttcatttcatgccgacgcggcggatgagctgctatcatccttaaccaaaatgtttgaacaaattcacggaggcacacataccgtctcttggctttcataaaaagacacgccttcgtgtcttttttcacataaaaaaacgcaatacttcgtttatcagagaaacgaaacactgcgttaataacgtatgtatggagcgggtgatgagaatcgaactcacgacatcagcttggaaggctgaggttttaccactaaactacacccgcatcaaagtttttgtcagtaccgatttgatgtttctaatattacatgtatatttttttttcgtcaagggaatgttaaaaaatttgtcgaaaaaaattctttttttgtccacatgttaagttgggtttacattttgttaagaatttcatacaatataaaaaagaagaaaacttgaggtacgccctgatgatgaaaaataaagtaaaagagctgagagccagattcggctattctcaggaaacgctcggaaaagaagccggagccaccagacagacgattgcagcgattgaaaaaggagattatgtgccttcactcttattggcgcttaacatctgccgggctttctcactgccgatggaggaagttttctggctggaggaggagaaaaaatgagtttgaaaagaaaagcgtgttttcaccttgcactctacggattggcctgctggacgcttatttccattatggaagcggcgccgcggatcgctcagtttttccaaacggaggggagcggtgcatttgagctgaatatcactccgtttctgctgtttaccgtttgtgccgcattgtatatctatgccgaaaagaaaaaacgaaacggcaaaaagcataggcttgtgcccgatgaatttgaggaacaggatgaaagagaacgaatgatgacggctaaagcttgccgttcctcgtatatcgccgtttacttctcattgccggccgcagccgttctgcttttgttttatccgctgattcagccgcatctacctttttttccgattcttttgattttcattctgatgatgattcagcatttggcttatgttttcacttttcataagcacggcaaaaactccggttcatgacagatccggagttttttacattaccagctcgcttttttcaccccgggaatccggcctttatgggccagctccctgaatgcgattctggacagtttaaattttctcatatatccgcggggccgccccgtcaccgtacagcggttatgaagcctggccggagcagaatcacgcggcagtttgctcagcgcttcccagtcgccttttgcctttaattctcttcggatgcccgcatattgttcaacaagcttctgccgcttgagctctttgattacttttgatttttttgccatttcagcactcctaacaaatcgtaataattacgttttgtatcatatcatccagatgagcatcgtgcaagctaagcgcttaaaaaggcgggtgaatacccgccttcactgccggcatttccccggaaatgaatccgcagaaagcgcccgccgtcaatgatccgccttgcgacgtcatcagactgtcgctttatttcctcttgcaaaatggtcgtttcccattgcttcacccactctgcgctcaagcttgttagtccgttcattctcaaacggcagaagcggaaacacgagttcagccagataataagcttcttccagatgcggatagcctgaaaagataaacgactcaatgccgagtgcctgatactctaaaattcgatcagcgacagtctgcggatcaccgacaagcgccgtgcccgctccgcctctgaccagtccgatgccggcccagagattcgggctgatctcaagcttcgagcggtcaccgttatgaagatcggccatccgtttttgtcccgatgaatcagcgcgccggagcgcagcctgcgctttcgcaattgtctcttcgtctaagtggctgattaatcgttcagccgcttcccatgcctcttcctcagtctcccggacaatcacgtgaagtctgatgccaaaacgcatcgtccttccttccttggcagcctgttttttaacggtttcaatcttttcttttacctgctccggcggctctccccatgttaaatagacatctgtatgtttcgcagcagcctcaattcccgcctgtgatgaaccgccgaaatataatggcggatgcggagactgttttggcgggaacaggaggttgctgttttccaccttgatatggtccccttcatatgtcaccgtttcgccccgcatgagtccgcgccagacggttaaaaattcttcagtcgccttataacgttcatcgtggctgataaacatgccgtctcccgccagttcataaggatctccgcccgctacgacatttacgagcaaacggccgtctgacagccggtccattgtcgacgccattctcgcggcgacagacggctgcatcagtcccggccggaccgccactaaaaatttcaagtcactcgtttcccccgctaaagcggcagccgtcagccacgggtcttcgcatgatctccccgtcggcagcagaacccccgtatacccgagtctgtccgccgcctgtgccacttgcttaaaataaagatgatccgccgttctccctcccgtttgcgtccctaaataccggccgtcaccatgcgtcggaataaaccaaagaatctccatatgaatctctccttttttaataggttacccttcataactgttccgccattttaatagtttccgttcgagcattctgaccaatgcatctgtcagcttgccgacagccgcaaaaatgataatgccgacaaacaccttatttgtctgtgaaaattgtctggcatccataatcatataaccgacgccctcgctcgatcccatcagttccgccaccacgagaccgagccacgcaatgcctagagagagcctgatgccgagcaggatattcggcagagatgccggaagaattaatttcgtcatctgctgataccaattaaattccagcacccgcgcgacgtcaaacagcttcgcgtccacactgcggagtccgagaaacgtattaatatacacggggaaaaaagctcccaatgcgatcagcagaattttagatgtctcatcaaatccgaaccacaaaatgaacagaggagtcacggccaagtgcggaaccgtcctgagcatttgcagagacggatcaagatatgcttccgtccgctttgagaaaccgaccagcagcccgaaaacaagtccgaggcccgcgccaagcagaaatccggcagccgcccggtataaactgatctctaaatgaccccaaagctcacctgaaagaagaagttcctgaaacgtctgcaagatgacgacaggcgacgggagcaccgcggccgagacgatgcccagacttgcgataaactgccatactgcgatgaccgcagccgggagtacaccccccttcacccattggtatgaatacttccgggatcttgccagagctttcttttctgattggcttattgcgccggcagccgttgatgcttctgctttcattacttgccatcccccgtttcaagcgcttttttaataaatgaattgtcgacaacgtcttttacatgaattttcttatgaatcgcttttgttcgatattgaaaatcagcggtttcctgctgggctttgacaatatcatcatcgatcggttcattgagaggctcagtattgttaagcacgtttctgacgactttcggatcaagatgtttgattttcgcatataaggagacggctttatctttgtgttccttttgccatgtaactgctttattgaacactttcagaaaacggacaacctcatccgggtgttctttggaaaatcccgttctgactaatgtgaaaccgggagaatataaatctgtgctttctccgttcgccaatatttccgccccgtgctgcagcgtttcaatcgacaaatacggctcccaaatggaccatgcgtcaactgatttgttttcaaaagcggaaaccgcctcatcaggctgaagctggatgatggtgacgtcatcggcggaaagccccgctttatctaaagctttatagagaaaatcaaagccgctgctgcctttggctacggcgatttttttacctttcaattctttcaggctctgaatcccgctgcccttgtttacgagaatgccgtttgcctttaacccgtcctgagacagcccgatctctttaaaatcaattcccgccgcctgaccggaaatgaccggtgaattgccgacctgggaaaaatcaagcttatcggcggcaagaccttcaaattgcggaggaccgctttggaattcgacccattttacttttattccgtcttttttgaaggcctcttcaaaccagcctttttccttggcaatgagaagcgggcttaaactctgctggatgccgatccggatttctttcaccgttttcccgccccctcctgtcccgtctgcactgcatccggctgacatcatgactgctgcagctaaaagaatgatgatttttttcacttcgcttcgtcccttctatattccggccccatccgcaaaccggaggtcttccgttttctcaaattcagaaagcaccttctgccggacggcctgaaaatccgctgacgtccgattgcgcggatgcggaagctgaatcggcatcaggctgtgcagccggcccggctttgccctgaggatcgccagcttattgcctaaatagacggattcatcaatatcatgcgtgacaagaatcatcgtcgtttttttctcgcgccatatatcaagcagcacatcctgcaaatgttttctcgtaaaagcgtcaagcgccccgaacggttcatctaaaagcagcacctccggctcacgcaaaagggctctggcgatggcaacccgctgcgacatgccgccggataattcgcgcggataagcgttctccgctccctgcagcctgacaacctcaatcagatcatccacttttttccgaacggccgagtcgttcatattgagatcggcagcgatgttttgttttaccgtcagccagggaaacagccggtgctcctgaaagataaatccctgccggatgcccggtcccgacacattgcggccgtttattgcgacagagcctttataatcggtatcaagaccggcaatcaattttaaaagcgtgcttttgccgcatccgctcggtccgatgacagtcaaaaattctcccgatgcaattgacagctcaatatcattcagcaccggcgttttccggccttcatgctcaaaagctttttcttgtatgctgatggttacagccatctgtcttcccctctctttctgccgcatgcgatcgaaaaacaaaaaggcccccatctccgattgcttgcagagatgggagccttcggcggtccgatcggcaacccgtttgtttttaaatttgaatatcatgttaattcaaattattccgacttgtcaactgttttttgtatgaattaaaaatgcgccttccggcataaacctgccaaagagcgcatcggctgtatcacgtatttacttccttttctttccgggcgattttcaataatgtccgcgcgttgttgccgaaaatgttttctatatcttcttcccgcatattgatttcccggcaggtcctcacctgctcctgaagatatctgtatacatatcctctcggaaatccgttcgaatccgtcccgaagatgatccgttcagcaccgattaattcagatgtctttcgaaacagaatttccaaatcaagccggtacggcatccacctcatccactgatttgagccggacgtgtcaatatacacattcgggcagctccagcacagctgcagcagttcctgataatatccggcgccgaaatgcggaatgatgaacggtatatcagcatactctctcgcgacgcgatagatggagagcgggttgatattgcgatggctgacaatgccacccgctctccctaaaagtccgaagtgaattaatacaggcagtcttttgtcagccagatacgtccacagctttttcagcgacggatcatgaaactcgatgtctgtcagcggcccgaacagtttatatcctttcagaccgagctcttcaaccgctcttttcagctcctcatacgcatccttttgttccaaaggatgatatgcaaatccggtaaacctcgcgggattggcttgaataaacgccgccatccggtcattgctctctgctgttaaaaaattcagcacgtcaatgccgtacttatctaattctttctcccatcttgtcatcaaagcgatttcgccgtcatcgccatcaacatcatgcggatcaggaaaatcccaagtgagattcattctttccgaccgctcccggttataatcggaaaatgtcttatcgtttttgccgaaattaaggctgtacggcagatgaccgtgaatatcgactggtttaaaatgctgcctgaaaagcatacaatcgccgcctcccttaccgcctgacaataaaaaaagacccttatccagtgaagaataagagcctcttgtgtccaagtcagcggtttctattttttctcatattaaacccattattcccgtcagtcaagttggtttttaaacccataccttcatttcgataataaaaataattattttataatcattataaaataatattgactttttactgataggtgatattatgttcttataaatttaaagaggtgatcacatgagttcaaataaattgacaaccagctggggcgctcctgtcggagataaccaaaactcaatgacggccggcgatcgcggtcctgctttaatacaagacgtccatctgcttgagaaattggcgcactttaacagagaacgcgttccggagcgtgtcgttcacgcaaaaggcgcgggcgcacacggttattttgaagtcacaaatgacgttacaaaatatacgaaagctgcatttctgtcagaagtcggtaaacgcacgccgcttttcatccgtttctcaaccgttgcgggcgaactgggctctagtgacacagtgcgcgacccgcgcggatttgccgttaaattttatacagaagaaggaaactacgacatcgtcggaaacaatacacccgtgttcttcatccgcgatgccatcaagttccctgactttatccatacacaaaaaagagatccgagaacacatctgaaaaatccgacggccgtttgggatttctggtctttgtcacccgaatccctgcaccaggtaaccattctgatgtcagaccggggcattccggcgactcttcgacatatgcacggattcggaagccatacatttaaatggacaaatgataaaggcgaaggcgtctggattaaatatcactttaaaacagagcaaggcgtgaaaaaccttgatgttaatacagccgcaaaaatcgccggcgaaaatcccgattaccatacggaagatttgttcaatgcgattgaaaacggcgatttccccgcatggaaattatatgttcaaatcatgccgttagaagatgcaaacacatatcgctttgatccgtttgacgtcacaaaagtgtggtctcaaaaagactatccgctgatcgaagtcggccgcatggttctgaaccgcaatccggaaaattactttgcggaagtagaacaggcgacgttctctcccggcacattagtccccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagcttcgggggcccgaaagagtcacctgaagataaacaggcggcatatcctgtatcaggtttcgctgacagtgtaagctataatcatcatgatcattacacacaagccggcgacctgtaccgcctgatgagcgaggaagaacgcgcgcgccttgtcgccaatatcgtcagtgcgatgaaacctgtggaaaaagaagaaattaagctgcgccagatcggccacttctacaaggctgatcctgaatacggcagacgcgttgccgaaggactcggactgccgtcaccaaaataacatcaaaaaacctgccggtctgcccggcaggtttttcctgtttattatcaataaaaccgtttttttctcaattacacgaagtggcatgccgcaaaatgatgaagccctttttctgacagcgccggacttttctcagcacatatcttcttggcttccggacatctcgttcggaatttacagcctgaaggcggatcagaggggctcggtatatcaccctttaaaattatccgctcccttttcgatccgggatcaggaacaggcacggctgataacagcgctttcgtataagggtgaagcggccgtgaaaagagctcctcctttgacgcatattccacaatcgtccctaaatacataatggcgaccttcgtacataagtgctccaccacgcttaaatcatgagaaatgaacaaatatgacagcccgtgctgtttttgaaggctgctgaacaaattgatcatctgcgcctggatggagacatctaacgccgccacgggttcatccataatgataaattgcggcttgagcgccatcgctcttgcaattacgatccgctgccgctgccctccggaaaattcatgcggatatcggtcgataaagtttgcggaaagtccgcaggcttcaagaacttccgccgctttatcacgcgcgttccgcttcaccgccaattgatgctcgatcatcgcttcaccgatggcttctccaatccggcgccggggatttaaagaactgaacggatcttgaaagatgagctgcgcttccgatctgaaagttttgagctcgcgccggctcatccgaaacacatcacgcccctgaaaaaacacctctccccctgttttctcatgaagcctcaaaatggtcttgccgattgatgactttccgctgcccgattctcccgctaagccgaacacttctccctttcctatcgtaaaactgacaccgtcaaccgcttttacgggttttttatgagtctttctcatccccccatgctcctcgtaatattttttcagccccttgacctccagcaacacatcactcatctgctttctcctctctgtaaagccagcacgccgcctgatgccccttcccgaattcagtaaaatgcgggctcgatctccggcatatttccgtgctgtgttcacatcgctccgcaaaataacaagacgatcccgacaggtccgcaagctcggggacctgccccggaatggtgtaaagcgtctcccttttttgaccgataaccggcttggccgcgagcagccctttcgtatacggatgcttcggatcagaaaacagctctgcaaccggtccttcctccacaatttttcccgcatacatgacaatcacataatcagccatttcagcaaccacgccaaggtcatgagtaatgaataaaatagacgtgcgaaattgctttttcatatcccgcaataaatccaatatctgcgcctgaatggttacgtcaagcgctgtcgtcggctcgtcggcaatgatcagtttcggatcgcagcttagcgcgacagccgtcatgatgcgctgcagcatgccgccgctcagctcatgaggatatcggttcataacctgctcggcattcgggatctccactaacgtgatcagttcaacggcctttcgccatgcctctttcttactcagcaacaaatgttcgcgaatcggttcggtcagctgctcaccgattgtaaataccggattcaaagatgtcatcggttcctgaaaaatcatcccgatttcgcttccgcggattttctgcatgtcttttggtttcagttccaacaggttctgtccggaaaaatgcaccgctccccgttcgattctccccgtctcgggaataagctgcataatggacaatgacgccatacttttcccgcagccggactctcctacaatacaaaccgtttcctcctcatgtatcgtaaagctgactccgtccacggcctttaccgcaccctcctctgtataaaaagccgtttccaaatgccttacttctaaaagcggttttttcatttcattttcacctgccgttttaccttaggatcaaaagcgtctcttaaaccgtctccaagcagatgaatcgccacaacggtcagaaaaatggccgttcccggcggaatccacagccacgggcggagtgtaaaatccataaaatgattcgccgcttccatcatgtttccccaagaaggtgtcggcggagcaacgccaagcccgagaaaactcagcgcagattcactcagcatcgctcccgccacatgcaaagtcgccgctaccagtaataacggcaatgtgttgggaagcaaatgatagaggattttccgtttatcactaagccccaaaacttccgcggccatcataaacggctgctccttcagcgacaaaatctgtccgcgtacaagccgcgccaaaccgggccatccgatcaggcttaacatcatcataatcaggtacattctgtattcagaaggcactttccactccgacatcaccgcagccaaaatcaaaagcagcggcaggcccgggatggacatgagcatatcagcaatgcgcataatgatcatatcagcggctccccgataaaacccggccgcagccccgagtaaagagccgatgacaagcgacagcaccattgaagcaagccccacggtcagagaaatctgccccgccagcatcagcctcgtcagcacatctctcccgtactggtcggtgcccagccagtgatggattcccggatgctgattggcatttgaaatatccgtccgatctgttatgtacggagaaaaagacggcccgataaagcacaataaaaacataaaacataagaaaagaagactgatgaccgtcagcttatgctgcagcaggcggcggtacgtctgcttccaaagagaaggcggcacctctttttgttttttcattccgaacaccccctatttcagtctgacccgcggatcaaccgcggcataagcgatatccgccaagaagttccctacaatcgttaaacaagacaaaaacaaggtaaacgccatcaaaaccggataatcacgataatgcacagattcaagctgaatacgtccgacacccggccacccgaaaatctgttcaataatgatggctccggaaaacagtcccggcagttcaaaagcaagcagggtgatggccggaatgagcgcgtttttcaacgcatgtttccagatgacggtgcgctctttcaatcccttcgctctcgccgttctgatataatcctgtctgatcacgtccagcatgccggagcggaaataccttgtcagcgagccgatgccgagcatagataaaatcacgaccggaagaatcatatgtctggcggcttcaagcacatacgaaaaacctgtactcgtgctgccggtatcaatcatcccgccgacggggaatattttcaaatccaccccaaaccacttaataaacagaaggctgataaaaaaagacggaaacgccatggaagcaaaaacaagaaacgtcacgatcccgtcaaaccatgagtatttcctgacagcggatatgacacccgttatcatcgcggctgaccatgtgacaagcaacgccaaagacgcgacaaaaaacgaattccagacatatttccgaagcagtgacaggacgttctcctgatatttcaaagaaaacccaaaatctccgctgagcacatttccgagccatgtcacataacgctgccaaatcggctgatccagcccgtaaagcgcttttaactccttcgctctttccggagtcaggtttacattggaatcaatatagtcgcccggcagcatggcgaataagaaaaaaataataaaggacgtaccgaataagatcacaagcatttgaatgaatcgttctgcggcataccgtttcataaaaagcccctcctttccgctgaaagggcaaaattcccaggatgcatcgggtattttgcccaaccgttctattgaattgagacatttgagagacttgaactgattccagaataattgtcagactcaagcccttttatttttccgctgaccgcccttgcgctctgacggtaatgaatcagaatgtaaggcgggttctccccgagctcccggtacagctggtgataaatttcttttcttttgctgatatcaagcgtgccggctcctttctctatcagccggtccgctttcggattggaataccccgtcacattattgggatggccggaagccagcttttccaccgtgtcattcggatcaaggatctgcgaggtggaaacggcggcaaggtcatattgtttgtcattgattttcgctacttctgtattaaaatccatcacttccggttttaatgagattccgatgtccgcataattttctttcgctatcgggatgaaatcatcatccgctttagatgtgtaatagctgatttcaagctttttgccgtttttttcacgtacaccgtctttgcccgttttccagcctgcttcatcaagaagctttttggctttttcagggttaaacgcataccgattgacacctttgtcatcataagcccacgaaaccggagacaccggaacattcgcgacctctccgtagcgtttaaagcggacatcgacgattttttgacggtcaagtccgtaaataagcgcctgggacactttcttatcttgaaaaggcggacgcttgtgattgacgtacacaagcccgtaatcattcacgacagatacgcttatattcgcaaaaccgagactttttaaatgctgaaccgtatcatcatcaggtgagaaagaagcgtaatcaaggtcacccgtttcaaacagctgaagggaagttgacggatcgataattttataaatcagcttttccgttttcggttttccggcataatagtgttcattagcctgatagcgtatttcctgtcccggaaggtattctgtaaattgataaggtcccgctccgagcggtttggcataaagctcttttaaatagtccagtttgccgaattgatatttcttcccgtagtaggcttctgacagcacctgcccgcccaaaagaagcagcgacttcgcactgactttctcagtcgtgatttgaatggttctgtcatcaaggacgcgaatgccctctatcgtctttgcctttccttctttgtaagccttaccgcctttaatataagccgtggtgatatcttcatagcccgcgtatgcaggatcatgcagcagtgttaaagtgaatgcggcatcctttgcggtcagcggtgaaccgtcgctgaaaacgagattttttcttaaacggaacgtgtatgtaagctgatctttggaaattttccagctttccgcaagagccggggcaggcttccccgttttatccagtttgactaacggttcaaaaataggatctgtcgcatttccatcccagccgttttcgtaaaaatacggcagaaacacgccgcccggcgcggaaatcccagcaacaaaagtgtcagttctggctttcgatttagcgggaatcgccgccggatgagaagctttaaattcctttgtcttgacatgggtgatacgtgtttcttcctttttatcagccgcagatgacggttcttccccggcactccctaacgcgcaccctgataacatgatggataccgacagcgcgagtaccgttgttttcaacctccattttctctccttcatctttatcgaacccccgcatgcttttcatctatctttatataaatctgctccatctgttcctcatttctcataatctcccgtttgtttttctctacaagcagttcgaaattcaatgtgtgttttctgtactttttccgctttttgctctttttgcgcacatgtgataccttttttaacgccacttttcatccctccgcttttcatttaatgactttcacgcaaaaaaggcccttatctgtttaatagataagagccttcggtgatccgatcagccatcgtttggaaatatgtaatgattatgttaattcatacaatccctacctgtcaactataatttaaaatatcgtgtccttccgggggttttcctcatacactctctcatttttccgcatatgctaggaaacatagcagattacaagtgaaagtgagtgagaatgtggaaaagacaacattgagcggtcgcatcgtcaaaaaagatgacccggactataatgccgcaagaaccaatttcaatttaagcctgcaaagatatccagacatcatagtgttttgccaaaacaaacatgacgccctcaatgcggtgagatgggcacgtgagaacaatgtgcctttccgtatcagaggcggaagacacagctacgaaaatttttccctgttaaatgacggactagtcattgatctcagtgaaatgaagaaaataagagtaaatgaggataagcggctggtctcgattgaagcgggagccgaattaggggaagtctaccggacactctggcggtacggcttgacccttcctgcgggaaccattgcgaatgtgggaatcacggggctgacgctcgggggaggaatcggatatttaacaaggactgccggacttacttgcgatcgtctcctccagctcgaaatgatcatagcggacgaaaaagcgggtgctgacttgatcacagtcaaccgctcaaagcactctgatctattttgggcatctcagggcggagggggaggcaacttcggcattgtcacatccatgatgtttaaagccgtgccgatctcgtgcgtgtctgttttttctgtcacttggggctgggatgatttcgaggaagtatttaatacgtggcagcgctgggctccatttacagacaaccggcttacctcatcaattcagttttggcctaaggaagtcaaccgcatagaatcgctcggtcaatttaccgggacaaaagaggagctgaaagaactgctggctccgttaatgaaagcgggaaaaccgacaagcggcttggtcaagacagtgccatttattaaagcggcagccttttttaacagcccgggaggcaatcagccgcaaaagatgaagcggtcaggatcctttattgaaaaaccattatcaacacgcgcaatatccactttaaagcgctatttagagcacgctccgaacgaaaacgccagtgtctggcagcaatctctcggcggggcggccggacggatcgctccggaccaaacggcattctactatcgcaacgcaatcattgcccaagaatatattacaacttggacatctgctgaagaagaaagacaaaatgtccgctggatcgaaggactgagaacgtccctatcaagagaaacgatgggagattatgtgaattggcctgatagagaaatcagaaactggctgcaaacgtattacggagaaaatgttcaccgcctccgtcaagtcaaaacgaaatatgatccggaaaatatattccgcttcgagcagagcattccgccgcttcgccgttcaccgtttttctaaaaaagatgaagatggatacactccatcttcatcttttcttttattgatataagcggcttcccttctctgcaaactcttttgctttttctttcagcccttcattgacggcctcgtcttcagtaagtccgttttccttcgcataatcacgaatatcctgagaaattctcatgctgcagaacttcgggccgcacatcgaacagaagtgagccgtttttgcgccttcagccggcagcgtttcatcatgatattccattgctctttcaggatcaagcgacaaatgaaattgatcacgccaccggaattcaaaccgcgccttagacagagcatcgtcacggatctgtgcacccggatgccctttagccaggtctgcggcatgtgccgcgattttgtacgtaatgacgccttctcttacatcatcacgattcggcagccccaaatgctccttcggcgtgacatagcaaagcatcgccgtcccgtaccagccgatcatcgccgcgccgattgctgaagtaatgtggtcatagcccggagcgatatccgtcgttaatgggccgagcgtgtaaaaaggcgcctctttacaaatttccagctgcttgtccatgttttccttaattttatgcatcggcacatgacccggtccttcgatcatcacttgcacatcgtgcttccacgcaatctccgtcaattctccgagagtctccaattccgcaaactgcgcttcatcattggcatccgcaatcgaacccggacgaagcccgtcaccaagtgaaaaagcgatatcatagctcttcatgatttcacaaatttcttcaaaatgcgtgtacagaaagctttcctgatgatgagccaggcaccattgcgccataatcgccccgccgcgggatacgattcccgtcgtgcgtttagccgttaacgggacgtaacgaagcagtacgccggcatggatggtgaaataatccacgccctgctccgcctgctcaatcaatgtgtcacgataaatgtcccacgttaaatcctcggcaatgccattaactttttcaagcgcctgataaatcggcaccgtccccacaggcacggggcagttgcggataatccattcacgcgtcgtatgaatgtcttttcccgtggataaatccatcatcgtatcggcgccccagcgaatcgcccacgtcattttttcgacttcttcttcgatagaagatgtaacagccgagttgccgatattggcattaattttcacatgaaaattccggccgataatcatcggctcgctttccgggtggttgacgttagaaggaataatcgcccggccgctggctacctcgtctctgacaaattcgggagacacatgctcgcgaattgcgataaactccatttccggcgtaatgatgccttttctcgcataatgcaattgtgttacatttttccccggcttggcccgaagcggtttccgctgcaggccggggtattcggcagcatgatcttcttttttatagccgttgtcttcaggtctcacggtccggccgttatattcttctacatctccgcgcccggtaatccactttgtgcggagcgcccccagaccttcatgaatatcaatctgtacatccgggtctgtatacggtccgctcgtatcataaacacggaccggcgcattctcctcttccccgaatgcccccgtagtcgcactcaggctgatttcccgcatcggcactcgtatgtcgggcgaagaaccttctgcataaacctttttactgccggaaaaactcgacataatggaaatgttcgcttgctgtactgattgattttgcatacaaatctctcctttatcatttgaataacagaaccaagctcagcaccagcacaaaaaaaccgggttcaaagaagaacccgattttgcagtcagaaagaaactattattgttttcctcaacaataataaaacctttacttccccacgctggtacgaaccagatcaggtccaaagggttaagaagccgccgcttctctctcagcccgctcagacgggcacccccagtaactattgatttcgctctcatcgtaacataagttgtgtacaaaaaaaagcatattatcaaaattcagataacggaatggtcataagctctgtttcccgaacgccttcttcggtattaaaaacccgataaccctttgcggtttcccgggatgagacagcccggaacagctgaccgtctttataatgaagcgcagcgccgtcatcagcggcatagccctccctgagtttcttttcagaaatcagacggtgatacaccggccggcgctccgttctccgtcatagtgcggacaaaagctgcccggcaaaaatcctaaagctgttaactctcgcaaatcccccgctgaatccgtcaccccttcttcataccagcaaatcgctccggcgctgagacccgctaagatgatgccgttttcccaagcctcacgaagaataaggtcaagcccccactctttccataagacaagcatattgcgcgtatttccgccgccgacatatataatatctttcttcatgagaaaggatctgagatcagaacccggcggtttaaacagcgataagtgatccggctcacaccgcagcttttgaaaggcctgataaaacctgccggtatatttctccgaatctccgcttgccgtcggcaaaaaacaaactttcggctttgaccgcgccgactgctctaaaatatactgatccagcacaagatgatccggctccatggaaaaccccccgccgcccattgcaataatctgcttcaatgtcatcacctctttttctcaagtgtaacagctcattaaaaaggcgttatcataatttcggataacgccttcaaaaagtatttgttatctgaaaaatacgcaccgtataacacaacggagatccccgcggcgttaatcgccggaacaagcttcgaacgggtacacttcacaacatcgatccccaacaccgtattatcactgaggggagaagcaaaccaaatgttccgctcgctaataataagctggtatgtaactgaaccgccagcgttacgccgagcgccccaagtcccccaggatgacccgataaaataggagataacaacccccagtataaaaagagacggcgcaataaacatatgagggatccatgatgttaaatgagaagtaacatatttcgagaatcccagattttcagctactgctgttacggcccaaatcagcgataacataataataacgttgaccaattcgtttccgcccttaataaaatgggtaacaagctcgcctgcatgaaaacgctgaaacataaaaagagcaaatactgcaataaccgctgccaataatgcgcgcttttgaatggccgacccaccagctgagaaacagtgttaatagcaaaaacagcccgatcggaatgatttaactccacggccgaatcggttccgtatttttgttaatgtttgcgagcagaagtttgtccgctcttttctgttttttctaagctttcgtccgctttttgtttcttaaaaaagcagtaataaattccggctactataatcacaatggagaaaaaattaaagggaatacttttcacatataccgtgtaagccgactgatctattcctgactttttgagggcctgtccgataatggaaaccatgtagccaaatgccgttgctatcggaatcaagggaatgacagggtttgtcgtaaactcaatggcatacgcaattttctgtttcgacaggtccagaggcttgcttaaagctttcatgatcggtgcaattgtgacgatgcgaaagtccggttcactgaacgtgccaaatgtcaacagccatgcaagcagcatcgcaccttttttggttttaacttttttactgatcaaatggacgaatccttttttcccgccggtcagctttataatccctacaaggccggcaaatgaatatagaaacacaatgattctactattattgatgacgacaatgttgctgattacatattgaaccatatgttcaatcccaccaagcaagctgggatgcaaaagatagcttccgaccagcaaaccgacaaacagaccggactgcacttactttgtaatgatgaaatgggagtgaccagaataaatggaataagacaagcccaagtccctaccataaaaaacacctctttcaaagaactttttgttagtatctttgaaaaaagcggatttatacaatcagcaggtatcatgttttcacaagccttggaggatattttcatacaacaaaaaaggcttctacaatatgtagaagcctttttatactggtggccgaggtcgaaccggcactccagaaggaacacgattttgagtcgaaaagttcctcctgcacctaattttattatcgttaatttcccggtggtattaagtaattctgtagataatttaagtctagaataattttatattaacacgacttgtacttaattatactatattctgcagaaataaataaagaatatttttgtgcattatgttaccagggacaatattgtaacattagacatgttttaaaattattgcctttatctcttcataaacttcaatattctcaaattctaaatcatctagattatgataaatttttctttcaaggataatccagtaggtgcttccttttttcattttattttgtacgaaacctcttaagttatctcctattgcttcttcaattgaaaaatctttaaagaatgacctaagcgttctattagtaatcagtaacaattgcttattaaggttctgattattgaagatatctttaaaaacttcaacatttattttgtcggcagaatcgtattccttatctgcatgtttattgaccatttctgtaattagtaaataatatgttgcaataaaaaggaatgctgaattaactctaaagtcatttgatccactcttatattttagttcttctttagcatacattaaaattaaataaggaaagagaaaatgttctaaaggtagacctttagtttcttcattcattatatctttccacctactacctactggagtcaattcgttagctcgcccataagctacattcggcattagttttatagcagctgtaaaagattgaattacttctttcgcaggcagaacgtattttttctttctattaacacttccaagcaaataattataactatcattacctctataggactcttgttcttttcgatctaaagttatgaatgctcctctttgtatttcataaaaataacccaaatttttcattcgatcttttaagccattttgaaatctgtctaaagcataaaaatccagccctctaacagcattttggctatttgtgtaccttgtaatattgtctcttaactctttcttttgagattcctcagcacttcgtttagttttaatcactttcacaagcaagtgtccattggattctaaagcagagagttctttattggtcttgtgcttatagaaatcccccagagttttggcagtttggcatccattaactatttgcggtgctttcattactaaactccccatagtctcatagtactcatcacaaaccacagtaaccccattattgtaataccaaaagttctcaggttcatttcttatagtatctttaatacctttgttaattttagtactctttagatagtttcttatatttgaatggaagagaaggttttcaccttcgttaacaaattgagaaaagtctttaactcttacttttgctacagtcgtttcgaaagtagagaaattctcttctatattcaacctgaacgttttttcacgaaagtcttttggtaacagtcccttttttatttctatactttcctgaatatcatctaaatcatgtaagaagaaatttaaattcttaaattccatactaagatgttttaagttggattttatttgcactctttcccaatcacttatatggttgttcgtaatatagtaacaatttatagtctcatcattctgatatgactctctaacatttttacatgcttctttgacagaatctctttctgtagttggttcttctatacatactcgttggcaatcagctataaacctttgggtggagtcaatattgtgggatgtcttatacttactttgtaataagtgaacttcaccgttatattcaaaaaccgcgtctaaaccgttatcaaacttcccacctatttctttagcttctgctacttcgtcttctcttaactcgaatatgttataaagtatccactcacaaaaactgtccccgacacttacagagtcattacttccacgctcactaagatactcttctatagattcttcaatttgattttgtaaaattaggtcgtatttgttctttttcgctacacccacactcatctctccttaggtaataacttcacaggatgattttaacactaaatctcttaaaaaaacacgtaaagcccttaagcgagcattgatagtaattatcctgtttcctttataattattcacgtacagtattacatttcctttgcgtgttcttcagtaaaggttttacgggtttaatagttgagtatctattctttgatctcttaagtttatcaaaaaagcactaaattcattcgtgtattattttatagtgtgtgatcttaaattttcgcaactcacagtttattgcctcctgaaatcattctacatatgactttgtttcgctttctaagatagccaatcccttttcgtctaagatgtttttacgtctagccatcatgacaattcctctttctctgtgaacacgattagtgccacaatttgaaattatattgtcatgtgaataaaacccattaaaacaagaaaaaacgccttcctacactactgtagaaagacgttaaaaacgttgatattacttaattcttctttaattgacgttttctaaagttaataccggtggccggggtcgaaccggcactccagaaggaacacgattttgagtcgtgcgcgtctgccaattccgccacaccggcatgtaatccgtcgtgttcaaccgacgtatataaatataacatgcattttataaagtgtcaatggttttagtgaagttttttcaaatggtaatgcagtatatacgatacaagcaagaaacttatattgatagtcttcactcttttattatataaaaaaagcgacctgcaatatgcaaatcactctcatatatgttttataataagaaaattgatgaccaatttaacataatccgctcaaagttaaattggtgccgagggccggacttgaa
